United States Patent 8,216,786 (GENETIC POLYMORPHISMS ASSOCIATED WITH CARDIOVASCULAR DISEASES, METHODS OF DETECTION AND USES THEREOF) - sequence listing, part 12

SEQ ID NO: 1291 - DNA, 168955 bp, Homo sapiens
agatggggaaaaaacagagcagaaaaactggaaactctaaaaatcagagcgcctctcctcctccaaaggaacgcagctcctcaccagcaacggaacaaagctggacggagaatgactttgacgagttgagagaagaaggcttcagacgatcaaactactctgagctaaaggaggaagttcgaacccatggcaaagaaattaaaaaccttgaaaaaaaattaggtgaatggctaactagaataaccaatgcagagcagtccttaaaggacccgatggagctgaaaaccaaggcacgagaactacatgacgaattcacaagcctcagtagctgattcgatcaactggaagaaagggtatcagtgatggaagatgacatgaatgaaacgaagcgagaagagaagtttagagaaaaaagaattaaaagaaatgaacaaagcctccaagaaatatgggactatgtgaaaagactaaatctacgtctgattggtgtacctgaaagtgatggggagaatggaaccaagctggaaaacactctggggaagttctcctggataatatcctgcaatctagcaaggcaggccaacactcaaattcaggaaatacagagaacgccagaaagatactcctcgagaagagcaactccaagacacataattggcagattcaccaaagttgaaatgaaggaaaaaatgttaagggcagccagagagaaaagtcgggttacccacaaagggaagcccatcagactaacagctgatctcttggcagaaactctacaagccagaagagagtgggggccaatattcaacattctcaaagaaaagaattttcaaccagaatttcatatccagccaaactaagcttcataagtgaaggagaaacaaaatcctttacagacaagcaaatgctgagagattttgtcaccaccaggcctgccctaaaagagctcctgaagaaagcactaaacatggaaaaaacaaccggtaccagccactgcaaaaacaggccaaattgtaaagaccatcgaggctaggaagaaactgcatcaactaacgagcaaaataaccagctaacatcataatgacaggatcaaattcacatataacaatattaaccttaaatgtaaatgggctaaatgctccaattaaaagacacagagtggcaaattggataaacagtcaagacccatcagtgtgctgtattcaggaaacctatctcacgtgcagagacacacataggctcaaaattaagggatggaggaagatctaccaagcaaatgacaaacaaaaaaatgcaggagttgcaatcctagtctctgataaaacagactttaaaccaacaaagatcaaaagagacaaagaaagccgttacataatggtaaagggatcaactcaacaagaagagctaactatcctaaacatatatgcacccaatacaggagcacccagattcataaagcaagtccttagtgacctacaaagagacttagactcccacacaataataatgggagactttaacaccccactgtcaacattagacagatcaatgagacagaaagttaacaaggatatccaggaattgaactcagctctgcaccaagtggacctaacagacatctacagaactctccaccccaaatcaacagaatatacattcttttcagcaccacaccacacctattccaaaattgaccacataattggaagtaaagcactcctcagcaaatgtaaaagaacagaaattataacaaactgtctctcagaccacagtgcaatcaaactagaactcaggattaagaaattcactcaaaactgctcaactacatggaaactgaacaacctgctcctgaatgacgactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagctagcagaaggcaagaagtaactaaaatcagagcagaactgaaggaaatagagacacaaaaaacccttcaaaaaaatcaatgaatccaggagctggttttttgaaaagatcaacaaaattgatagaccgctagcaagactaataaagaagaaaagagagaagaatcaaatagatgcaataaaaaatgataaaggggatatcaccactgatcccacagaaatacaaactaccatcagagaatactataaacacctctacgtgaataaactagaaaatctagaagaaatggataaattccttgacacatacactctcccaagactaaaccaggaagaagttgaatctctgaatagaccaataacaggctctgaaattgtggcaataatcaatagcttaccaaccaaaaatagtccaggaccagatggattcacagccgaattctaccagaggtacaaaggaggagctggtaccattccttctgaaactattccaatcaacacaaaaagagggaatcctccctaactcattttatgaggccagcatcatcctgatagcaaagcctggcagagacacaaccaaaaaagagaattttagaccaatatccttgatgaacattgatgcaaaaatcctcaataaaatattggcaaaccgaatccagcagcacatcaaaaagcttatccaccatgatcaagtgggcttcatcctgggatgcaaggctggttcaacatatgaaaatcaataaacgtaatccagcatataaacagaaccaaagacaaaaacgacatgattatctcaatagatgcagaaaaggcctttgacacaattcaacaacgccttcatgctaaaaactctcaataaattaggtactgaggggacgtatctcagaataataagagctatctgtgacaaacccacagccaatatcatactgaacggacaaaaactggaagcattccctttgaaaactggtacaagacagggatgccctctcaccactcctattcaacatagtgttggaagttctggccagggcaatcaggcaggagaaggaaataaagggtattcaattaggaaaacaggaagtcaaattgtccctgtttgcagatgacatgacggtatatctagaaaacctcatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactataaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaagaaactactttaaagttcatatggaaccaaaaaagagcccgcattgccaagtcaatcctaagccaaaagaacaaagctggaggcatcatgctacctgacttcaaaccatactacaaggctacagtaaccaaaacagcatggtactggtaccaaaacagagatatagaccaatggaacagaacagagccctcagaaataatgccgcatatctacaaccatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagatttacatgtttgacctaaaaccgtaaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaataaccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcggggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccataaaaaatgatgagttcatgtcctttgtagggacatggatgaaattggaaatcatcattctcagtaactatcgcaaggacaaaaaaccaaacacggcatattctcactcataggtgggaattgaacaatgagaacacatggacacaggaaggggaacatcacacaccagggactcttgtggggtaggggaggggggagggatagcattaggagatatacctaatgctaaatgatgatttaatgggtgcagcacaccaacatggcacatgtatacatatgtaacaaacctgtatgttgtgcacatgtaccctaaaacttaaaagaataataataatacaaaataaataaaaataaattgtacatcaagtaaaaaaattaaaaaactagagaagcaagagcgaacaaattcaaaagctagcagaagacaaaaaataactaagatcagagcagaaatgaaggagatagacacacgaaaaacccttcaaagaaccagagagtgactttcaattgaaggacagagccataccaaggtgaccttacagggaaacagctgggagagtaaatacctaatttcactcttccctgtctctgatctacagcccagctagaagccaggaggagcagacaccctgctgatggagcccaacaaggtcagcctcccatgtctgagagaagaatggattctggttctggaggagcagtcaaaagatatcggcaaaaactctgtcacagtattggccactttaaaaaatagatatattccatacttctgcagtgagatgggctgaaaatatatttgaagctgttatatgaaaagccacaaaacctttcctagctccagctccctggttgtagtttcatgactgtggttcatatgttttatttttaaattcccttttctattactgttttaaaatgtactttgtctaagatatgtattaaagggccatattttaggaaagtccataaggagaccttctttgagaaatgacatatccctttttctttaaccatcactctcatcccctctttggctatgacatttccattgttagcagttggtaggaaccaggccaaggatcacaaggagccaggaattgctgagctgactgaactgcctttattccccggctttggagcacctggatcaaccatacacatttactgctgcttctgatgatgtgtttttacactgaatgcatttttcatgttgtttgttaaagatatgcagggagagtaactcagatgattctaataacatgattatattgagataggactaagggagaattttggtgtttgcaaagaaattatttttaagttctctttttttttcctgtagaaagatgttgtgtccctcctggtgagcgctgtcccagtgcacccgataatggcgaagaaaatgtggtaaggcattatttcctttatcaaaccatatacagtataaaaatgcttctttaaaagggtaattgaagttctgactgattcacatatcatcaagcaagacttttatacagaaaaaaacagcagcaggggttgcaggataatatagcacgaaaaatataattaggcttttcccaatgtctataattaaacaggctctacttgcttaaatacatggttgttcttcttgtctcctattgttatttgtagagaagatctccaatggcattgtgcatatgagggtgagccaatgtacttattcttatgatagaagcatgaaacatgggattgtatacaagtggaaagaaacacaactataattcacttgcaaattatagtttgattgtatacttcctttttactgcattccttttagtatttatgtgttccattaatcagagtataaataagggccaggagtgtggtaaacttgttttttccactgttaaaaaccatgaaacagctagtagggagattaaaattaactgataagactcagacttattttataatggtctcatggatctttaatttcagatgcaagcaatagactaaagctttttgccgcccaccccaaaacactactatcaataaatatttaagatataaatggttattctgacttgaacaacagacatttagagtctatttttcttgcttctagcctctttcaggaaaagtataggaaatgagagaagactgtgacaactcatgacctgcatccttaatatccagtgacttcatctcccctttcttcaccacaattccaggcaatggcctgtcggagcagacaattctaccactgcaaagagttgtaaccattttctggtatcacatttatttttcaagacatacttttcaagacatcattcactgacccactacctgcattgagtataaatgcctggatgttaaggattccaatttaactttgaaaagaactgtctcattcatttacatttctgttacagtcagcccaggaggttacagtgagctctccactaagaatctggaagaaatgcatcactaggggttgattcccaatctgatcaactgataatgggtgagagagcaggtaagagccaaagtcaccttagtggaaaggttaaaaaccagagcctggaaaccaagatgattgatttgacaaggtattttagtctagttttatatgaacggttgtatcagggtaaccaactcgatttgggatgaatcttagggcaccaaagactaagacagtatctttaagattgctagggaaaagggccctatgtgtcaggcctctgagcccaagccaagcatcgcatcccctgtgatttgcacgtatacatccagatggcctaaagtaactgaagatccacaaaagaagtaaaaatagccttaactgatgacattccaccattgtgatttgttcctgccccaccctaactgatcaatgtactttgtaatctcccccacccttaagaaggtactttgtaatcttccccacccttaagaaggttctttgtaattctccccacccttgagaatgtactttgtgagatccaccctgcccacaaaacattgctcttaacttcaccgcctaacccaaaacctataagaactaatgataatccatcacccttcgctgactctcttttcggactcagcccacctgcacccaggtgaaataaacagctttattgctcacacaaagcctgtttggtggtctcttcacatggatgcacatgaaactatgaacataagaatctctgaagttaggttacacttgaccacacaaggcttgcatagttgagtgactagccatgaagataatttaaacaactcttctggctcaattggcatattgctaatcaatcttctaataaatttagattttcatataaatttttaagcaagagaagggagaactcagctaacctaatctgtttcccttaattttagtcatcaatttacataaaagaaacagtctaatgttaatgcttgtgaacttgtcactataaccaggcttttgtgtgacttagtagatcaaggtttcaactctataagagaaagcaaattctgaattgtggtgtaactgccacctggtccaattttatctgacctcagtttcacaatcctctccttgtatgtagttaactctgtttttgctacaatgttgtgatgggttatcacaaatagcaaagtattaagaattccagtcagaatgttaattattaaaaagtcaaacaatagatgctggcaaggctgtggagaaacaggaatgcctttacactcttggtgggaatgtaaattagttcaaccattgtggaagactgtgtggcgattcctcaaggatctagaaacagaaataccatttgaaccagcaatcccattactgggtatatacccaaaggattataaatcattctactataaagacacatgcacatgtatgtttattgcactatttacaatagtaaagacatggaaccaacccgaatacccatcaatggtagactggataaagaaaatgtgatacaaacaccatggaatactatgcagccatgaaaaggaatgagatcatgtcctttgcatggacatggatgaagctggaagccatcattatcagcaaactaacacaggaacagaaaaccaaaccacatgttctcactcataagtgggagctgaacaaggagaacacatggacacagggaggggaacaacacacaccagggcctgttgcagggtggggggcgggggagggaacctagaggacggttcaataggtacagcaaaccaccatggcacacatatacctatgtaacaaacctgcatgttctgcacgtgtatcccagaacttacttaaagtaaattttttttaaaaaaataaatataacttagatatcttttaaaaaaattccattgtgaagaaaaactccattgagataatatttgtctaccatctctgcttccccctagccttggttcctttttaaaaattgtgtcctagtgagagaacatgatacttaataacaaaactggatgcatccccaagctgaagttttactttactgagtatgtgcctggggtgtggagaaacaatagcatcctaacttcaggattggtaatatgacaacagcaaatttctaagaaaaggtttgggatatagagatgtttcctgaatataaacattggcttattaaaggataattccaaacattttttactgaagttttaaaaaattactattccaggaaaaaaaaaaaaccctagaaaagttccatgttaaatgtttcatgttgttttctcattgcgttaagaccgatggtaagaaggagcgactgctttggatacagcccgacacacatacctgctagttcactctgtggctgtgcatccctctccgccaaccacaaaactcaaatttggttcaccttgctcaaaatggtaccctgatttttcaagagcatccactttgatctgtctgagccaaccctgacaattgcagtcctcttgccactagactggttcagcataagcagataaagaaatctgctcactagggtatgaggaaaattattccagaggtctgtttctgggaaagtgtttctccattttaagaagagacaggttatcgtatggggagaaaatgctcaggactgctgaagtcctcttacggcgacaagagattccgacaagaatgaacctgggtcctctgataccactgagtccctgaattaatcgtcaagctacccatatgagtcagggttggatcagggaggcagaatcagagaatgacagaataaagatttattatagagcttcagccttacacaattgtgggtgctggtggagaagtctaggccaggctgttccctctgcatctggttctgggcctgaagtcactgtaggtcgactgtgaatgcagcaaggatgaagggaagtccataagaacaaacagaacccatgtctgtctcacggcctccactgcaatgctgtgtgtgatctcaggaaaagctgatgctggttgccatggagctgcacacacacctggccagtactttgcaaagctgaaggaggaggctggcaggagctggaagagctctgggtccagggagctgtctctggtctcttctagctcccctttttggcctggagtcatattttcaagctgtcaccatgcttgggtctgtacactgaccttatgagtataaaatagctgctgatcaaattaatgcaaatttctttatgacctactccaatccagaaccatgagagagaggaattccgggacatgttcctccagctgagccaaatcggtactgcacaaatccagcatattacctgtcactgaatgtctcgtgtggggttacctccatgtttaaagcatgtaccagcatatagcctacatgtgtgttgattaggagagttttgcctacatgttcaaattgcctaactatagctatatttatatcacaatgctgaggagatcttatgacttccattctaccactgctggctcacaatatacattcatagatttaggggtgaatcaagccaaagttgcctaactttagtaaaaaccattcaccaacatgccctagtccccatgaagcgtgactggtctaaggacatcttctatgagtcctacccattaagaggaaatatggacaaaggatcaagtatttattcattttttaaacatcagaattgaaaaggttcttccatttatttaatctgtcatgtgaagcattagaaggtagtttacttgcatttgaggatcaaaaaatccccattaactgtggaagcaatgatattccctttaattatttttctaattgccttgtttatatggtgtgaaaagcaatttaaacatgtttttaaaaatgtttccatgcaacctaagtttttggccatgaaacagcaccttccttgtacttctccagctgttgtcctttcaaagcaggggatgctattcttcttgaacctgaaaaacagaatgtcagtgtgttctgtgaatttcctgtgattttcaccagtggaacacatgtccagaaccaagctgagtcccttccagaggtaagcaggccttagccaactcttcattaacttcaaagggaggcagggaattgaggcaattatctgcattacagaaagcagaccctggtaattcaccccaagggcatgctcggtcactctcaattttctgcctgccttgtcttgccaatgaaggcagcgcccccctttgccaaccccataaggagaaagattctgcagccacatcaccagtttgctccccagccctgacacagaattctatcagcaaacctcttccttgtgcatatgacagttgaggattttttggcttttcttctgtgaaggggaaacaattagtcattgcactgccaaggaaggttttcctattcctctctggcctctcaaaagcaatttctacttcactcactctgttctttgttgaaaataactgtgacaaagtcgaatgcatggcatctgttttgaaggcccttcaacctcctgcagctgaatgcaattgcagcacatgggaagcacctccctaaacaagtcattacatggggttgctggtgggctctgcagagaagaccctaaatccagtgccacaacacttctcaaattgaggccaaagttcaaaccacttaattgcccctctcgcataggacttatccttgaggcagctattcaggcatcagtaaaaaatttctggagtctctcaatgattcatatttcttatatttagatctaagtatattcaatataaccaactcttaggctctccttcaaaagagatgcttttgacctcccttaaggtagtatttatgcatattattggcaaccctatcaacttaccttgcagggttactagtaattcagttagggcctggattcatttgtataaaataatcaggagtccatggaacaaagatgattttaaaaagcacagatggatcggctcaaaatttggagtgaactctttccatagtagacacatgtgtgactttttaccatgtcaatatggagtccaagagggaagacgtttaagattgaggcagtgaaggaaaacaaatgcaagagtcttgctttgtagttctctgctttatattcctgattctgcccgaaaacacagagaaagagggctggtgatgcaccacgtttaaaaaaaaaataataataatgaaatgatggtgcctaactatgccagaagctatgctcagtgatttcaggcaatctattagctaataccacattatccaatctcctttgattcctttcgcctaaagccagacctcgtttaaaaactgtgtgttcctgggaaaatttcaacaaggaagccaagactacctgaccctaccaaacatttagtacattgttctttgtcactctaccagtaaaatcagggcaatggcctctaccattagattagaagagccattttgtggaccaaagagacatagaaagatcctttctctgtgtttttgggcagaatcaggaatataaagcagagaactacaaagcaagactctggtatttgttttccttcactgcctcaattttaaacatcttccctcttggactccaaattgatatggtacaaagtcacgtatgtgtctactgtggaaagagttcattctgaattttgagccgatccatctgtgctttttaaaatcaactttgttccatggactcctgactactttacactaatgaatccaggccctaaatcttagatcctgcaagttaacatggaagtaagcatttgaaaagtataaatacaatgtgcatgtcactcaaatgcttagcatttcatctaccaggacaagtataatttagcaaacatgggaagattttattggaaccctttgttcttatcttttaaaagcttttaaggagaaaaacaaatttcttgttatactggtccatgcaatgacatcagccctaaacaaacatgattaaagagttagaacagagttgaatatctgccatacctttttcccaaactctcttgctttaattttgagtttattgacttgagattctgccacctctgccctttccttcacttcattcaactcatgttgctgtttcttatacttggaaaggtattgattggcttgtgtttcctataaaaataaaaaaaaaaaaaaagaaatctccatgcctatatagtcaggtgttttttttttctgctctgacatgagaaagttgaataatgtgaaaagaatctaaacttctgagtattgaatgggatatcatattttggtatgatatattaggattcagactttctagcaggtataagatccatttttttataacttttgttccttggaaattcagaacctagttggcacttttcatcaactggatgcagtaaagctctcacagactgaaaatgtgctagaataaccacagttgtctattttgtcatgagtttaacatcctattctacccctgggtagagggggcttgtctttaaaattatatgggtcaacaggtaattattagaccttgggctagaacaggtagtgttttaggccaaatcattgaaataatcaaaacccctcaagagttaatattagggataaatcaatatatatgacacttatcaattacattccctgtagttatagatactgacccagggatggcaagtacatttcaatttatggtggttttgtccacaaccatatccaggatcatcaagaacaaatactgtgaaccatgtttatgtttacccaaggttttgggatgagggaggccccagggtgactaccttgcccaaaactggccttccctacgtgacactctgcttttacctatctcatttcttgttgtgtacctgtttgggtgcaaccacaaaggtaaaggagagagctctggcttcctggagggaaaagccacgcacatttttgccatgggtgagaattctaacttgagaaaaaaaactgaggatgagcagactctaagctgagcaggtcctctctgacaagctgcttgctgagctcagggtcacagatctcccttaatcaaaacaacactgggaaatccatgaggctgaaacttccccaggcactcaccgccacctcgacttgctgcttgtaattttgcacttttagctgaagtttatccatctgagtttgcatcctgctcagattcttcttgtcttcctctgcctgcaatacataggcatgtatgggaaggtgattcagaggatccagcagtctacgttggtgtagtctcatgtggggaaataaggatcagggaactttattaaacatcatctcagagttgtgattttaacaatgggtttaactcacccaagttccaagaaattgataaatagaactgtcagtactaacagtcatttgtcctgatccatcaacctttgctgaaatgggagttaaacccattaggttcagtttgggtcttcagtctttccagctcaaccaagctatatctgcctgaagctatatctgtatacttaaaattagtagtgaattatctactgttatattttactttaaggtggtggtagtgggggtgcattcagatgacgaaaacagcaatagctttagctatagctaaataaaaagctgtatctttatttagcaggaatgaagtgcattattataaaagccacatatgcaaaactgaaaaccaattgctccccaatcaaaacaactattcctttgaactttctaattgactcttggttttgagtaatagaactatagaaaagataaattttctggaattctgatgcggagatagcaaggaagattctacaagctgtggggaccatggtgtgcccattctcattgcctcaattacaatccagcctcgggctgaagaaaggaaatctggtgggataatgtttctcaactgtgctctgcagagcctttggtattccagagagagaggaggctagaggcaggcaggtagataggggtctgcctgccccctctttcctcatgcccctttaactggaatatttccatattggagctattgtacttttcaaaggaagaaaatatctcaatttgctcagggttgagaagctgatttaatcaagaaagatctactactgcttaaaattgttttctggctccatttgacctattccatcaagtatgaacttttttggcagctttaatgttccccctacttaccttccattccccccaccaccacgaacccactccaaccaggtcacattctcctgtttccccagagctcccctgctcactctgtcctccttaggtttagccaagctattctcatcatctggaatgctcccccgccacacacaccaccaccttaaagtaccatgtaaaagtagatattaataattactaattttaaccatcaggaggcagggatgaatatatatgaaagaacctagttggggaactgagacaagtctggttcaaataaaatcccttctttgtttttatctgcctatccctcaacttgtcaggtttataaaattcaaaagactcatagcattatgtgcttacagtaaattataaaatcaacacaggtttaattgctaataatcagtttactgagaagagagtaaattggtcataaaggaggccacacagaagaaaactgaaaaaagctagaagtggttgctgatgttactgatgtccctcccacatgggaaggcaaagccattgatgttaggcctaggttcccatctcagctctagggcattgagtaactggtgaccatgactatgcacgtcctagatttcctatcaagaaaagaacttgacattcagctgtgagaagtgcagttacctgataacctccaactgcagtgcctttgggacccgccacagcattagcattgaggccacacacttcccaggcagcccccaggcaatagctgggcatagtgaagtcactagtgtctggccatttctgcccaacatgggagtcctttctgggcaatctttgtgctggagacttgcccagagctgcactatagtctgacgctcttcccttctcctcttcctccctcagcctctcccttcacgtctctgccccatcctgcttgcttgcatcttcatccttcatagatgttacttctaatagatctcttgtacatctaactctatcctggcatttggttcctagagaaccctctcaacacagcaacttaaccaaattgtatttccttatccctaaaaatgatactacattcttgactagatgtgtaaagattaaataatatctatacagattcctggatgtaggaggcagttgatggtagaaccgagtagatgggtggagagtgaggggcagaggaactatcttgaccttctatagcagttacaagtacctaatcttatgttctgctttatagcacatttttctaggtgctggagagagaaaataggacaagtttccaaatgctaaggggatataaaggagaagataaatgcagcatggggaccagccatagaactgtcatggagtgggaccacacttgactcctttccagtagcagaatcttcccagaggacttttcctaagaaaatgatatttgtgtccctttcaaaatgacatttttaattgcacctaggaatgggctatcaccaaacaccctgcctccttgtcctggtggttattttgatgattgagatgactcagcgttaaccttgaacacttcaaaaccaagtaccaggaaatgtggagtgtcctctaatgtctttttaaacttacagggtctagcctaatgatattagctgatttgatggcagaaaataggcctatctaagcattctgcagacacttggaagaaattaataaatgtacctcattctagtacatgagaaacactaggattattacaatgaagaaacaaaggtaagacacgatagaacaagaatgcattccttgggacaatgaaaaccaaaaaaatatataactttggttttttgttccataatgaagttgtttacagaataaaacaataagaagaatcaatgggaaaataaaaaggaaaatccagacattaaagcagcatttcatgtcatcaacatgggtggcttctccaccttcctcaaagtagaatagcaaacttttaagttcccaaggtgtttacctacttagccacacataccatgggcccacttctcagtggctttgatatacctagcatggtctaaagaagtgtcagactaactcatcttacaaaaggaaccgcttaataataaaagagctgtgcaagtagcttgtttcatcttaattagcccaagatgatgcttctgaagtgctgtgctttcttatctatccttcctgctgcaagggaagaagactttgacatctttaacaactcagcctcaggaaccagaatcaggagtagcagatcttgcattggcattgtcaaagaagctgtaaaaatgggtgcctaaaataaatttgcctttgtattggaataagctgtcatgtgcaatgtgagagggctgggataagctatcatgtgcagtgtgagatagcttactgtccagtgtgagatagctggaacaagctatcatgtgcagtgtgagagggctggaaagtgacttttagcatctgtgttcaacagtggaaatcacacatctactgtgtgataggaggatgccagaccctggaggggagaaaaatacagtgcctctgccatcagagaatctatgttgactgcattagaaggaaaagggaagcaatggttgaaagtgaaaatgtagatgatgatatttttactttagaaatgcattagtcacttgtaagaagtctgcccacctcttttcaattattgcttgagaccaatgttagtcaacaggttagattcagaaagcttcagaggtctctctttagtattttgtttccacctggcaccagcaacagtgtcctcagtggccttgagtgtttgcgcaaccagaaaataggagtggaaatgccccccgctgcaattgaatcagcatcccatgtaacctgccagctgggtagccaccccgagcctctgccattaacttcatttacacattgttctcactcagccactcacaggaaggcatctttatgaaagcactgcaaacactatgtgtgaaaaaatccagatggtataaatagcttttcacttctaattgcaacttgcccctcacattttgtttcctgagagctctgaaaagagaccgatccaaaccactaatagcacaggagctctgggagggtgagtcagtgtctactgctgaaggagaacaaagatgaagagagaacggcaggagtcccagaaggccatttcaggcttgaaggagtacttttctgcagggtagtgcccagccagacaaacagggaatggtttcctggagtacctgataggtcagctctttgatgcatcgctcaagtctgcgggctcccctctgggcctctgcactgcgacggatttcaccctccagttcaccttccagttcacgaacctgcaaccaaaacgtgacctcagaccagacgctgccaccaagtctggcattctatttgctgattggcacaatcatttgaaagacagcaaagtgtcaagggaacatgcacacactgtttttggtgcttaaacaggacagtgtctctgggaaaactctctcgccaaaagtaagatcttttatggattcataaaagaactatttagactgaaatatgtgaaaggctaattcacacagatatgagaagcttttttcttgaattacaaaaccacacccaaagtgtatgtatgaatgtatatgtaagtatagagagtaagcaatgtgtagcccatttgaggatttggtcaacatactacctaatcttaagctgctttccctatgttcagctctgactctctaaagaaatcagatgctgagtttatgtcacatgtatgtcacccacaaccctccagtcctgcttgagctgcctgctgccttatagagttacacaaatgagcttaacattcattcaatgcaggtgcctgctacataccacaccccagtgctagcaatacagcagtgaacaaaacaaacaaaaatctcttccctgaattagcatacgttctaatgaggggaagcagacagacaaaacaaagtaaaatgtaggctatgttgatggagataagtgccatagagagaaataaggcaggagagggagtagggagttgatgttggctgctccccctgcctagggggctcttacccagatatcctcttttcctgccttctccttgacgccaatgccaccttctccaaggggccttcttgagaacgggaaggccagtgccctgaggcaagaatgtgcctagcacatctgaccccacctcttactccccactggagccattcttccctcctgtacctcctcagagaggtgcaacgtgaagggaggggagcaagtgtgagacttccttgtggataaagcccatttaaagcaatcttctgacacctgctatataggaacctgacacacagttctgtctgtcgggatgtgagctcttacaggcccctctactttttttaagcactccttaagaattttggggggggattaaagtgattaaaacaccttggggaaaaactgctctactaaagcaaatcctagacattatgtaattccacctgtaaatactattggatatcattctaataggtaatgatggtatcatggttgtgtctttaagaatattaaccataattccttagtattatctgatattaaggagttcattgctggtcgttgctactgagttatcactggttctaggccataatagtgaacaaacagcaattggaaataaaacctggcaatcttaaaactgagttggaaaaaccagtttcatgtattttttaggggaaaaatgcatacttttaaattttatacctatatgccgtttctcttataccaaaaatcttggttcttatatatgtcattggataaacttactgctaatagcaattaaatgttggtattttgaagttataaatgcatggtttttgccattcttttgttattttgtccttatattgagggatgtatggacaaaacattatgtttaaaagtcactgagaataattcttacttgtgtatgtttaatgcccccaatttaatatatcattaacttcatttgcttccattggtgttaaaattttagagactgctgagtttttttctttgacttaaacttgtttttttaattataaagtatgcaaatgatttatatgattttccaatcaaaacaactaaacaaggtacattaggagggtccaactgtcatctctgtgttatcctctcatagatagccatttttatttttctgatttatcctgttaccatttcattttgaaaatataagcaaatgtgtacaccttcatattctcccactttcttgaacaaaagggtatatacgctttccacattgccctcactgtatgactgtatggaggtacccgaaatggacatgggtattccattgtatggatataccataaacatgcaaaggtgataccttattttttagaggcccttttgaacaattgaatcctagttgaatattctttccattcttgtagcatttatcatatgccttgtctgtagtcattaaaattgattcaataattttacaaatcttattttcaagatgctattactcatttttaagctccctgaaggcagatactacatcatttctgtcagtccttactgtatcttctctaagtctttcttgatcattgatttagttgttttctctctcctttctctggctgtcagaaaatgggcattctctgcagaggaattaacgggagaaaaggcacagaaacaagactgccaggggtgtgtttggaaacaccaggtagccttggagtgagagcctggagctggtgaggtgagcaagaagggctgcaatgttagttagcaagagggaaggcagatttcatccagtccaaggaaagtcctatgtgctcacccaaagtcaagcaaagaatgaatgcatatattgagatctgacactcttaaatatctgaaagtactaaaagcaaaagtgataaagggtatgtgtgttggggggcagatctagtgtcacattccaggacaaagaggtcttgaattggggactgtcaagccctcatgattacccagactcctaccctggattctagtttctggatttgctttctactccccatcagggccatctgttcagcttcagccagccttttctgtaagtctgtaattgtctgctccatattttctcttgtcctttccaagtgggcaatggtgtcttgcttcttcttcagttcttctgacaagtttgctgcctagggggttaaaaaaagggactgagctagttcagcagtcaattgatcttaacatttttacccatgatctttagttcctggtctgactggctgccacgccttgcctctatgtatgtgatctcttcccattataatctccctaaccactaccaccctcgagtttgttaacagtaaggcaatagagacagcagtagctacaggagagaacagggtaaggagtggtggaaacagactaaagatgaagaaacatatgaacattattatgcaacacctgtattaaaataaagatgaccaactgaagcaatggcttttaattgaataaagcactgggatgactgattattgaataaagtaaccggtgtcacattaatgcaccaggaaagatatggagaagtgcctacaaaaatcttttcacatctcacttctataattctgtgattcactacacaaacaagtttggctccaggaatttggcagtaacagatgctctcactgccaataatctggcaagaaaaaggttaattgtgaagcctgctcttggctttggctgtgtgtacaagggcttggtgtctcaatgcaatcattaagaactgttttgagaatctctaggtacatttaatgtaagaacatggccctcacagcccaagcttttctgtctatcaggttaccaaccatctgcagaatttaagtgtgagacttctatgcagatggtgagggcaaagaatgaattacattctgtgatgtggggttgggactcagagctaaactgtgggaggcttggaggctggggtcagagatgagttcacttttcaacactgtcaagaaaatcttatcaaggcaagattaagcagagagcatcttcataatatatgattgcatatgtttatcaaacaggagcagctatttttattcctttctacctgtgtggattttcataaatgttacacatatttgttcccttggccatcaaacatcttcaagatttcacacacctcgttttcctcagagatcagaatatccgccttgatacaaaagggatgagtgaataggcatggttgcccattcttagagggggctggattctacaatgattaggtggttgggatttggtgcaatggttttgtttagttccccaagtgttaaataacttgagcaaatatagatacaagctcttcacctcctttgaattttaaagtgactaatgtaaaatataatcaaatgtcctgtctcctagtttagcaggggaatctgcttcccttcatgtgggaggatcagggctgttgcatgtggctgtgcatttgatgggctgcacaaaagctcttgatggagaaggggtgagcagagacagaaaccaaccccaagccccactctgcaagctctgggaccttcaaagctgaatctgccacacacaaacctccccctccactaacatatttttcccagtggtaccttccgctaaccatgcccgctgagagaagtgctgcatctgcccacagggggtgcccagagggtggccttttttcagtccctatgaaggtgcgccaaagctggcagccaactctgagctcaacatcatttaggaaaatcactgccatcatcaactggaaaataaagaaagtacagcagccctgaaacccttttttaccaacctgattttgctcttcaagcagtagtacaggttgtaaaaaaaataagtgaattaaacattctttccaaatcatcatcataaaactgttatagaccctaggaaaaatagctttttgtaaggaaacacagaaagaattgtttctagacactagatgtattgattcacaaatgaaaagtggcttaaccaaaacaaaagaagactcctgcttttataaggttttgcttatagcaattcaactgctccttttcatcaccagggtatgttggtgggaggagctaattggcctaatttttcaagatgagaacagggaggcagagaggtcagactaacctccccctggctgtatgggaaatcaatggaatactttttggctgcagatgtggccctgccccttggccactgcgccagtgaactctgggagacaggattgagtacgtggtcaagggacccacctcaatggctgccttcttggccttctcttctgcattttgacactcctgcaccacctcttcagcttctttctgcatccgggcaacatcagcctccagtttcttcttctggctgaggaggcttgtgttctaaagaaaagcagcattcctattaggcaagtaaaaaccagcaatgcaaatgcaagctggtctgttcaggacatgcaatgggagtcagctctggccagaagcaaattttattatagtgagccatagtcccttaagcagtgctcccaatcccgaaaggcttttgccatcaaacttgaatggaagggatttcacccattagaagttcaagactaaagagatggcagcctgaatcagaagggaagaagggtatctagataacctacaagccccaaacgtgtttggttttcaatgggttgaggaaatgtttctctgccacttgcttttggatgtggtagaaacaagtgttctagagcagaagttggggtcagttgcagacatctgaggagcagaggttggggaataaaaattgtaactccaagtatgctgctccagaaacaaacaaaaaaaatcattcctcttctttttgtacttcccttcctatcttactttacagtgaggaggtggggaaagtagttcagaataagcctcctccagcccttaggtaccctcattaccacggaggattctttgtgttctgtggttggtgctgccctaattctttccttcctgagttgtgacactagaggccaaatatccttttgctgctatttggtctgtgtttgaagcccagcttttctgagggtgtgaaaactcgcagtgtatataaaaggcataggctttctatttttttatttctcctttcactttatccgtttcacattcacttgcctctggctagtgcctttctcagtagcaggatgaagacttggaaatagaaggatactccaggccaggtgtggtggcccatgcctgtaatcctagcactttgggaggctgacgggggtgaatctcctgagctcaggagtttgagaccagcctgggcaacatggtgaaaccccgtctctaccaaaacttttaccaaaaatagttgggtgtggtggcatacagctgtggtcccagttattcgggaggctgaggtgagaggattgcttgagcctgggaggcgggggttgcagtgaaccgagattgcaccattgcactccaacctgagtgacagagtgagactccgtctcaaaaaagaaaaataaaaaatagaatgatattccagcatcactggttctatctaccccatttctctatggcatgaagcatctttatcaagactgccatcttttgtccttatggaaagccaggccctgtatacctcctagatttccactgccatggcctgagagatggggtggaattaagttgtattttcctgaagtgttttttggatgctcacagcacagactccatagaaactatttctttgtagaggaaggtataagtacaaatactaatttgtttgtacatagaatcctttaaaatttgctagggagacaagggtttaaatctttgcaaactgaattactctctaatttgttttttttttctttctttttttttttttttaggagaaagggagttaggaagtgctttgcagaaaggtaatctagattgtcacagctcaagtttgaaaaagacacctgtaatcagtcaaagataagtttagcctcaaatgttagtcctaggctggagatctggaaatgcaggaggtagctaagaaggctccctaaaaggttcagtatgttttgcttgataatgttctagtaactgcaaggtgccgcagcatggtttaggttggggagaggtccttgtgaataatatcacctagaccagtgctggtcaaagggtagtctttctatgagcagtagcacctgagaacatgttcactttctaggtcccattgcagagcttctgatttagtggatctggggtgagatctgagaatttacatttttgtgttagggattcttatatgtacacatcaagtttcagaaactctgccctagagaccaggtctcctctacctaattttcttcttccccaaatcctctcctctctatgaatgctttttctctagctgatcctcatctctctctaggctagtgattttgcatcatattggatcccactggtgcattatcatgtatgatatgcatggcaaatgatttgttaccaacagcaattaagtactatagaccagcggtccccaacccatttggtttcatggaagaaaatttttccatagaccaggtagcagggttggggggagacggtttggggatgaaactgttccacctcagattatgaggcattagattctcctaaggagcatgcaacctacatctctcacatgagcagttcataagagcatttgcactcctatgagaatctagtgctgctgctgatctgacaggaggcaaagctctctcccctgcagctcacctcctgctgtgcagcccagttcctaataggccccagacctgtactggtctgtggcccagggattgggaaaccttgttctagacagtggatgagttacttttttaaaaaaagtctgtagtctattttataagaatccaactcattgtatttaaactttcttgaaggagaaaaaaaaaatgtttgagttagcctgttgggaattatctataacctacagactatttgttctataccacatggtacccagacgggattgtgtcatacacatggacacaaaagtcaaactgtaggcacaaactaattacaacatctttcaacaggcacatttctggtttatactttcttttatccagtatttttcagtagggggaacattggcattctggaaggggcagttccttgggattatccttcaccttgaaggagttttggtatctctggaccctactcactaaatgccagtggtatttcccagtcactgtggcaactaaaatgatcccacagatgtttctaaatgccccagagtgtagcagttctgcccctaggtgctttaatctgtccttcacaataatcaccacagtaaaacttcctaaaatgcaaatctgataacttcactcttagctactcaaaattcttcagtggctctccatgagctgcaagataaaattcaaactccatcactctcaggctcagggtcactggtgacctggccccacctatctcagcatgatttctgatccttctggctatccaccgaatactctagcatgtgaatttcccttagaatcctaaactccttccccctgcccccatgtctctgcccttgactttcctctctacctggctggcttcttacatgtccttcatgactcagaagaagcatactgtgcagctacctaactcttggattgtcaaagaaggctttctgtaggggtgtgcttgctatatcattatacttttagcagtgtactacaattgcttagttcaatcttcatttttttaggacagtggagacattctgtgtctataccatccataccagtccaggttatggtgggggtgccctataaacacttatcacacaacccatttactatagatgtttgtcctagaaactatggcttcttctgattctaggataaggagaaggatctaagaattcttgcttcgtgtcacttacataaccttccattagaagccagagtccagacggtgtatcatatttgtcagcagccactcagaattgttagggctttcctggctccaagacaggagcattgtttttatcctgggatgctggggaagcacatggcttagagagagcaggagaaccaggagcaggagtggttctggaacattagggaatgttcatccctccctccccagcatcctggctgtggatgccctgacaatccattcttctggcataaggcttattgttatgggttgaattttgtctcacacacacacaaaaagatatgttgaagtcctaaccccttatttatcagaatgtgaccttatctggaaatagggtcttattttgtttaaaaggaagctggaaaaaagggaggtagggggtaaatgagttaaaatgaggccattagggtggaccttaatcaaatatgactggtacccctataaaaagtggcaatttggacagcaacagaccctcgcagcgggaagatgctgtgaagacacaggaagaacaccatgtgaaggcggaaggttagagtgatgcatccataagccaaggaatggcaaagattgccggtaagccaccagaaactaggaaggggcaaggaaggatttccctacaggtttcagagggagcatggcccagctgacactttgattgcaggcttccaacctccaggaatgcgagaaaataaacttccgttgctttacgccaccctgtttgtggtactttgttatggcggcctgagggaaataacacacttgggaacaaatgaagagtatgaacatgccttgcttcacaggcacatccaagacttaacagggcgactgtgcatggtccaaggccgccccaagtgtgggaaccactgccttcaaccaactggcccagctaatagggagagtatatgggccccacctgggtatagaaaagattgattctttctgttgcttccaggagctcttcttctgacagcctgcggccacgctctgtctgctcttgcagggaccttagatcctctagttcagactgaagaagagagttgcgccgctcagccacagccacctgctccttcagatcactgttcagttgtgtgctgtcatccagctgcatttgaaggtcctgggagagaaaagatgggtctggagtacagatccctctgagttcaacatagactatgcacctacacatgcatgatctgactatatatttagacataagcatgctccttctctctggaaagattagatttgttgtcctcatctttactgctgaacacaatctgttgcttagtttgcttccataagcagaaacattttccacccctccctaccccatcttacagttttaaaataccttgatttgaatctgaagctggcccagggatttggttgcttctgacacctgccggttggcacagctaagctggagttccatctcattgaggtcctcttccatcttcttcttcagccgggtaacctcaattctgctcttagcttcagaatccagactagactgcagggagtcaatggtacactgctgcttcctcctaatttgaaataacatttggagtgggggaaatgacacatccaaattaatcaaattcacctgctatgtttaaaacagtacaagaaacagaaaaagaataaaatccaagataaattttaagtaactaacaaaatgagtctaagtgcttttattttaaaaacagagagaatgagaagttaggttagtgagtatatgtccaccataatggactacgtagggtttccagaccaacttccctgaagaattcaggaaaatacaagaagcttttcaaggtcctgtgaggcagctttagtcttatctgatatcccataaaggatgacctagggcaagcacctgggtttcctgtggtggctaaggatgaaggaaggatgctctttcagacagccgtaatatttcaactactttcaatgatgaaaaatgtctgaacaaggcaggaaaaagccactcaggttggaacaattcttgagatgcagcaatactgctatagtagcctggagacacaactctcctagaataaaatggttatctttctctaggagtttgagagtacacccaaggattggctgagacaaccaattgtgtgatattgaattactttaacactttaaattccttcctaagaaaaaaaactagaactaaaaacgtatttgcaaagtgacagaagacaatagctatgtgtttaggaaggccataaaaaataaaaaattgggagaatccatgggaatttgtatttcccaaactgtttgtagttagtttgggactatgtgactagattctggtaaatgcactgtggagaataatgaagtttaccattccagggctggcccatagaaatgttcacttgtgagatcctgcactctcccttccccctttctaccaaacttgatggccacatacagaaggtcatggagtcacaagatggaaagaacctgggtctttcaatgactttgaatgttattgaccgactcttcatcctacctcacaatggcctcaaacataggcaaaaataaacttctatttgttttaagtcaccaagatttggtgattgttaggacagtttaactgctgtaattgacacatgacctgttaagctcaattcatgaaacagggacctggtgctggacagataatagagaacagagaaggcaaaaacctttctattcttctttctcatagagcctatctccacaaatcagattagatcagaattagattccatgttgaattgtcatcaagccagtgtcctaagctctgtgaggtcgattaagaaggcatacaggccgggcgcagtggctcacacctgtaatcccagcactttgggaggccgaggtgggcagatcgagaccagcctggccaacacggtgaaatcccatccctactaaaaatacaaatattagccaggcgtggtggcatgtgtctgtagtcccagctacttgggaggctgaggcaggagaatcacttgaacccagaaggcagaggttgcagtgagccaagtttgcaccactgcactccagcctgggcaacaaagcgagactcttgtctcaaaaaaagaaaaaaagaaggcatacggcctacagggggaagagagaggtcagagcttgaaattggttgacaggtggaggtgctacttttcgtgacccccattctgcccactggtgagggaggcctcagaagcaattatggaaatgtatagaaaataactctgtctggctccagagcccaatgtgagcacctatcctctgccaaccccatctccctggtcctcacaagctgaggttggtatctcatgcctgtccttaggctctgggcttttgtccagcttccagatcagaatcctgtagggatcccactaggtaaagttaatatggacttttaggaactgcattatgtccccaccaaaatttacacgttcttgccgtaacccccaagacttcagaatatgactatatttggagatagggcctttaaagatgtaattaagattaaatgaggctgttaggatggggccctaatccaatgggactagttagcatccttataagaagaggaagagacacagggatgcatgtgcgcagaggaaagcacagatgaggatgcagtgaaaatgtgaccgtctgcaagccaaggaggatcatcaggagaaaccaaacctgccaacactttgatcttgaagctttagtctccagagctgtaaggaaatacatttctgctgttgaagccacccatctgtgcattttgttatgacagccatagtaaaccaatacagggatgctcacactcacatcaccaaaatctgtcagacacttatctgtcctacattgggaaactctcatttttgccacagctggctctccttacacaggaacactgaagcatccccagcctggtgtcaaaatcctctgtacagaaatacattctacttaagcagacaaactgcatgtttcaaactgcacttttcccacagttgtttatgaaacttcatgagtgcctgcagacaagtaaaaagtgagatggtttaaaaggcatgggtataatacagtcctgtagaatggctgctgaacaatcaacatgtttcatacagagtcaagaaatctttaaaatgaaaactccctcaagtacattctttaagaaacatgatgcattcaggaccaagggcaatataggaagaagtaccttctttttcctaaaatgtgaaatacaatttaaaaaacaaatgcaaagaaaaatcaagatgatagaacttggaagagctaatgatttaaaatcattagctcagcatttaaatcattgacaatgcagtaggtcatttatttcccttacgatattgctaatctatgtatgagaaataagagatttttttttcttaatccaaatacatatgagccagctttaaaataattaacaagctattttgctaccatgtctgagtttgaggttctaattttcaaagacactcgaaaatattttacttagaagtgagaaaagatttgagcatattctggcagagattcactcagacaataaaagaaaccaagtcagatggtgtatataaattaagaccacgtggcaaagtttgacatgactgagttcagaggagtggactttacagaaggaacattactatatacctggggctgtagaccagggttgggaaaactatgggctgtgggccaaatcccaccatgcccatttatttcctattgtctatggctgtttccaacctacaactacagtgttaagtagttgccacatctctgtggcaaacaaaacatgtagctagcaaagcatttaacatctgaccctttagagaaaaagcttgcctagcctttcaatcagtgatcaacccaaaacaaacaagcacagtatgatagaataaagaagttcagtgcctcattcccaaaaacacctctctgggtgtgtctgggagagcagaatacagctcagaaagaccatggctgtggaccagtgtgatgactctcacatttcaacatttcctccaatcagagaattccctgaagatgcaggatgcacctgaccaacctgttgtcagctcagtcttgggccatgcagtagggcttgactaacatggcaattatggcaatgatttggccttcaagctagccttgtttcctgtctaataagatgggaagatcaaagccagctaccagctcttcttctccttccatcagtgactgcaccgtcacctccctacctctacctgtgtcaactataacattatttatttattatagaaataaatggaataccctatcatccaaaaatgtctatgaagccctgactagaatatgaggcacagtgtctggtgaacattaagcactccaatatctgttgaacaagtgaaacatatcacatacataccagctgcttgtacttttcacccccaacaggcctccaggctgggctcattcagaatcaggcctcaccagagtggaagacatggcttggcagcagagaattagttgaatgagttacccagtttgctgtactatcaaggttttgcctttgcctgtgggtctctttctcttgctttcctggtccctttaacttacttaccaggtcctgtcttcctgggcaccttctgtttctgtggagttaatgatgggttatatgggcataggaccttgaacctgatcttgccctcaggcaatattttccttgttctataacttccctggcttatcgttgattgcttggaatcttgtgtttggctttttttttttttttttcctcctggcattctattcagtttccttaagatgcccttgctagccccaaagtgaaactatcagattaaaccttggcagtttggtacaatctgtgctcagagcagaaagggtctgggctggtatttgtgatattttgtaagataagctcatcttttctttctggatctacctattatagttattatgaatcattaactaaaatttatgaatagctcacccccctgcctccagtccaccccttcttttctcagctcctcatggctcatgcttatccttcagttctttcttcttccagccctagctctttggatctctggctttttttcgcactaagattattataattggtgaactgctctacgacattcagatgtagctgacgagacacaggctctctgaggattcatttctcctcagctgggtttatttataggcacaggtctgatattacttgaaatcagtgttatttgttgctttttttttttttatctgcacaaggagacattcatttttattccttgtggaaagaagtagggcaaatatcaaggcccagggtttttgcccttcatcaaaaaaattcttttagacactgactcagaacctcttaagtagatcagaattcctcgccacagtcagtcctgtagaagaaaatgccagtgagtgagagcaaagataactcaaagcacatagaaggccaaatttggcttgacaccctcattaaaaaattgacccccttgagagttttgtctaaaaatgggctgtgggaaagaggtcagttcaattgaacatgttaacagggttttttttctttttcttaaaaaaagactgtttaacaaatacattgaaagtaagttgccagttgaatctcaggctcaaatgatttttcttgctgacatatggcattgacttaagggaacagattagataatataatcatcgttaattccatgtgtttataattgtgcctttgatctacagcgtgtgaagtgctttgccaacatcagcctactgatcttcctcaccaccttctgtgacatgtagggactgcttttatcccctcacttcactgagaagctaagaagtggaatgtctaaagtcatcagcttgttatgacaaagctaagaaaacattctgcaacccatgagtcctgtctaattcagtttcctgactattaagactcagctgctttaacaaggattcaataagcagcttagctcttggcttctgctcctcttcaaacaaatggctacaggtacaggcagggggtatgtgaaaacttcactctggtctgaaagtacagcactgaattttttaattttttaatttttttctccatggctcagcattttcagtcaatttcttaatgcccaagaacgtggcattatagggacacgcagacagtatgcacagtccttatacatataatcatttatttggtgttgtcttgagtctcacatgacagtagaagctcctcaaatataagaaaattataaaatctggcaataatcgtatatagatagctagtaagctcaccactattgatataaaggaatatctgtacacaattgtgtataaagggatatctaattgtgtataaaggaatatctatacacaattgtgtataaaaggatatctaattgtgtataaaggaatatctatacacgattatagatattgtatataaaagaaaataatatagagttacactaagtttctttggtaatgctccaacaggggccataaaagcagccagacataatgagctctgtttagtcaaggattcagaaatacataattgttacacatcaaaatcatcttaaatacctaaaattttctatttcttcatctttctctgaaagctttctttcaagttctgctttagcttccaagagttcaagctggaaatgaagaatcttgctttcattacgttccagggctccctggaatacataaataaaaagcattaaatgaagtccacttttagacaaaattgtattttttacccaaaacatatgtcgctaatgtagctctcttagagttactgggagagatataggttcaagccaggtccctagagattgcaacacagtgagacaagcaactgctttcatttgtcatttcacttatagatttgacattcttaggtctttcagctgtagctccagaactagaattttaaagcctattttaaaatagaaaatttcactcttgtctgtgactatatttaaactttttaatgtattacccttgactttttctaacatattccaactttgggataaattttaaaaagtatcagagctagaacaaggaaggtgataactcctacctggaatcttctattaaattctggacatcacgaggggatagaggaaaagttggatgtattcagagaacaaacaacagggtagtgtccaaatattgtcatatgaagaacaaataaaggaatttacaatgtacctgacatgtaacactcagtgtgagccattaacaccataattggtaccactactgcaaatgaatttctttgacaggcagaagattccttgcccctttgtgtattcaaatatagttaaggcaattatttgcagggatgttataaaggcaattcaattctaaaagcataggtttggctaaatctttaaaacccgtcctgaagctaaaaatgtatataaaagaagaaatccaaaaaacacttacagaataccaaggatataagggcataaggggtgatgcaattttgtggtcagttagctacaggcagtcctaagggcagaagtaattttttcatagcctcttttgaggcgtgcttagcagatatgacaaaatgtaaaaaagtaaaactgagttgcaattttaaaataaaaataaaaagatgatgggaattttaataagacctcccttgatgttatcttgatactaccttcaatataaaagaaaataaaattgctaacgcacactcaaaaacaaatgcttggataacaatttcctcagagggaatagtgtagtagttccttcaagaggaaactgtcacctctaaccctctaaaatgcactgagaaagtgaatctttagggaacatgacctgggataatgtgagttttatggctttaaaaaaatctgataaagtttctcataaaggctcacccaggaaaataaataacgcaatgttacaaatacatgtccaagttgatgaagtatttatggatgtggctgaggacagaagtggagaaaatgcgaatagaatgtgttgccatctagtggtactaagtggtttgagcattatggccttcctgtcattctcacccttgacccacgtgatgatcgactgaatacacaaagatgcctctgtgttatacaggacataaatggcccgtgccagttgtatttttcattggcttgtcatagtacttgaaatttctatcataaaatttacttctttcagttaaggtggtggcttcaaaaagtcccttgccaggatagccagagaaccaaagggaacgagtaaacaaaacaaagttcaccaactgtgtaaggaccagctgtgctacagggcaccacactgccaacgaaaaggagtctgtataaagttagatagcctcaggaaacatttatgtataacagggtgagagctgctgcctgacaactctatacagagggtaatatggacacatttgcttggaagtttcttctggaatcacaacggtgaggtaaatttaacagacaatgcttggcacagagtggtcctttggggtcttgttttccatcgccataccttccaagagacccctgcctaacactgactgccacacctttcaaaaatcttttttctttttctactggtgggaggatcagggctgtattttaatgtgtctgaatacttgttcaaaggctgagtcaggaagatgaagttcagctctgagaagaggctgcacagggcttcttaaccacctaagaatcatgataagatgacttccttgttagtttaccttctttggcgaaatgtcttcttagaggtcctttcaattgctaatgcacacccagagatacagccagagacttttcctgaactgtgaatccataacactgaaaaccctcctgtcaatctgcacaaagatgagctttcagaaacaaatgtttgacaacatcactttgaatcttatttctgaaactaccgaaagtttttggggaaaaaaaattgaaaagcttttgtgactgactctttaaagagggggcagctatgagaatatttattcattcaacatttgacaaatatttactgagcctctactacatgccaggcaatgttctaggccagtgcttctcaaatattaatgtgcatatgaaccaccaagggatcttgttaaaatgcagatcctgattcaacagagatgggcagagggctgagattctgaatttctaacagcctcccaagcgatgtccatgggccacatgttgagtagtgagggtctgggcactggggataaactggtgaacaagatagatagttcctgtttttactacaatcaggagatttgcattcactgttgtgtatcctgctctctgagtctcaatttcctcttttataaaatggggacagtagtttcctacggtgattatattaaaattatgcatttggcagagtgcctagcatatagtaaataaacatttgaatacgtgtccttttgttggtgctgctgttattgctgaatgcagatcttctgccttgtcacagtgaaaactttcttttctccctggtgataatacctctgtttcttccagtgtcacctggacttctgtcttctcttcttcaattagtttcttgaccttttccatttcagttaagttcttggtcccttctctaacctggtttgtcagattagaaatctcttctggagacagaggtaagaaaaacaaagttagtgaatgggctcagtctcaaaccaatgataccaggcacaacagattcttccagcccactggaacagtgacctcatgccacccttggtaacttgatgacctatcctatatgggaccgagaaattttaaaagggtattcattttttcatatagtcttttgccatctgaaaattgaaaattgtctacaacaaatggtgagggtggtgcttcagagtattgtacactggacaacttttgcaacttttacatgacagtcctgctcattagagccattccaggttccacctggaggaacacagacctggagtccctacccttccagtgtaagtgcttagctatcaacattagtggctgccattgtttcagccaccactcaacactgcgacaggaacttaaagtaaaagctggatcaatatctgccagcattcaaggcatggccccagataggccagagaatcagaaggggcccaaggaagacagtggctttagctcaagcacttgagtgttttttcctagcctctcatgaacataagcctttgacaaacagaatagggcatccagaagtcacaaaacctcttccacctgatattgttatggtcagttctgcctttagtacctaagaggtgtggtatagggccaagtagctcagagaattacccagttcagaggtggtggaaggagctcaataggtcacctgctcctctggttctgagatcctgggctgtgatgtgatatgatgagaatttttagaagttacaaagacaaatatgttagatggaaattttcattgcataataaattcttctctgagaagtgctctcctaaagatgggttatcaagaagaaaatcagggaagaggttctcaactctgaccgcaccttagaatcacctggagagctttggaaaaagctcactcaatattcaaaccccgccccagtccaaaggtggtgcccagatcagcagcaccggcctcacctggaaaactgtcagaaatacaaatccttcagacctactgagtcagaaactctgggggtgggccccagccatctgtgctttaacaagccctccagctggtttggacgtagctaaagttttctaaccactgttttagcacccgtcacgtctccatctagtgccttgatcatagactatgtaggtcaacagaaagtaagcttcatttacgcctccaacagtaatgaacttgcttccagggcatctcagggttttcatgcacattgctgttggtgctgggataagttggcagcctctttgaagggctgtttggcagtaaatcaaaatttaaaaattcatttcattaccccagcaatttcttttccagggatccattctactgaaatatttttacatgtgcataaatacatgtatagggatatataatgtaggattattcatatttgtgaataattggatctaaaatgaataaagtctagttaaatgatagccatctttattacaaaacactatgtagctattaaaaagcttatggtaggtctccatgtacaggcatgcaaagacccacaaggtacgtgggaaggttgcacagctcagtagttaagtgcgtatatgctggagccgtgctggctgggctcaaatcccagatctgcgacttatcaaatgtgaatttgaacaagttactcaacttatgacctatataaccttcattttacagatgagaaaactaacactagactattctgaaaatttaacaataaatagttaaacagtgcctggtacgtagtatgggctatagaaatattcattaaatcgggaaatatattcatatatgaaaaaaaggtgtagaacaatatgcaatttgggtaaaaactacacacttgagtatagcacacatggaaaatcttggtacggttgtggatatcaagaaattttcagcactggcttcctttacagaggggaactgaagttaaaggtaggaaactagtcttacttttagaattaatttaatacaaacagcatctaaagtaaaaaaaaaataagtcaaacagaagtataaaaattgaaaagttaaaacatgttgggaatgtgaaaatgctgaagacagccttgcctgtagccagggctcttcctgagctacccgctctggctttggctctgagcccagctcggtgtaccttggaggttcttgttctccctcctgagtgtctcctggcccacgatgctctcctcataggtgttcttgagcttgaggagctctgtactgagagcctgaacttccttctgagaggcatccagcaacgcctgggactcctcgtgcttctgcttccagtcggcaagggccttgccagactgcagctgcttctggtccagcctggctgctgcagagcggaccttcccgaggtcagacagggcgtccccgagctccagctgcagctggtgcctggctctctccaaggaggcatttctggcattggccacccccatggcttcggctgcctcctgcaatctaattgccagttccttcctgagaaaggaggacacccaaagagtgagtgaggcaataactctcagagagctcatcaagtctgccctggattaaagatagagcttgggtgcaaagtaagatggcgcctctgcagtggacttagtggtataaagcaacagcagctcctatctgaaagtgacctcactgtctatgaccaccatcctctgcctcctgtgtgcatggggtctttattttccccctttgccaacctgcacttggaactcagaatctctttgaattcctacaaatatttgcttatcctaaagctctaataagcaatactgacttgattatttcctaagaagggggagaaaaggaagattgtactgaacaccctaccaacagtaagcaccttacaaatctgtagccatatgtagtcactaaagagctccttggctgtgttgcttctaaagaacactctcttgctttttcctgcttattttctctcatcatgtggctcctcaacatgacacaattctttcttctctccgagtttgttctccacctcagctcctctctccagatttatattcccaaacccatctcattatgctcacttaacaggtcctactgttcttatggggttttttagcccccatctgctgttccttgggcatctctgagatggagtaatttattacagtgcttctttctccaccacccccgtaatatgctactattaggaattctaatggatgaaatgtgttctgtttcttacatctcctgcagggttgctggcagtcccattcttactcattcattatacttcttagatgaaaagtactgtatgtaccaaagctttttctcatctactgctattaaacagaaaaaaaggttctccggaattaataggactgcataactagcccaacagaggaatgtggtaataaagtccccttttggtggaatcctgcaaaaacccctatgtgctcaggatccaggaagcatctaggctctaacaacactctgcccccggcttcctagccatactcacttcacttttctgcttcatgtttcttaaacgttaagaggatattctgatgctttacctgacttaaggcagtaggagtcaagtgaaataattacatatattttaactactttagaaatgcttgttgataaaataggagtttcactttgggtgactgatcatactggactgcctgggactgaggggtttcaccaggtgatatggtttggctgtgtccccaccaaaatctcatcttgtagttcccataatccccacatgtcatgggagggactagtgggaggtaatttaatcatcgaggcggtaaccttcatgttgttctcatgacagcgagtaagttctcatgagatctgatggttttataaggggctttccccttttttattcactcacttctcttcctgccaccatgtgaagaaggacctatttgcttccccttccaccaggattgtaagtttcctgaggtcgccccagccatggtgaactgtgagtcaattaaatctctttccattataaattacccagtcttgggtatgtctttattagcagtgtgagaacagactaatacaccaggacatgagactttcaaagctaaaacaggaaacatccagggcaaactggacaaactggttacccttgttttaccaataactttgttctacgtttaatatcaactactattttgctccttaacttgccaaccataagcacctacttagttatctcgaatatgtaaagggatattggaaattaagaaactaaatccttatccttggggaacttagaattcagaagcagtacaatgggtcttagataagcttgagtctgctaaactaactcatcatttgaaccccagcctggaaatcaaagcaggcaaatctttaactttaataataacaaaagaaaccaggaccctagattgttttgtagctgcctacctccctgaggtgatttagaggaaaagcataatacagacaaagttttatttattctatgtcccaccaatttgaaagtaaaaaattgtcttcacagagtaccatgtttgccctttattttctttagttattacatactacagaactagttccaacaaacccatgtggtcataaagtaatctatattcttttgctctttcctacccaatcccaaaagaaaccatcaaacagaatgatagataggcaatttcacctgaattcttcaatcattagaagggggaaaaatcttacttcagaagtaaataccatatttggatataagagggcatctcagttcaaagccaaaactttctgtggtccagagttttgataaaacatctactgcaggtatttttagtatctgtcattctaaagccctttttaagttactgtgggtacagagatggatcacttggtaccccttctgggacaaaacacagcagctgttcagcaattgcacagcaatgcctctcaaagatttaggtgaagaactgaaaaacattatttctggttgaagctaaagagaaatgtattgatcttccctggatttttgccaagctaccaagccagggacacattcttttgagtaaaccttgaatgattataagctggggtttgacaatttctcttaaaggtacagtttcctggcctctaagcaaaatgcttcagttctataccctggtactgagtctcaattcagctgtgccccaaacttgtgtaactcctaaaaacttttaaaacctttacatagaaatggctataaaattgatattctaatcttaggggtggcctggggatgatttcttttcaaagcaacctttgtcctagaagacatgacgacagatcctaacatttttttccagcttccctgtccatcttcacagactactttgtagtctacaagttgtagaccagggacacaacgactttgatggagacacgtacacacatggactcaattattatggcgttacaaatgaaatacagggttttaaacgatagcctattttcacaccacggctcaaagtcacatcttttatgaaaacttcccttgtgcccctagaaagagcctcctttctctccccaggacctctttatagtctctgtcactttgtattatactttttatatttttagtccctctacagagtgtgcttcttaccagcagtgcacgtttcagctttggttttgggcttgttcctgcactcggcaaggatttgttaagtgcataccatgaggccttggagacagagtcattattctcatactgctccatgtgagtaactccaggttaaggatagccttgccctactcacttggcatcctccaagtcttctgttctctggatgacattgttttcatacttcattctccattgcaccatttcagcattgactttggataaggtccggtgcagctcagccttgacctcttgttcttcctcatactgctctcgtagaaggtcacagtcacgctgagccttctgcagggcatgggccagggcactctgggactgtaggggacacacattaacaaaaaggtcatgaccaccatgagcaacacaagtcttgaaagtaagctaattttttttttaggtaagattaataacaacctgccacaaattcaagccgaacctgaacctagtaagataacactagggagagaatttgagacaagagaaaggatagatagtatctaattgctgccattaaaacagggaagggaattctatttagagaaatgccagcttggctctgtggacttagacaggcctggaattctagaaatagtggagaatgcaaggatagcaaagagaacattcactatcatttaggcaataagatttatatttagcaatatattagactcagagcttgtttgaaccagaaagaaccactaaaatttagcctttttattccactgatgaagaaaataaaatcttttatttcacactgaaatctctaaaaacctcagctcctaatacttcaaaatagtactactgcccaacagaactttctgtaatggtgaaaatgttctctatgtacactgtccaatatggtaaacacctagccacatgtggctactgaacattcaaaatatgcctagtacaatgtgtgatcaaaactgaattcttaattttatttaactttaatataaatttaaatagttacctgtagtgtagtagaggcttctatatgtattggacggccctgctgggtttaataaacatttttatcatttaaatggtgatctggctaacctagcagcattattccccagagataatctagtgtggaaagaacactagatcctgacgggtcctcaagtgtcctttatgcaaattaggaaaaaagcacattttcaggaagatacagctctgagggcacaaggtttagttaatggcagcctcagccagacccctttgggtggtaaatgaggagccacaatacacaatgactctgaaaaggatgcaggctttggagtcagatgaacttgggttcaaactgtgacctctcctcttgtttaattttatttttctttaaaggaaaaacttttaaaacctttatgtggcatttacatggcatatatttaattatagaagtaaacaagacaaagacaaaatccctgccctaaagagcccaaaagaaataaggggatacacaaaatacacaggcaaatacattaataaataaaatttctaatagcagtaaaacaaacacagcagataaacacgatctagaatgtttggctccttctcatcatccctctaagacttcggtgaagggcctttaagcaacgggaagggcagttataaaagtcctaaggcaggagtgatggtgcctggtttaagaggcagaagggaagccagggcagctggaggggagtaaatgagggaagcagatgtaggaagtaggtcacagaaggaggctggagccagatcaggggggcttgtaggccaattggaagtcactgggaaggcagccagagagatcttctaaaatataactcatttcactatgcgtttaagttccttcacagtacatcactaggtgtatgaccttggacatgatatttttcttctcagagccttggttttttcatatataaggatgcaattctatctgcttcatttgactgatatgaagattgagataacatgacagaagtatctggtacaatgtctgatgcacaaacaatgatacatttttaaatttgtatataatatagaaagtatggagagttaagggaataaaatggtacaatattttaaaacagactcaactacctgtgttttcacagtatacgccttcatagtatggtcatgtacaagtaagatagtttggggtcttagtaataagatgccttgactatgaactaagaattcatttaaatatcagggctcaaagaattcatatctcatgttagtcactatgctttcatcttccagaatcacttccactggagtcaccttctagcaacattatacactcataggaagaaatgactaatttctataatttattgacaatttaaaagtaatattgagctaacccagtcccacttattttattctaggcttttatttaatttcacttttttatgagcagtttcaaaatcaaaatcctgaaagagccttgctgcccttctgttcaagtacttatacaagatgggaacacacactttgcttgctctaaacctgcaacgaagcaatttgaatcaccgaggaagatccttcagtcatcagggttcttcctggcatggtttttcccccataacttctagggcattttcccttcttcttttacaaaacatcttcaggctgattcatcaagcactattttttaaaaaaaaaaacacacagtcaagaaactagtgagaaataatagatacattactttggtctccttttccagctgccctctcaggtcttcaatctgccgagtgaagttgctcttttccctggaaagttggtttatcagagcctccttctcttcaagcctccgtaggaactcgcctacagaaagatttcacaaaactacataattacagtcttcctatctattgcctccttcacttgacttactgactttaagggtagccagaatgactcctacccacatatttttgatatttaggaagggtctgagagtcctattattcagcaaaaccgtggcaatgatcctttccaggactcagaagagagtcctaaaaatgagctgatttttagtaataagtatgaatcgataacagatgatattagttaccatttattgagaaacttctatgctctaggtacttaacgtatgttatctagtttaattttcataactccttgatagtgtaggtattatactaaccattttgcagaggaggaaacagagcaacttaaatatgactgaaacagaaacatacacagttcgtaattggtgaaggtagattcaaatgaagttcttgaagaccacattcttctataccatactcccttgtttattatatgtggctttgtacacttctgtctatataatttttagataattataacttttattacctcacttgtaagatgaagataacaataagattcttaatgaaaactaaattagtgtgaatatattttatagactgaaatgctaaataaatattagcagtagtcactaaatggtaggaaatgtgacgatgagagggagaaattctatcatactctagtctatcgtccctgcttaacttatcctattaattatagtcgggccttccatatctgtaagttctgctttgtgaattcaacctaccgaggtcctacaatttaactcaattctgacactattttcctggagacagtgtcagatacacacacacacgtacaggtatgtatatatatatacacacacacacacacacacacacacacacatatacacacttaaacacacacatatatacacacctatatgtacatgcatatatctttttataaatcacatcgcatacaatattttaaaaatcatatttgttaacatcactgctgagctcatcagaaaagtccaagagttgagagccatcaacctaatgatggcatatacatgttttctaaaatataatttttacctaaaagctcctattttgttattggcaacaaatgttgtcagttgctttccttgaagtgacaggtttcctttgttcatttttgagaaatcatctgccaaacatgtaagcctaaataagcctagtttgtttgtcagtcattctttcaagtaaaagtgatactccctgaaaaaactactagctcagctcagagcttaatcacacatcttactccagtatgaaacaggaattctttatgcatacttcttgttttgtcacacagaatagtaaaaagatatatactcaagttgagatgtaataaaattcatttttcctgcttcttaaggacatccttaagtgaaactgactttttaaaaaaccgtgagtacatattagcgaatacaatttttaccagtatgttttagtgctactaccttgacttgtgatcaggctgcagcaattttaatcatcgttgcttttgcaccatcaatacaaatggcaaaataatttaagttgcaaatagtatcttagtactatactaaaatagcttcaacctcatagaccccctataggctcctgagaatcacttgggatatttaaatcaaactttaagggtatttggatgaaaacatcttgtggctttttttttttttgacagagttttactcttgttgcccaggctggagtgcaatggtgcgatctcagctcactgcaacctccacctcccaggttcaagcgattctcctgtctcagcctcccgtgttgttgttgttttgttttttgagacagagtctcactctgttgcccaggctggagtacagtggttagctgcaacctccgcctccagggttcaagtgattctcctgcctcagcctcccaaatggctgggactacagatgcctgccaccacgcctggctaatttttgtatttttctggtagagacagagttttgccatgttggccaagctggtctcaaactccttgcctcaagtgatccgcctacctcggcctcccaaaattctgggattacaggcatgagccactctgctggtccaaaaacatcttatttaaaaggattctgaagaaatataaatccactagctggttgagactaatacatcacgtatatatcacatttactattggtttcctctgaaagcagagtatggtaagctgacagaacagggcatgagaaagaaactttggtgatagccaccaacaaaaaaacaaaaaacaaaaacaaataaacaatctggaacgtggacccagtgaggggaggataggcttgaataaatttgtacttctaatttaatttacacaaaagccaaccaaaaggtaaagttaaaaaaaggaagaaaaaaatcctgcagcctaagcagaattatcatctcagacccacttttattttactcgctacccactaatttcctcatcaaaaaagtgagtagaaaattaatgccaataactaggggtagacagccaatgcctatcaaaatagattttacacagcacttcctttagggccagacatccaggtattctccagctttgtgtctggactgtggagtctacataccaactaaatcctaaatagcacagatcaaactgggggcttggtagcaaggccaggtgtcacacaccctgtgggcagtataagaagagtcctattcagagtccttaatagaaccaaaaacatttccttcttctagatttccaggtttttagttttatcaactaatttttatttagctctcaccctagatttagcatctggaaatagaggtgtctactggaggaattgtgttatatgtagcccaaatgtgttcattctctttttaaaactgtgtgcctcttaagcatcaagaatacattgtttattttcattgacctaagaattctatctctcagaatatattactaaaactgattttagttatagataaacatctagccacatgctattcatagcagagaggcaagtcaagttgcaggcaaggttaggtttagtcaatctcaatgaattagaagcagtcattataaatgaccgagtatgcaaaatacaaaagcttatgataaattgaaaaagaaaaacccccaacagattgctacaatgtaatagattggaaaaacagaaaaaaaaaatccatagtggttgataataatgaataaactatgggacatttttctacttttaatttatttatcaaatgtttatggaggatcaataaatgccaggcagtgttctagatgattgacatacatcaatgagcaaagacccttgacctcatggagcttatattctgacagatggagacaaacatatttattgtgtcaaatatgtagttagtttgaacttaataaatagtatgaaaagagaagctcttgaggaaatgagttgacagtattcaaatgtcaccttctcagcagggcctatcctgactttgcccagatctccacttgattaacccttatccccaagtctttccagaattaataaggtgttccaggcagagtaaacagctagggcaagactctagggtgggagtatgcccggggtgtacaaagcacagcatagaggtcgacgtggccaacgcagattgagagttcaagggcaagtaggaaaagaggtcagagagaatggggtccaatcatacaggctcaggtagccggctgtacagaccattggttttaccaggtgtaaagagagatgtagattcattatccaaacattaaaaattttaaaaaatttaaatattcaatgaggtagaaattgtaaaaatgtcatgactagtagactgtggattgcccctcccatcctttgatcttgagagttgcttctactgatggcatattattataattttctacttcttggaagggaactaggcaggggttcccaagtggcacagaggtaacacttcctagacaagaggcatgtgtgtggcaaagctgtctcagaggctgcattcctcccctaggatcttcagatgcccactcagcctcagtgggtagttcattatctcagttgtgccttcatgagtctgctgggattgagaattgcctatgagtcaagcagcatacttacttaccactctcactccacagctttgtcttttgtgctgccaggtcatttgccaactgagtcaccttatctagctttgcagttgcttcatgcaagcgctcttcatatagagtacagagtttctcagcatttgcctataagttgagaaagaagggctggtcagggctcacagaggatactctgaatcagctgcacaaaggaagaggggaggagtggctccagggatccgcatgctctcttctgtagtaaagagctcagccagcattgggagatcacatcttctgatttcagcaagcacaattaactctagggtctggaccccaagaggcctaaactttgcagagtataggtgtcacgggagacacccaacttcctgggtattaggatcctttctagaattatttacttttctggagaaggaaacatgtcaaacgctaatgagatacatgatccttttctgacagtacatatttaactgtctttttcactagaatataactctcatgagggtagagatccagtttaaagatataccccctattgtatagaatagtgcctggcacataggagagcaatatgcaagggtggagaggcagacgaaggggaaggaagagaggtaagaaggggaaggaggaggaaggaaatctagaaggctgcccaagcaggatagaagaaagggatggatctaagccgcaacagcctaataacaaaatgtgagctgccaaagcaactgtaccctcctgatcactatggctacaatctcaagatgaccctgttgggttaacacttcaatccccaaacccaacttctcagaattggcttttcatgcctggagaaaaagatatgacattggcctttgcacttttacccaattaaagtaaccagtctaatcgccagactcttgccacactctgagaactcatgctagtggttttgagacccaagatcctcagacgggactaagagttgccaaatgtaagatgaggtatccccttcacatacaaattaactatagtttgcattcttattatttatatggtcagaaacagtaaaattacattggtggtggtcttccatggttctacagattttacatagctgttttgatgaaactcatgtataaattatctttttattatcttttttttttttttttgagacagaggctcactctgtcaccaggctggagtgcaatggcacgatcttggctcactgtaacctccacttcccaggttcaagcgattctcctgcctcagccccctgagtaggtgggattataggcatgcgccaccatgcccagctaatttttgtatttttagtaaagatggggtttcaccattttggtcaggctggtctcgaactcctgaccttgtgatccacccgcctcagcttcccaaagtgctgggattataggcgatctttgaatgccttccatctgccccatcgtgggtgatgatgatgatgacactattaatgataatagcagcagcagttaatttattgggtgcttgttacatacccagctctcttctgagctctatgttttaaatctcaattaatacagcagtccatgaggcctttgtctgtacaaagaaagtatgctatggaaatggaagaactgggagacaaagaagagattacaccaatgaaattttgagaaaacagtgaggtctggtgagatgatgaaagctgatggtgagcctaatagttttcagtgttaacctaattgttatgatagagcaatggccaaaggaccaggaatatttcaaaggtgatgccaggtttagtcctctggaaaacttctgtatcagccaaaacctaggccatctctagctggaacctacgctctgtttaagattgcttccttcatgctatgttgcaggacttttccttagttcagctaaagatggggttctttgtccccggccacaaaaaatcaggctcacagacaatttgaatggtgagtaagacagggtttgattaggtgaaaaggaagaaaagggggaaacagggactctcacaaggccagagtccctgcttgagcgcttgccgcccgcagcttgaatcccaggttccacacaggaagaggaggggccaggcttcaacccaatgcaaatggcgtgaagtttccgaggctccactccagtgggcaggctggttggagtttctccagggaccccctcccacctggctgtctcacttactaatggctattctctgaaagactactgaattatgtcttcttatatctccaatgcagtgttatgtagttccagttcacagatgtcctacagcacacccaagcttggtagaaacagacttaacagagattcaatggccagtttctcgaacgatgccatcaacctcacataggttagagcattaatgttaaatgccagacatgctcaattgtccccactctccactcctaactagaagaaagctatagtagtgatcaatgtgacaatttttaggttgtctgcacagtttctaattatatgttgaatttgtttgctctcacttctgaaaatgactttgacagtcaaagttggcatgctcattttcttcctcacgatatctctcaaaagttcagattgcctctttctacaaatgagaaaactgagcaccagagaggctaaataactagcccaaattcacacagctattaaatgtcagaattggaattcgaactgaaactgcctgtgcagatgcacacacacacagaaaatgtcaaatattagatttctaaacatctgttgtatgaagtggtgataaaggaaatattaaggattaatcgacttgatgtcctaggtggcccaaattgtcatgaatcctgggttccagaggaaaatggataaaaataggatgattatgaaaaccatttttattttatgatgtctccaatagtaaatgacctgttaactgagccaggaggaacatatccaggtgtgaaaaatggcatctgtttagggccctgaatatgctgtgctatgcacctgtgtgcttagggtgaaaaagcacggatctctacaagacaacttagtcaatggtgcgtggaaatggtaagaaaaagagccaaagacttcccagtttttcaagagaggtctccacgtggtgaaggccagctgggctgtgtgtatctgtagagtgggcagcccacttggacagatagaaaaggcacttgcccttaggtatagcttcacatggtaggtatccacataggcactgctaaccactggtatagtgtttccatgtataaagtattttcataaacaggatctgcaaaaagacaattagattgtttatctaacagtggcctatatggggatatagcatgcaaaagagttgtaccctcaaaagaatttttaatttaagcataaggataagcggtatgttttgataccagggatgagaaggttaatagaataaggcacatttatcttatagctgattcttaaaatgatgcataaaaatgctgcctcccagaaatgcagggaccaatgggaattcaaaataatcaagataattgtgaaatttcctataacttctaaattgccctgagcctctctgtcagcataacatgcttttgaaaatgcttcagtctccactgtaccactcagcattggcattcttgccattataattcataaaatgataaagtaaacaattcaaggaacagtttagcctaatgtatatgcctatgagagttaacagaaacaatttatcatgccaacaaatatttaaagcagtaacaggacatgctcaccaacagacatacacaggatttggaattggagttcatctcttccatagaattgtgtgaccttggacaagtcactgaatctatgagctccaagaggtatacgtaaaagttgatgctagtaattgagtgcagagactctacaaagcactgtagtaaacatgaaaaatgagacctagtttctgctttcaatgttagcaaggttaaaagactagataatgcataagtataaagagggaccccaaaagtgctacaggaactcaaaaacaggtaagtctttaatgcaggaggttgaacttgagcattccaaagagaataattagtttggaaaaggcagattggtgtaaaaatgaatatttgtttaaaggcaacctgaaatggaaggtccatgaaacaaagcaatgggatctaaaactggcaagactggttgactctgatcaaaggttacaaggtaccttgaaagcagaagtttggagttcatttttaagcagggacataattcaataaatccgtgctttatgaatattctaaatactttacaaatattaatttgggcatataaatataggatggtttgaaaaaaggaagactagaagcaaaaaagataatttaggaaaccactgcagtaatctacttaaaaagtagacagacctacatgggaatgggaatggaaaactatgagatggtaaaaactgacctgctgcgataattgactgaaaagcaaatagggaggaaagaagtggttgagacttagaacgtgagttataaaaagaaaccaggtgccagtgacagagatgttcagaggaagtgccagcttcaggagaaacaaagacacatggcagggattaaagagtaaggaggtagtgagatacacacctactgctagaaaaagcctatattcccatgaatggaacattaagaatccttctgatgaggactcacaagaagaggagagctgtagagagagaattaatcttcttagagatagttggatggctgtgattacaatgctggtagtaaaacagacagtaaaggcaattctgctgaggtcttaaatggaaatggggaatatcctattggaaactggaagacagaccatccttgttacaaaatgccaaagaacttggctgaactatgccctggtcccttgtggaaggcaaaatttaagagtgataaactaggatatttggtggaagaaatccttaaagaaagtgttcagggctccatggcttctcttgattgcttaaaacaaaatatgaagagagagaaataaagatgaaatgtataatcaaagagaagcagaattgaaagatttagaaaattctcagcctggccagattgtgaagaataaaaaagtattttcagaaaaaaaaaaaaaaccctaaggacatagacaaccaaacatttgataaggaaattagtagggatagaaagaagacaggtgctattcatcaggaggatggactaatgaccctgaaggcatttctgagacctttgtggctgccccacccacaaaggcccagaaggccagggccttgatggaaacgtgatttcaagagaggattcccttgagacctcagagcttgctgcccagggctgcctcaagtctttgctccccacatgccagttcagtgctcctctgccactcaggcaggcccaggttcagctcaggtcaccactctggaaggcacatgctgtaaaccatagcagcatccatacagtgctaactctgcaggagatatggaagcatagctcttccacctagatttcaaaggatattttggagagccttggggttcaggcagagaattgccatggaagcaggaccaccacagacagcccccactatggcagtggtggtactgtgagggcagagctgcccccaacaccccagacttgtagagccaccagcatgcaacactaacctgggagagccacaagcacccaacttcaattcctgagagctcctgccaggggggggcagtgctacatggggccctggggacccaaactccaccccagtatgtccagaaggtcagacatggagtcaaaaagattattccccactttcaagatttaatgttgtttgctgtgttttctgttgggcttttccctttgtcacctcttttttctttctgatttctctgtttttcggaatgggaatgtctatgctatgcctgttccactattttattgtggaaacacataacttgtttgatttcacaagctcacagttggaggaggaatttgcctcaagatgaatcatgccttgagtttcactcctatatgatttagatgagactttagacttttgagttgacgctgaaatgacttaagtctttggaacctattgaggtagaatgaatgtattttgcttatgtgaaggacataaatttggggggccagaggtagaatgctatggactgaatatgtccccctaaaattcatgttgaaagaatggccagtgtgatagtgttagatggggcctttaggaggtgatgaagtcatgaggataggagccttcatcaatgggactggtacaagggagcatctgtccctttcccctttttgctcttctgcaatgtgaggatgcagcaagaggcaccatcttagaagcagagagacctcaccagacaataaacctgctgctaccttgatcttggactttccagcctccagaactgtgaaaaataaatttctattatttgtaaattacccagtctgtggtatttcattacagcagcaggaatggactaagacacacacacacacacacaacacacacacacacacacagagagagagagagagagagaaagagagagagagagactgtttctttctactcagtatggtatttaaaaggaattaatattaaatatttcagaaaccactccatatcactgaagatattctacatttttctaaccatagtccatggagatcaagctttattgtcaggccatgtctttcccagatgactttataaaatctgctcacaaggagagaaggttgcagcaactagccatttgctctgcttaatctaaagcaaagctcctctcaactaccaaaagacagggtcgctgatttcgatgatctcatagtaaccatttgacatgacagcttgcagcatataggctaatgggctcagtaaagaaagaacatgtgatgaacctttcttatagtactggctgattaaaaagatgccagaggacttgagggagaaaaagttccctcctctcagcaaagctgtttgtgtacaccattcattcagataggttctaggagtatccaggccatcactgaggagcacttataacaaaagtcattcttcaagacagacatagatagtggcctcagatttccagctcacttacttgtgcaatcactaaaaaaatccataaggaacatggatttgaattctgttaaaaccagaggccactgtcaggtcacattctggtgatggctgtgtgaccttaacaatgaccactaaggtcaggcctgatctattccgtccaaaggactatagtcttcattagaaaatacactgagtcactaagctggcttatttttcttttccctcccctcccatttcttcccctccctacttccatgttcagaagaccacgaggatggcatgggagtatctaccttagctcttgtcatctgctcaacacgggtcaggaggtcatctacttctagctgcaagtcactcttgtctttttccagtttctgcttgacctgctgtagattttctacctggccctcgagctcagccaggctgtctgcatgtctcttcttcaaagatgcagaagttgtctcaaagtgcagagtggcctcttccatgtctcggtgcagcttctggaatttggtttcctgtttcttagttatttccagctgagccaaactggatcctcctacctcctccagcctctcattcaagtcagccaggtcttgggtgaggtcagctctctccctttccatcttggctcgagtggtcctttcagcttctagtttctctttcaaatcctttatttgagtctgtagcaagaaataattttgacttttactaagcacttgtagcaagagctttactctatttttttttaatcacaaagctaacatgaaacttttggttcccaatttacaactaaagaaaacagaatacacagaagttaagtgatttgccccaattcagtaccaagaccagaattagaatttgcagttctgccaaattgctcagcccctgatgatgggcaagctcattaaattatatagatggaggggaaagcttagtaaagagcacttcccaaagaaacaggaaaatatctttcatacgaccaaaaaaactgtttaagagcatttataaaaattggaatggtaaattttatatacaaaaatcttcctcatttgaaattcgtttatctgatctcaactatctaggacttgggcaaaaatctgatcaataaaatgaacatcttcaagttcaagcaatttaattgtaagaaatagcatcaatttaattttacacacaattctaaaaaacttggttacttggttttctagtctgcaggagatttcaaggaagagatttgaaataacaaacgagagctggtgaaggaatgtggactactaaagcgagtagagatacagtatcatcagaggcaggattattggaaaaaaaaggtgataacaactctcagagccccaagcccttttagtataggccaaacaggtctacaaatcctgagaacattactgtattacagtacaatgaagccactgatgttattatcatcaccttaagtaattaggcatagattaggataggggagaaaacaagatagaaactgttttagaatatgttttcctttccattaaataagactactgtggcttagaaaaaactaatttctagattatatcaaataagtagtctatcagttctatagatgaggtatgacagaaaaggtgcttaaagaaagtatgatttccacattcaagtaaccatgatcctcttccaactggttatcatgggatccaagaaaatatttatcccaaataataccaccattgaaccaaacatttctgaaatgttttgtcagaaataatctttagagaactttttgagtcatcaaggtaaggaaatttgtcttttggatatatagaaaagtttgtgtttttttactttattttggataaagtcaagagtcatttgaagacaagcccaatgaatatgataaccacttggagattaatagtgtgtctgaaactaaaatgtttacaaaacattgagactggttttcttatttggctcaaaatatctcagaagataaatatcagaaagatgttccaaaattattttgagtcatggttatattactaagatatttatttagcttcaaagggaaattatccatctaaatgtgtatgtgtgcaattgtgtgtaaaattactttacaacatggtcatatgctataaaactcacatggtctaaaacttataaatagctatccattatcaaataatgttttgaggccacaagtacctatagaacttactgattttcaatcgccttctaatcacaaagaataatcatcataaaaattaaattgctaacactgaatgcataccatgggtcaggcactgtgcttactacttaaatatattgttgcatttagtaatatgagctcaatcgttgccagaaggattcatgagtgaaaaaacaagttttggattttagcacaatgcctggttcacagcaaacagtcaaccaattagctattcatttttattattctcataaggaaatttaagcttaactctatctgtggaatgccacagtttcccttcttaaccactgttcttttctgcctctgcctgtggttggctaagggtatgaataccttggcagagaattagtcattgaaccaccagtcatcacccatggatctaaatataaatacacaggcatatttgataattgattacctgaagctctttaaccgtcttctgaagctgagctaccaggcctttctcattctccacttttgaattcatctgactcaattctaattcttttctgtttagaaaaagatatcaaatacaattgttcagaataataacattttgtttaaagtagttagaattgtaatattcctaacacaaagaaaagataaatgtttgaggtgatagatatcccaattaccctgatttactcattgtacattgtatacaggcatcaaaatagcacatgcactccaaaaatatgtacaattattatatatcaataaaaaaacacaaccaggctttaaccaaaagtaaaaaataccattttgtttaattatgttttaaattatagatataacacaataattcattctcattttaaaacttcaatgattatacctacatctgaagttttcttggctatgatacctgataaggtttggctgtgtccacccgaatctcatcttgaatttccacatgttgtaggggggacccagcaggaggtaattgaatcatgggggcaagtctttgctgtgctgttcttgtggtagtgactaagtctatctaacaagatctaacgttttataaagaggagttctcctgcacaagttctctctttttgcctgcagcatccacgttagatgtgacttgctcctccttgccttccaccatgattgtgaggcctccccagccacatggaactgtaagtctgttaaaccctttttcctgtataaattacccagtctcaggtaacttttttatcagcagtgtgaaaacggactaatatagaaattggtaccagtagagtggggtgctgatgaaaagatacccaaaaatgtggaagcgactttggaactgggtaataggcagaggttggaacagtttggagggctcagaagaagaaaggaaaatgcggaaagtttgaaactccctagagatttgttgaatagcttcgaccaaaatgctgataatgaaatggacaatgaaatccaggctaaggtagtctcagatggagatgaggaacttgggaaccagagcaaaggtgactcttgttatgttttagcaaagagactggtggcattttgcctccgctctagaactttgtggaactttgaacttcagagatatgacttagggtacctggtggaaggaatttctaagcagcaaagcattcaagagatgacttgggtgctgttaaatgcattcagttttgttttgttttgttttcagactgagtcttgctctgtcacccaggctggattgcagtggtacaatcttggctcactgcaacctccacctcccaggttcaagcaattctcctgcctcagcctcctgagtagctgagactacaggctcatgctgccctgcccagcaaattttttgtcttttagtagaggaagggtttcactgtgttgcccaggctggtctctaagtcctgagctcaggcaatctggccgccttggcctccagagtgctaggattacaggcatgagccactgcaccctgcctgcattcagtcttataaggaaagcagaacataaaagtttggaaaatttgcagcctgacagtgtgatagaaaaaaaaaaatcccattttctgagaaaaaattcaagccagctgcagaaatttgcataagttacaaggaaccaaatgttaatacccaagacaactggaaaaatgtctccaggccatgtcagaggtcttcactacagaccctcctatcacaggcctagaggcccaggaggaaaaattggtttcgtgggctgggcccagggtccccgtgctgcgtgcagcctagggacttggtgccctgcgtcccagctgctccagccatggctgaaaggggtcaacatagagcttgggtcatggcttcagagggtgcaagccccaagccttggcaacttccacctggtatggagcctacgagtacacagaagtcatgaattggggtttgggaaattccacctaaatttcagatgtatggaaatgcctggatgcccaagcagaagtttgctgcaggagcggggccctcatggagaacctctgctatagcagtgtggaagggaaatgtggggtcagggctcccacacagagtccctgctggggcactgcctagtggaagtgtaagaagagggccactgtcctccagataccagaatggtagatccactgacagtttgcaccacgcacctggaaaagctgcagacattcaacaccagcccatgaaggcagctgggagggaggctttaccctgcaaagccgcaggggaggatctgcccaagacaatgggaacctacctcttgcatcggtgtgccctggatgtgagacacggagatcattttggagatttaggatttgactgctctgctggatttcagacttggatagggcctgtagcccctttgtttgggccaatttctcccatttggaatggctgtatttacccagtgcctgtacccccattgtgtctaggaaataactaacttgcttttgatttcacaggctattaggcagaagggacttgccttgtcttggataagactttggattgtggacttttgagttaaagccgaaatgagttaagactttaggtgactgtggggaaggcatgattggttttgaaatgtgaggacatgagatttgagaggggccaggggcagaattatatggtttggctgtgtccccatccaaatctcatcttgaatttccaggtgttgtgggagggaacctgtgggaggtaattgaatcatgggggcaagtctttcccatgctgttctcatgatagtgagtaagtctcttgagatctgatggttttataaggaggagtccccctgcacaagttctctctgtttttgcctgccgccatccatataagatgtgacttcctcctccttgtcttctgccatgactgtgaggcctcccaagacatgtggaactgtaaatccattaaaccctttttcctgtataaattacccaatcttgggtatgtctttatcagcaacatgaaaacaaactaatgtcatacccaatccctgctttcccactagaggaaactaccattatccatttagtgtaaatccttccagaaatttaagtactgacatatgtttgtgcttacatgtgtacatgtagctgtagagtttcattttccttactgtgatagaatatcacatacatttgcatgtatagattaacaacttgattgatattaatatattattacattaagatattgataatagcatttatattaaatatgtatttaatattaaatattgttgtatttaatattaaatattgttgtatttaatattttaaatatattattgaattgagaatggtttttttttttttttgagtttcactcttgttgcccaggctggagtgcaatggtgtgatctcagctcagctcaatctctgcctcccaggttcaagcaattctcctgcctcagcgttctgagcagctgggattacaggcatgtgccaccaagcctgactaattttgtatttttagtagagacagggtttatccatgttggccaggctggtctcgaactcccaacctcaggtgatctgcccaccttcgcctcccacagtgctgggattacaggcatgagccaccacacccagcctgagaatgtattcttatcaatatattaagcttaaaaatcttaagctattatattttaagctaattattatattaataacatattaattcaatatttttctacacaagcctacacagagtactccatttaaaaattaactatgacataatatttcacgatttagacattccttagtttgaatttcacaattaataagcacttaggttttccttaatattttgcttttacaaatcaaactattcataatcatgccccttgtatacatgagagtgttcctctagagtggacactgagcaggaaattactgggtaatgtataggtgagtgctaaaaaaataagatagccctgtcccttgctctccattagcagtgtgagatcattgcttctctacatttattcttaatatcatacttctgaaattttcttagaaaatagattactatttcattgttttattttgaatgccctcgtttactagtaatgactgcatcttgtcaactattagtatttttaaatggccagtaaaccaaatggaccgcctgtgtatgttctttgcccatttttctgttaggtttgttcatctaattattgagttatagattttccttggattcttgacattttttatatttgttacaaatttttatctcactttataacttgtctccattttatttgtgttggcgtttgccacatgtttaaaattttgatgtcaaatatataatgccttccttttgtctttggctttttgtgacttgttcaagaagacttatcctgtcaatttcctaagaattattgactgtattttattctaattttttaaaaattgtggtaagaacacttaacatgagctctactctcttaaatttttaagtacaaaatgtagtattgttaactacaggcaaaatgttgtaaagcagatctctagaacttaatcatcttacataatcaactttatactcattgaacagaaactctccattatttctccctcctcccagcccttggcaaccacttttctatgaatttgtttctatgaattcgattattttagatacctctatcagtggaatcatgcagtctttttcctttttgtgactggcttatttcccttagtataatgtcctccaaattcatccatgtttttccacatggcaggggtttcttttcaaggctcaataatagtccactgtgtatgtatattttatatacatatatatatatatatatgtatgtatacagatgtatgtatgaatgtatgtatgtgtgtgtttgggattttttttcatttttaagtttattttttatttcaataggtttttgtgtatatgtatatatacatatatgtatatgtatacacacacacacacacacacacacatcacattttctttatccattcatgtatcagtgaatatttaggttgcttctatatattggctattgtgaataatgtggcatcttctaatggttttatggctttgttttgacattgagttcattagtgcaactgaagtttgtgtttataaattgtatgaggtagcaatttctctcacctcaggaaattaatagctaataattccaataccatttaagtctcttgtcatcgctaatttgaaatgccacctttatcgcttattgtttcagatatacataggtctatttaggggaaaagttttataataaagttacaactttttgaaaatatggatttctaaaatgctaaaactcttgacctgtggcctacacgacatacagtatcatttacactttgctggttatcatttgcactgaaacacaacttcaaaattgaatgctaagggaactctatcatcattttgctttaattattccattccattcataaggtcgcttgtttcatcgtttctaaacacctattaagcccagtaacttgttagcagaatatgagtcaagcctcaccaagagcatgtataatagcatatgtatataccaacaagaaagccagatgctcacagctggtcactggactctcttccctctttcactgtgggcctcaaccattgatatactactatctttaatgtggccttttttgagacagagtctcgctctgtcgccaggctggagtacagtggcatgatctcagctcactgcaacctccgactcctgggttcaagcgattctcctgcctcagcctcccaagtagctgggactatgggcacatgccatcacgcccagctaatttttgtatttttagtagagatggggtttcaccatgttgcccaggatggtctcaatctcttgacctcgtgatccacccacctcggaaacctgacccatcttactcttcatcctcactgttttcttctcttatttggtataatctaaataaattgaaaatccctaatggttaaaagaaaaaaaaaagtctagttaaacagaggaagatgacaaaagggagaaggtgagaaaatccatgtcactgactagtagaactaaactgagaaagccaagttgccctgagttctttggggtgtaaggaatccagatgaattgaaagtttccctaattttgatcattttcatggcttgttttagattttaaggtttaatatttatatagtaaattatttcaccaaattcctatataaatattaagttatgtctggcaaacatatattatttaagtaatctgagtatgtaagtcttcacatcaggatcaatttttttttttttttttacattttatgccattggtctcgtcatgagtaaaaagaagagtgtcatttttatttttttgacgtatagctgcaagttcccaaaagtttacatctcatataccttacaccattctttctcatttgctagtcaggtattttctgttacgtccttctagattatgcatctggtctctttacaactataaaataaagtccagtaaagaaaaaaaaaattgtttcctaggcttgttatccttgccttgggtcttgagctatctggccctggagtcctaaggataaatgaaatgagaaagctgttccttctaatataaggtctccagcaatctcatgtcaacagaaaggtggcttacttcctcagctcttctgccaggtgtcgctggctgctttccaggttctccatactttcccgattcagctttaaattgccctccagtttgtgcagttccctttcacagttcattctcgcttttctctcctgctcaagggcaccctcaagctgacaaaaggaaacattatttagctaaataaataggtagagtttatacttcactagatgtgttcattaaccacttaccttctggaaaaagaaagacacaagcacaaattctataaatgatgcccagtaacatagatatttccaaataaatattgcatatgtcaataggttaacaaaagaatccagaaatcacagggatggaagaaaactagaaataacagaatatgagttctgtcttagggaaggaaccaacaagaaatggccagtgagcccttgattgatcgttttccaatgataggaagctcacttcttcacatggcggctcatttcacgggtggataagtccatttacttgggagtgcttcttcataagaagccaaaatattccctgtaaattctatccacaagtacaagctctgctccctggagcaacaccaagcaaatcagtttccgcatgatcatccttaataatttgcaagaaccccctggcatcactggcccattcaaacacattctcacatgtcatgatttccaagccccgtcaccaccttggtaccctcttccagttcataacattatgtcatattctggttcctcactaaatgttccccatcagaacattccagttttgtatggattagtattgccaggaattatatagaggttaattttccaggaagctagataacagtcacaatatggctttttatttattgatatgtttactttaaaacaatggaagatatcctctgtaaccagccaaagagatgaaattcaaattgggaaggagggagaaattctggaaaggattccaaattcatacgctgaaatcctaattcccagtatgatggtgttgggaggtgggccctttaggaagtgatgaggtcatgaaggtagagcccccatgaatggaattagtccttataaaagagatcctggagagctcccttgttccttgtgtgatgtgaggacacagggagaagtcaccctccataaaccaggaaatgagttctcactagacaccaactctgctggtactttgatcatggacttcccagcctccagaactgtaggaaataaactgctatttatttgccacccagtttatggtattttattatagcagcctgaatggactaagacaccaggagagaataagtgtgtgggtgggtgtgtgggtgtgggtaggtgtgtgtgatgtgcatatataagcacacatataaacacccaaaaatccttatgctgaggctttgtgagatatgttattattggaaataggaacaaatgtaacacaacgaatagataatagaagaaatttatatagaggcaggaagaaagagcagcagataagaagaaaaaaaaaaaacctaaccactcttgtcaacaattttataaaggctacactttggggactactgtgagcataaatgcatacactatgtcagctggggtgggaaaaaggaagaattatgaacccacacattgaaactggtgtgaaacagctttatttcacagggcatttagaggcaaaataggggcatcatctctagaatcttaaaagtattttccaatagtgtaggtagaacacaacttgtggctcacatatctttcaaccataaataaatctcagcacaccactggaaacacacatggcctttaaaactaatccttcaacactagtggtaaatagagtaccagcatatctgtggggcaaaataccaggttctgtgggagatatggggaaaagccagtcacctagagtgataaccctttaccattcatcttaatgttctttttccattgcccagggttgaatgaaaattgcatttaaaaaccgacagattatatgcagagacctctcttatactatcgtggttttgtgtataagaaaaagaacccttttattctcaataatcaggaaaacaaactatgctactaggtttttctgaaactgtcaagataaattaatgaagtaaaaactggagttatgtgtatatgtagacagatagataactaaccagatacaccgttactgacctcatcaacttgctgttccagcttcagatttgctttgctcaggctgctgagcttctcctcctccatgtgcaggtcatccagggtctgctgatgggcctcctgcacaaccttggctgctctgttaagtttgctgatatcctcatttagaaactctacttcctcagtcaagttcttgacctgtgggaagaagatgacagcttcattaaagccactgctggaaagttgggcataacactgagggtcatttctcttctgtcgtccaaaactacgcatgaggtatccaatgtcacaaaaagctgtatttagccaaattcctgatacgctttctaaagctacatttagtttttctcccacaaaaatgatctgttatctgtcatggtgaggaaatggagtattctgtttaaacattaatatgggtaaataattaacattatttataattatttaacattattaatatgaactaaattggatggccaatttaattcacattattatataacagtaacaacactaaaagcaattgcaatttcttttgaggagtcatggcatgtactgattgtgttgtgcctcagtatcccaagaaagtggcagttaaagaaaggttccagctgataaaacatgcaaacatggaagttgactgtatcaggcccatgtgctttttatgaaagggaatcaataaaaataagagtgctacttaatagcctgccaaaattacggtgtcactttggagattgtgtatcagaggcttgatgcggactcctcactgtcctcaatccacacacagatgcgcaagttaaaaccctcaaacaaactctcagccaaaacaaaacatgaaagcccttaactagaattaaagtgacatcttcaaggtcaaactccaaatcaatgacacagctggggactcaggcacatcccaaattatcttttagcaaaccatatcatgctccctctccttccaaaaaaaaaaaaaagggttcttacaggcccgatgaaaccattttactctattacagagttcagatgcaataggattgaaacaaatgaaaatgtttcatttgggagattaaataaggttccataagttcaaattggaaatctgaattgggacagcatagtttatcagactctatattttgtgccagttctgactctcaatgctgtaaagttgcaggccactgtgttaattaacttgaatagagcaagtcagataccaaaacctgatttgagagtggaattctggctgctaggccttcttaactaacattatggaaaaagtaccttgtgctctgtagtacgcttctccttctctgacttcaccaacattgtttccaggtcatcgatttctttcttcaactcaaaacattcatcttcgagtttccgccccctggcagtcagctcagaatttatctcctcttcttcctccaccctctccgacagctcctttactctggcctccagctggatcttggatttaatcagccactcgcactgctcttcaacatttgccagtgtctcttgctcctgccatgatgaggagaaaattgttgccaacagctggaagtaatttatcagctaggcgaaaatgctgcttaacacacagcaaagagataattgcctgccctctgcccagcactttcacctacctttcctaaacagctgcaataatattcccaggtccctgatccgatcactgagaagtggagaagttgcttgtgtttggaggtgctttcaatctctcaggccaattcagtagattagattacttcttctaaagcacttaatagaatcctggtggcctaaaggagctagcatgcctccaaaaatcagtggtgtgctgcttaaaccacagcttctggaaatatccatgtaggcacagagtttgaggttgataactgctcaggaaatcatcttttaagaaagcagagttccctctgaatattgcactgtaactgttataagtgcatggatgtacgtgtttaatatacatctcttctaataaattgagctgagtcatatgttttttaaattcataggctaaatttagaattcataaggttatttgcaagtcactaactagagttcactgttatttccaactaaaatttttgcctcaatgattctgccagcacggagttacacaaagagcatgtggtactctttcatttatcctttcacaggcactgcctccagctcttactgggtgacccattgtttctgtgttatgggtcaagtaaaaagcaaaggggctttttactacagagcacctttcataactttagacccctctaatttgtcttctttattggctaaataaaacctcttcttcatgagcaagttcttaattgttgcgggtcttgctgtaatataactttacatacattttcaccttccatctcgagacctcacctatccttcataatatgccagtttgggcaacatattaatgatccatttgcctcacttaacttgtgtctgctaattagatcaagagtggggggctggggggaggtaaaaatccaggctattggcctctgagtagctcctggctggagaatggctgcctacccagcaaacggggctcaaagaagcacagatggagagaggtatagaataataaatgtacaacttcactgaaaaccccagaacaggggctaaatagaaagaagtatcaggacatttaggaagggtcaatgcaaatcagagaagcttccaatgtatgggaaataatggggacattttatcttagttcaccccaggttgacaagcagaacagtttttgctgcattccattcagcctgtatacaagacctgtcaccatcactgaacaaagaggacagtccaatcgaccatcattgatctcttcattaaacatgacagcaggatttgggggctgagcaatggtgtggcagtttagcagtaggaagattctttccccaatggcagctctctgacatactcacaatgttaattgaaatggggtcactcagttctgctggaattttgactaagcaaagaaggatttcaaaatatttcttttttttttttttggattcttttgtgtttagctttctcccttaaaataatcataaatagatattatatataataatatataatgatagctctgtcaacttcttaatcacagttacaatctgaactcatctcagccttcttgggtttgctctagagtttgcttccatgtgtttcccatgctccctacaatgacctttgacatgcatatcaagcttttgtctaccatgccctacacaagctgggtccatttctatctcctgcatcaccccaggtagcactggctactttccatcagtaggaagaatgatagaaactgggaggcgaggtctcaaccaaagttacctattccctaaaccaaaatattttacaaattgtgattcttacagtttcttacagtagctttgaaatggggcccaggaatttgtatttttaacaagcataccaggtaagactgtatacattgaagttgtagaatcactgctatgttaaatacgtatcagaaatgggggtttgggtgtaaagtcttacataaaatacagcctgttggcatgctggtagataatacagctccaaaatattaaaaagtaataataataaaagaataacttgtgtcagtctgaaagcactaaattttctgtttttagtagagtttaaaaacaagaaaaactgttgtttcttgtttaaaaagcaagataaattatatttgaacacagcatttttcaacttaatgctgtgctaagtagagaggaaagtattataaaggtggttaaaatttcatcctggccctttgggctgtttcaggatcacagtagtccgagggctagggaggagtaacatgaaagagagtgagtaatgacacgttagcatcatactgtagacagaggcttgaatgccaaaaccaggtgtttggaatctaaaaatgtatgtattatatgatctgagggttgctcacccataaagcgacatgatgcttttttaaagacaatggttcttaatctggactggatatcagagtcacccatagagattatttggacccacacagagtctgcttaatcaaaatatctgagagtggagtctaggcatctttatttttttttttttaatgtttcacaaataaatttgatacaaagccaaggttaagaactgttttaaaaactcagctcattgaacaatgagaacacatggacacaggaaggggaacatcacactctggggactgttgtggggtgggggaggggggagggatagcattaggagatatacctaatgctaaatgatgagttaatgggtgcagcacaccagcatggcacgtgtatacatatgtaactaacctgcatattgtgcacatgtaccctaaaacttaaagtataataataataaaattaattaattaattaatttttttaaaaaaagctcattagtaatgttgatttggacccaggaaggggaagcagggagaccaaaatcaggatatccgactagaagcacactgcagcattcctgaagatctcagtcaagcttttcttgggacctactaaaatcctgtctgctgatttgctaatgggtcatgggctacatagaaactttaaattaagacccagagcttcctggcctccatgatgtgctattatacagtaaaaacccatctgataatttgtccctttttaaaagacatcttgccaattaaatcacttcactatgaaacagggtatctctttgttttcattgtctttggttttataaaatcctttggtatttgaaaaccacatgcatctatttttttgtttccgtgtcaacactgcctgcttaacaagggagtctaattaaaaacttgatttaaagaacaaatggtggggctactcacagcctgaagctgaagaatcaggtcatttttttcctgagtgagggatacttgctttgctttcagttcctccctctgaaactctgatttctccaaggctttctgtaattgtgcacactcttccttcagtccagctacttcttctcctacttctgaagatttaacaagaggcttgatcttgaagaagagcctcatccagggccagttcttcacagccatgaaagctcttatgttccattggatcaaaataagtgcatccctaaatcaagaaagaaaaaagaaaagcaagttagccctgactataggagaattagttcccaaattaagatcctcaataaacacatatttttaggagtcataaaaaattcttattagtcttcaaagcacttttatatctggactttcacttgattctggcaaaaactctccaagggatatctggggttagcagtattatggactagatatcctaaaaatgttcctaccacaaacattctttgaatgagagctgaacctaaagagagtaagacatatagaaggcaccaaaaacttgaacaataagtgaatgcatgcatagcttggccatctttatggaaggaggaaacaagtcttggtattgtaagagtttgtattttcatattcacatggataaaaaggcaaggcagaaaccttcaaagaatcttacccttaataaaaaggaggactgaaaaatccacctaccagcaaagagagatatcaaattaaagcacatctgatttggtgtgagtgaagacaaatcctgcttcagatttttttttaatgatccagtaccactgaagtatttaaggtctaaattatactgcctgaatgatacacaaatatccaagaaattagcacagtgatttttttactgataataaataccttttcaacccttggggtaggaaaatacaaaattacactgaaaaaaaaataccttaaacccaagcaccagaagttctcctacataaggccccctgaagagggcttacaatccaaagttacaaaccacatataggaaaatgaagttgagtgcatataataaaaagtttgatgaaacccccaagattttcagataattgaactatctgatggagactatcaaataattatgttaaaaattattaaaggtataaaggaaagaactttagaaacaatgaaccactatgacaaaaggacacacagatttgaaagaagaccaaataaaatgtctaaaactaaaaaacatagcagttggaatcaaatactcagtggaaaaattaagcaggttattagaaatactggggaaaaaaaactagtgaattgagaaaagaataaacccccacagctccagactccaggatgacccttacaacctcaggttccaggcctgccccagtgccagtccagacatgcagccccagactgcaagcctacccccagtgacccagactctaggaccatcccaataatcagtccagtccccacagacccaggccccagacctatccccatgaacccagtcaacaagggtgttccagtagatcctaaccacagactgattctcatggccccaggatccagacataccctcactaagtccactaccatggacttagacaccaaggcctgcccatgtggatctaagatctagtgtatacagcctccaggctaatcttcatggacccaggaactgggcctgaatgtgcactgaaactaccaccaggccatcatgccccaagactccagcagcattcctgccagtggacaatgccagctgggctgccaagaatctctgaccaagcttactgctgaagaggttttcctgttgaagccagcctataaagaccaaaaggtgtactacttcaaacgcacaaacactaatgtaaggccacaaggatcatgaataatcaaaaaaatgacaccaccaaaggaacaaaacaaagcaccagtaaccatccctaaaaaaatggagatctacaaagtaacaactggagaaagcaagaaattacaggcttctgaaacaaatgcacaaacaaactggacacctggagcggttagcaacaacgtcctaaaatctctagccaagatgtctggtgaagattttgcccagtcaaagccagtccataaacatggaggaggggggatgctgtttcttcaaatgtacagacatttatgcaaagctataataaacatgaagaatcaggaacacacaaaagaataaaaagaataaaataaatccctaaaaatccaacctaaatggagatctatgaattgctgacaaagaattcaaaacaatgatcttaaaaaaaagtttagtgagctacaagagaacaactaaacaaagtgagaaaaataatacatgaacaaaaggggaagttcaacaaggaaataaaaaccataaaaaagaaccacatagaaattctggaattgaagaacaaaatggctggactgaaaaaattccatggaaagtataaatgcaatcaaggggaagaatcagtgagctcaaagacaggtcacttgaaattactcatttagaggaacaaaaatgaaaaacaaatgaaaagaatgaagaatgcctacagcacttgtaggacatcggcaagcttaccaatatacacattatgggagttacagaaggagcagagaaagagaaacagaaagcttatttaaagaaacaatgacagaaagcttttaaatctggagaggaaaacgaacaactagattcattaagcccaaagaaccccaagtagatcaaatataaagagatcttcaccaatgcacattataatgaaattctcaaaagtcaaagagagaattttgaatgcagcaaaacaaaagtaacttgtcacatataatgaaaccctcatgagactatgagcagatttctcagcaaaaaccttgcagaccagaagagagtggtgtgatataaccaaagtgctaaaagaaaaaaaaaaaactaaaaaccaccaaccagaaatactgtatccagcaaggctgcctttcagaaatggagagataacagactgccacacaaataaaagctgtgggagtttatcgtcactacttgccttacaagaaatgctaaagggtgttcttcaagttgaaacaaaaggatgctaactaaccacacaaaaatatataaaagtgtaaaactcactgaaaagaatatagtcaaattcagaataatactgtaataatggtgcataaatcacctttaactctaaaattagttaatgtacaaaattattttaaaaaactatagctataataactgattaatagatatacaatactaaaaaatattaaattgtgacataaataacataaaatgtggggacaagataagttaaaattaagagtttttatatgtagttgaagttaaactattgccagcttaaaataagatgttgtcagccttaagataaacatataactacaagatgttttatgtaagcctcatagtaaccacaaagaaaaaacttctagtaagtattcagaagataaagagaaaggaatacctagcattacaaaatattatcacatcacaaaggaagacagaaagaaacaatttttttaaaaagttgtaaaacaattaacaaaatggcagtaagtctgtatctattaataattactttaaatataaatgaaataagttcaccaatcaaaagacagagtggctgaatagaaaaaccaaacccaactatatgctgccaacaggagacatactttagctttgagaacatacacaggttgaaagtgagaaatggaaaaaggtattctatgcaaatggaaattgaaaaagagcagggatacctatagttacatcagataaaatatatataagtcaaaaactgtaacaagagataaagaaagttattacctaatgaaaaatgtgtcagttcatcaagatgatataaatatctttatatttgacaagatttaacatccatccattcatccatcataaaaattctcaacaatgtaggtatagaaggaaagtactgcaacataataaaggccatatatgacaagcccacagctaacatcatacttaatggtgaaaaactgaaagcttttcctctaaggtcaggaacaagacaagaatgctcactctcaatagtttttttcaatatagtactgaaagtcctagccagagtaattagcaaaaagaggaaacaaaagtcattcaaattagaaacaaagaagttaaagtatctcatgtagaaaaccctaaaaaccaccaaaaaaacagaattaacacgcttgtaaagttgcaggataaaaaaatcaacataaaaaattagtaacatttctatatactaacaatggactatccaaaaaagaagtcaattcataatagcatcaaaaattaaaataaaatagataagaataaatcttaccaaggaggtaaaagagctgcatgttgaaaactataaaacattgataaaagaaattgaagacacaaacaaatgcaaaaatatcttgtgttcatgaattggaagaacacaggatatttttggttaaaagtccatagtccccaaagttatctacagattcaatgcaaacccttttaaaattccaatggcattttttacagaactaggaaaaattcctaaaatttatatggaaccacaaaagacctcaaatagccaagacattagaaacaaagctggaagaatcacattacctaatttcaaaatatgctacaaactatagcaatcaaaacagcatggtattagcataaaaacaaacatatagtccaatggaacagatcagagaacccagaaatcaatctatgcatttatggttaattgatcttcaataaagttgccaaaaacacacagtatggaaaggacagtcttttcaataaatggggttagtaaattagatatccacatgcagaagactaagtggatcctcatctcacaccatatacaaatatgaactcaaaatgaactaaagacttaaatgtaagatctgaaactgtaaaattaccagaagaacacttggggaaaaagtttctgacattggttttggcaaatttttttaatgtgaccccaaaatcaaaggcaacacaagcaaaaatagacaatgggattacatcaaactaaaaagcttctgcatagcaaaagaaactataaacaaggagaagacaacctatggaatgggagaaaatatttgcaaactatacatgaaataaaggggtaatattcaaaatttattaggaattcaactctatagcatgaaaacaaccccattaaaaatcagcaatgacctgatagacatttctcaaaagactacaaatggccaataatatatgaaaaaatgttcaacatcactaattatcagggaaatacaaatcaaaaccacaatgagatatcatctcacacctgttagaatggctactaaaaaacaaaagataagagttggcaagtatgtggaaaaagggaacccttgtacactgttgatgggaatgtaaattggtacagccattatggaaaacagtatgaaggctcctcaaaaaattaaaaatggaactaccataggatctatcaatcccattaatatttcaaaatactaatgaaattagaattttgaagacatatctgcactactatgttcattgtactattatttgcaatagccaagatatggaatcaacctaagtgttcattgacaaataaataaagaaaatgtgtcataaatatacaatgaaatattattcaaccttaaaaaagaaaacattgtcatttgtgacaacatgggttaacctagaggacattatgctaaatataataagccaggcacttaaagacaaatacagcataatctcactcatatgtgggatattaaaaaagtcaaactcacagaagtagagagtggaatggtggttaccagcagccagggcatggggaaaatgaggagatgttgctcaaaggacacaacgtttcacttatgcaagatgagtaagttctgaggatctaatatacagcatggtaaccacagttaataatactgtattgtatactggaaatttgcttagagagtagaccttaaatgctctcaccacacacacaaaagataactttgtaaggtgatgattaatcagtttgattgtggtaatcatttcacaatacctacatatatcaaaacatcagattatacgccatatatacaatttttgtcaatgataactgaataaagttagaaaaaggaaaaaaataaacacaaagaaagtagaagaaaagaaagaataaaggtaagatcagaaattaatgatctagaaaaaagtttaagtgatttattaaatagactaaataaagatgtggcatgaatgttcaagaaaaaggagagaagccacaaaaaaatactagaaatgataatactctagaaatataaataatttaggattatgctctaggaatagaattagagatacagtagagatttaaaaataataaggccaggtacagtggctcatgcctgtaatcccaacactttgggaggccaaggcaggcagatcacgtgaggccaagagtttgagaccatcctgctcaaaatggtgaaaccttatctctactaaaaatataacatttagccaggtgtggaggcacacgcctgtaatcccagctgctcaggaggctgaagcacaataatcacttgaaccagggaggcagaggttgcagtgacccgatatcatgccactgccctccagcctgggcgatagagagagactctgtctcaaaaaataaaataaaataaaaaataaaataaaaattgatcaaattgaaaaattcaaaagaaatgtaaaatttttttaataaaagaaagctttcctgcactaattcaagaagaaaatatctcattagacatgtaaccaataaataaattgaatcaaaatataaaatctatcacaaaagaaacaccagatccagatgattttactggcaatgtctaccaaagattcaaagaccagttataaactggttcatgttttgaagagagaaaacattcttcaactgttttatgaggttaagataaccttgattcaaattcagataacatagcagatgaaaagaaaattacaggccaatcttattcatgaatattgatgcaaaaatctcatggtgatattacaatcaaacccatcaatgtatgaaaatatttcttaaccaaagtaagtttaacatttttaaaaatctgttaatatatttccacacatttatagattaattcagaaaaaccatgtgattgtttcaatagatgcagataaatgattaaataatttcctgataaaaatgcttaacaaaataaaatagagggaatgtccttcatataataagtcatttctacaaaaaaaaaaaaaacctacagaaaacatcatttgttaaagggaaatgatagctttccccaaagtcagaaatatgaagacatttggcaaaagtttttaaaggctgatataccacaagtgggtgagaacatgggacaaggggactctcatacattgctggtggagagtatgatatattagaaagcaatttggcaacatcttgcaaaattgcagttgtgtgtgacctacaacctattattaattcatgccctagagaagtgccactcaaagtgtgtgcctcagaccagctgctatccacaaattgttatcagaaaatggagtattttgagtaatgatgccctcaagaaactcttatgtatatgaatggggagacatttacaaaaatatcactgcagaagttagtagcaacaaaaaaaaaggaaataacaaatatttactttagctggaaaattgataaataaattatgatatatttatataatggaatactatacagcagttaaaatcaataatctagccctagattcattaacattgatatatttcaaagaataatactgaatataaaagacaaacttcaggacaatatatacaaaatattatttacatgaagactaagcacatgtaaaatcatgtcacattttaaggatatctgcatatcgagtaagtaaaggtatgaaaacatacttttatataacatatataaaacatggaatgagaaacacaaactcaggatctgagaaggaaaaggtaagacttggattacagcagaactatatggaggcttcaactatatatgttaattttttttaatgttgttagcaattacagaaaaaaaatattgagttggctgggtgccatggcccatgcctgtaatctcagcaatttgggaggctgaggcaagaggattgttgagcccaggagttcgagaccagcctgggcaacatagggagaccctgtttctacaaaaataagaaattaataataataatgttaagaattgatatatcttcatgatggctccatgagtatgcattatagtattttctgtattttttatttacttgagagctttcacaataacttttgaagtcatgatttagagagaatggatcataaaggcttcactttagacatgaagaaagtaaactatggagaaattcagaatcttactcaagtttacacaactggtcctagaagccatgttctgtgacccccaaactcccataccacattgaccactatatgagagtcacagaagacccttaagagtcatctctctaatatctttgacatcaccatgtaataatctttttctcttgggaaaaaacagaattaacaaattgtcaattaaacaagttacaccaagatctgtagacctttcttcagaagacaatatatgctaacgaaaaagtaaatacaacttcagcatcccttgctcacagtccctttgtttggagattttgctagcttgcttttcatgattctattaaacaatagacaaaaccaatgcctaagaatgtacaagcatggtgataaatgtccctagtgaacctgtctgaaataaagtaagaaagttatgattacatgtcaacaagagccacagtttctgacccaggggaggtaacaaaggggtcagaacacctcggtctttgaagcacacttccccaaagagttggctgtgggatatatgcaaacctttccaggtctgcttctgatataaattgtgagtcacaccactctcagagatccagacttctcagaacataaaaatctctctcaaagggaagcctgaaagcatgacaagaaatatctgaattatgcttatatttggttgaatagggcaataaaagccctttgcactctgtccttttgttatctcatgatttaaaaatgtttaagacccagcctaagcagaggaggcagctcttgacctactataaggcaatgagattagttgcactggttgaggcacactattaccctagcagttggggagcagggtgggcatataatacctttcttccagaatcttctggaatttgattcgcatcagtttgccctgtgctctggcttggaacaatgtgaagactttagatagtctctcatctcttattgcttccagttggcccagaaacccagctttaaaaaacacctaaaggaaaagtcagatgttagctccactgataatgggtattcagcaaatgtttattaaatgatcctgtgagcaactgttgtgttcctagggataactgtatcaattccatttcttgtaagttttatttaatgtgtaaaatctacttcttagaaagtttgattttataaatctaaaatgtgaaaaaaaaaacgttattaaatcatgtggttctattgtttgcctaagaacttaaactattcttccccttatctattaataatgtctcaattgtttagggaacctggtttaagttttaagatgggctcaggcatgcagtgtgccaaagtaccaggtagggttctgcaaacattttctgtgaaggatcagatagtaaatatttttaggctttatgggctatacacaatctctgtaggatattcttgtttttttaaacaattcgtgaaccatctaaaaccatttttagctagtgggccatatattaaaaaaacagtccatggacatggctcttgggccatagtttgctgacctctgttctagagtaaggcacttttgtctaggcatcaaataatccacaaaagtattttttcaagaatgattactaacaaacaaggtgaaatgagtgaggtgcctaaagcacacattttatggaggcactaagtgtgagagtgccctgagagtgtgtgcctttcaacctcacttgcccaaccctgagaatgagagcctctttgaaatttgtgccttaggagtttcacttgcctcaggtcaatcttggcccagatgaatagtatacagtaaaaataactaaacacacaaggaaggaaggcatcatcagtgaaaatcagcagaaacaataaacagcagaaactgattctcaggtactcaaaatatgggagtcaacattttataaccatatcctacagagttctaattctatgaggtctttatcctgaattttttaactctccttcaaataatttgttccttatatgaatgtcattaggaacaaactgatgttgactgccagataacaccaaatctattgataagttagaagtttcccaaaatatgtgagtcatgccaatatcatctaagatgaagtagaatttagggaatcacatttaaggaagttggttttggattaattttttgatagtgggttaactttaaagttttaaattactcagaaaaattagtccctaagagaatactgtccctgaaagaatatggtggatgaatcagttcacacacagacaagccattagctccaggaagctgattcactttttctagctctgatatatacacattttctcataacatcaggttgattcagtattttatatcttgacacaaatttgcttagttgactaattataaaaatgtaaatgtagtcaaaactgaggtttaaaaaacattgaatatttttctcaaacagcaccgaagttttcaccttcagctaagatctgtttgtgatatttatggtcatgagagctgaagaatgccttataattgagcattcacaggtattttaagatacacagtcttccccccattcgtctccaaatgcattctttgcagttttctggttaccttagtgattccaaatcggtactgggtatggtctatctccaaggagccaagtaattcttcagctgcttttctgctgctcacaaacttgctctttggaaaggtccttggattcagaatgcagtacctaatttaaaataaagaaaaaatcatgagtttgggaaatcatattattcaaataaagactaatctagacaaatgaggtgaaaggagacatagatttttatctctgttactaatatgttcaattttcacaagattcttagtaacaataatgagggtacaagcaataatcccttgcattggtataatagtttgtacttttcatattgctttagaggcaacctcatttgattgattgctcaattaggcaggggcaggattggaagaggaaagagagggagggaggaaagcataagtatctctactgtatagataaggaaactgaaaagcagagacattaaatgtcttttccaggattcctttaccctgttggtgagttggtggaaaacaagaaatatgcctcctaattctaaagcaagaaatatgcccctttttactctaccaaactttgctcaaattgatttgatgacctataatttaaacttctagaatccaagaaatagaaaagatgccactcctgcctcctgccatacaccctgctggcttccttcctttcaggggcttgctagtaaagccacagcctgcttggatagcagctacgattaagtatacacaacatttcagagattcaattcagcctccatatgtttcttctgtatatatttcttctatatgtgggtctattatctttgttaatagagatttaaggatattacagttacatggatgttggatttaaggggaaataataatggaactctgtcatcatatatcttcccaccaccaaaacacatcgatttgtagtctggaggacatcaaccaaacaaacaatgcatgcctaaacactcggaaagggaggaaaacagaatgaactgcctcaggcttcttggatcctagaatgtaggtttacctttgtttaaaatcagcatactgcagtcggtttggaaaaccttcacggcatatcctagtcccttccaagacaccattacagcgcaactgctgtagaaccaagtaagggtccagtatacctggaaaaaaaaaagagtcatggtggatctgtgcctgaaaaaaaattattgggacagattttgaaccaattgctgcatcttgggttaaaaagaaagtctgaattggatagtttccacatgataggtcatagatgttcactcacttatggcctgatagtactcacagtaatcatcctattatgtaggcatctccaaatatgatttccctgaaattcctttaacatggaacaagccccttaattcacagtcagatgagatgtttataagcaaatattcttggaaggcaaaaagattacattttttgctagaatgtaaatggctgctctacgttcatttgccaaccaaaaccagccagaaagggtgataagaacacaaaagagaactgccttctccgtgcaggagggggaagggataagaacaaggaagaataaaaggaaaggggaagatagacacaaccacaacattctgtttacagttttgcttaggaaggacctgtccacatcccagacttcattctccccttattttcatgagagtgcctaaattctattctgtagtataagcatccttctgtcaccttctcgttcatcaaaagaagctctactgcagctgtcagctgcaacgtccaatagaagcctttgaaaaaccatccaagaagccactgtccctgccctcagcaagtcttctgaaagaagccaaggaccacatctcctaacacaaattcctactatggtattacatgaaaaataaaaaaaaaaaaggactccatgcccaaggtcacagaaataaacttaaatcatatacccatatttctatactcgaatccctttcacagatagaaacagatgatgtataagaaggcacaagtaggctggcacagcggctcatgcctgtaatcacggcactttcagaggctgaggcgggcaggtcacttgaggccaggagttcgagaccagcctgaccaacttggtgaaaccccatctctactaaaaatataaaaattagccaggcgtggtggtacatgcctgtagtcccagctacacaggaggctgaggtacaagaattgcttgaacccagaaggcagagattgtggtgagccaagatcataccactgcacttcagccactgcactctagtctcagcaacagagcaagactctgtctcaaattattttttttaaaaaagggaggggtacagggagtagaatcctatgacaccttaacatcagactcactcattctctttaagtacatatgaataactgttttgattagatcatgaagcttttcttatgactttgtcttatgactttaagaaaaaaaccaaacctgctgaaatccaagttgactcgatgggaagcaactctaataggtaacagaattgctccaaaatagaactcagctaattagattccttgatagatggaagcagtgtccctagacacatccagaaacccagctgataggaaacaatgaggcacaaacatacagccgtgaatgaacatgaaagtatttgtatcgcagaaactcaaactgcagcatcattgttttgtatcacactttcccaaaataggccatagactgtcaggattggggtcttaattacaggaggttaataaaaatgcaagctactatggaacctcagagatcagaaccagcaacatctggctatgtattataagggtggttagtgctctgaagacatagggcttgtcatatacattccttggaggctgacagcctccaaaccaagctccagaggggccagtaactccaaagaggtggctgggaatcttcaagctcatgaagtaaggaaagcaatccatgtagttaattttggtaaaacccttgtttggggaattgaaaacattaaaaaaaaaaatcactaccatccacctatcacatcatccccctaccactattcactgatcaaaagatagccactacccagagttacataactaaaaaaaaaaatgaatgctattagaaagagggaagaagatgttggcattggcaaggaggactagagggtgttctcaacaattagaaatggatttaggaagtgtctttatggtcaatttagataactcagaccaaataacttcctttatgctgaaatatctaccttaatcccctaattgattattcaattccatttttattatagtttgtccttgtagacaatggcatgggagctcactcatgttcagcataaaattcaaggaagaatttaaatagtaatatcaaacattctaatgttgcccaattgagaccgctttgtgaaacccttctgtacatccatttcaatggcaatattgaggaggttccaaagacctcatttttaacatattttcatttttctatatgaaattctacccttatataaaaggcaccaataaatatttctttaaaagatattcaatatagctaatatcaaatctatttcctagtgtgaattacaaagaaatctagttcttacctggtattttgttcacattgggatttatgcatctcacaaaatgaggtgctgttgatttcagattagtcatcaatttattcaggttttcctaaaatggagaccataataaacacaaaatcactttgcaaatcactaaaaacaccaatccacctcacaaatgtctccaaatctatcaacttaatctcacagccaagatgtattctaacagtaaaataatgaattcaacattctttactgcctaccaaatgcacattatttctttcctatggcaagtcaatatttatttgacagacatagttaaattgtgaatcatctctacctattttgaatttgatagcaatatcaaagttatggctgggctataaaatggcttgaaaaaagaaattgtttctcaagttctctctctgtggaaaacctttatcttaggtcagattctctagaagccaaacctgagatgggaattctggttcaagagatttttagggagtgaagaaagctgggaacagcaggggaagagaaaagcaatgattcagactcagctttagtctgatccttgcaagcaagagctgtaaacacgaatgcaccaattgcagcataggtggtctcccttgaggcaagggagaggctaaagtctggagaggagggcaaagaggcagcttagtttcccctttggctaagtgcaattctgacaactcagagttgttatgagccaatatgcacatcagctggaagatgggtgcaggcatgataaaggggatgtaagtgggaacaaacagtgtcctctaaagcccttgataataacagcataaacttcaacttttccaacttgctagctcctgatactttatccttatttgaagatgtgaaatgtcaactaaataataacatatgcagattgtgaggcaattaatatatgaatagacgcaattaaaaattactttatgcagagatgcaaccgtttggaatgaagctcctttctttcgtttcttctccccaaatggtatagctagcaaaaaaaaaaaaagaaaaagatgaaaacatgtaaaaagctcatttttatcacattatcctaccccactgatggaagcataaattcaccagagttctagaacaatatggcaatatctaccaaaagcttcaaaatatttatgtcttttatcacaaaatgtatatttttagtgtttttccttaaggatataatcaggcaactgtgcaatgatactcactgaagcattatttagtcattgcaaaaaaattaagcaaaaataaaattcatcaacaaatgcacatcataggagattaatttatgagagaatatgcatacagtgaaacactgtaagcttttaaaatgatgatgtggatccatataacttatatggaaagatttctaggatgtttttagataaaaagttagtttacaaagcctaaattttatatatgatgaccctgagtatgtatacatgtttttttaagtgcagctgtgttataggtgactataaacatgaaaaatgttgggaggtgtaaataccaaaatgtaaacagtttgttaatctatatgagattacagataatttttatgttcttctttcagtttttctatattgtctgtgtttttagcaacattcatgtatttattttcatgatttataaaaaataataagtctatttccattttcttgaagaaaaagaacctgtgctaggccaaccagctttacaaacatttgaatagtgctaagttactaagatgtgcaacacagcaacaacaaaatccataggcaagctggacagaatagggtagctgtcaatatggaaaactaataaaatattctctgcgcctgagtagcaactgtgcgatggcagatgtcatgaagctcaatcactaatgttcttttgaaacaccccaggtctctcagtgaaacacttgacttctttgtacttcagtttttccatctatgaaaagggaataacactacctttcattaattttttaaaaagaattataaccctggtttaaattatttggattccccaggagaaagtatggttatcacaagcaatttaatgttcagatccgtcagaaacttggaggcaagtattttcagagggtgcttaaagaattatttaaaaaaaaggccattctgaacaattcttgtcttttagttccaaagaacacagtacacaacctgaagagttagaagacgatttctcctctaattctctgcccaaaccattctctgatctcttatgatcagagaattactcaaatgggagtcataagcttatgtggctactatcaaacagacttctcagaggtactttagcagctattagaatcaggcaaatgtactgcctgaagattagccgggtccagtcacaatagcttccatctcttcttgaggcaggcccagaggatttcaggcatgttccagaattatgtcatcatgtgctgatgaagccagaaagtgctaaattttctctccattccctatgtcagtcgagagaaccaatcagcctgataggggctgggagttaacatgcagctgggtgtaagataacagcagggtatgttcgaaagtgagagtacacaccccatttaaagaacagttggtgtactgttgccatggggaaatcagaacccaggctggctagattatctatttccccagaatttccatttttcaaaagaaaacggaaactcaaatgtgcatgtgaaatctgatttttttagcttgtgtggaccaaacaaaacgtgtttgaaggccagtttctgctcagaggctgtcgatctgtgacttttgctgtaaatcatggagagcttccctctgtatgtagttagcatttcgttcagtgaggctggtgttaacaactttggctcagtatcttcaaatccatcacatgatggtgcagaagttttcactgcatcgtaaatgcatgtagcctgtctgtctctgttttgttcattcctgggagacagtgagtagaataggcactaaactagaaaacagaagtctatctttctacctagccttttgccatatagtagatttgtaaaatcagggatgctacttaacttctctatatttgttcctgtgagaagttaagtaggatccctgattttataaatctacgacatggcaaaggctaggtggaaagacaggaacattctgtatatatcttaaagtgtcaggtaagaaatgagtaagataatgtatctaacagtactttgtaaattacaaactactaaacaagattagttgtcagaatagaatgcctgttaaacaggtatttgctgcatgctagaggctacagttgaataaatcagacataatccctgccctcgtgaagcttctaataaccctaagtgcacagagtgctgtgaaagagaatattctaagatatttggggcaataactataattatatatatatagttatatagatatttgggacaataagttattgccccaaaatcattcatcaaaacatgttttttgttttccctttgtagctaggtgaagtagaagacaaaagcaggccaggaacagacttcttgaatctatcttagagcactagtaccatctccctgaagaacccccagcctgaagacagaaagactaataagaggggacgactcagaccacagggagcagaaacatatcacaggaaagaagcaagaatttttgcaaaagctgaggcagccatgggttccattctgaggctgaaaaatcaaggaagattgtatgactcaccactgtcagtactcatgtaattttcaaaaaggctcgccaggagtctgttggaagacttctgaaatacagctaccactgtttcattaaggaggtctttgttcttttccagccaaccactgatattataaggtacctttggaaaggcatgcatttcaggttaaaaaaagaaaaaaaactgcataagttaacatggaaggctgtgcattacccctttttttttttgagacagggtctcattctgttatccaggctagaatgcagtggcatagtcacagttcactgtagcctcgacctcctggtctcaatcaatccttccccctcagcctccagagtagctgggactataggcacatgccaccatgcctggctaattttttttgtatttttatttattttgtgtatgtgtggagatttggtttccacatgttgctcggtttggtctcaaactcctagggctcaagcaatccacccatctcagcctcccaaagtgctgggattacagggagccaccatgcccagcctttgcattacttttaataaatcacaaattatatgggtcctttacctttaaatcagtttaatgtaatagtacagaataacctccaaaagcccattgtgcagcccagaaagattctcaagattcttatcattaacattgtcaaaagaaaggaacagacaggaagggaagaagggagagagataggggaagaagtagaagagaggagagaaaagaaaggggggagagagcaacagagaggaaggaaggattgaatggcatttcacaccagcagtcctttaaaggcaagaatggtgaaataatccaactgtctctgacatacagtgaacattcaaaaaaaaaaccagcaattgcaatggtattttactgtatatatcattataattaatatgccaggatatcaaagaagagaactataaacatatctgtgtacagctggcaggccatttttaggtcgaagtattattttatcttttatcaattctctttttgttccaccagagtcaccagccagaagtagaaatgcagaaaaaggggcatatacactggtgaggaaatgaggagaggtagcaagggtcattagaaaccgtttttggccatagtttggagaccattacttcacattgactatttctttacgggagaataaaaaaatcttcaacaaaaagatcaactgaaatcattcattcacacaacgttaagttaaaaggaaggacaaatgggggaaaaccatgactttgatggtctccatgcctttctgaagctgccttgctttgagttgaggttgacagagtccatttggagatttttgacctctgtgcacatggaatgctattgttcatttcctgagtgctaaaaggctacactaccttttttgtggaactgagatgtattttgttcttctcttcatttaatctaaacattacttaaatatcatctaaggactttggctgagcgcatttgaaacaaagtcaggaaaattcaagaccgggggtccagaggtaactcaccactcctgcataatggacaagttcaaaatgagcttcaaatttcttcttatcaggcttgggcttctggagatgaaccgactttccaaaatggttgtcaaagagtttggtcttgaaagtcaggtctgtagccttaggaaacatacactcttcttcaaggatggaaaggatgcccattggctgttgaagagacataagagcagcagatttctttaaaaacaccggcactttcagtagggggtcagtataaattctttcccaggaacctaatcagttgacaaagggaagaatattcactgcataaaactagcaatcatccattcaacaaatattaattaaatatctgctacttaataacgataccaatagccgctggtgattgatgcagctgtgagccacatatacaaagtgcctgtcctcagggtgcgtacatttagtggagtggcagacagtaggcaagtaaacaaagaaataactccaaaaaacaaatgacttagtttcatataaatgctctgaggaaaacactcaaagtaaagaagtagagaatgacagggggtaaggaggttttagatagagtcattgggtaagacacctctcctgaatgagaacaacaagctgagaagatctgtgcacaagtattccaggcagaaaaatgaagaatgcaaaggccccgaggccagagcccacttggcaagtctgaggtcctgccagaggccagtgtgggcagagaaaagctagcttgacggaacacattttaagagataatgtcaaaggggtaaggagcagctggagctcaaaggccttataggctgtagtaagacatgtggctttcattttaaatgtaataggaagcctttggaggctttttaaatgaagtgctgtgatttgatatatgcttaaagaggatcattggtttagaaagtagggctcatgggctcagtcctgcctgcactctgtactggaaagccagtgagctaagaatggcttttacatttttaaagagttttaaaaaacaaacagattgggtgaggtggctcacgccagcactttgggaggctgaggcgggcagatcacctgagatcaggagttcgagaccagcctggccaacacggtaaaatcctgtctctagtaaaaatacaaaaattagccaggaatggtggtgtgtgcctgtaatcccagctacccgggaggctgaggcaggagaatcgcttgaatctgggaggcacaggttgcagtgagcccaaatcacaccattgcactccagcttgagcaacagagagagactctgtctcaaaaaacaaaaaaacaaacaaaaaatgttactgcaaatctcatgacctccattagcacactttttctctaaaggaccatatagtttctgtcagacccttgccatccacttagtcattgaaacactgaaagcagcatgcaacaacatgtaaacaaaatgagtgtggccatgctcccatcaaacttgatttacctaaacaggctgcaggctagattgggtccacaaagtcagtttgctgacccctggtctagaatagtggtagtgttggagcttatgagaagtcattaaaaataagatatgcgtcaaatttagagctgagtgccaacttgctgatggagagaatgtggtgtgtaggaaaattttattgcatttatatagcgcataatttttaaatgcatttttacttttattagacttacaaatcctttacttgactgcaaatttcctgaaggcaaaaactatttataaaaaatgcttacatttttctacagcattttacgcagagtcttatacacagtagtgtggtagaaggcctaaaattaaggcccaacattatgtgtgccttgacatctgggaaaaaccaggaggggctcaaaagttccctttctgttgtgctcccatgtgttagatcccttagccaaacaccttccttatggcagggaccatacatagtgcctgcttatacctgagtaacgggtttcatttctctatcagcccatgaaattattcaaacaagcctgttgcatccttctgtaggattctattgtcacgtcacctataattactacaaagcctgcctcctaaagcccccgcttgttcactctattctcagcataaccctctcatggccccgcatggttcaaggtgtcccccctgcaggctgtgagcataagtggctaataaaatgctggtctcatctgtctagtgttggatgtcatatgttcagcctttcccataaacctagggcaggatttcctccttcagcaatggggtgaacaggaagcaaccaaaacaaatagttgcaaaatagacttacttattggtttaataaaaaataaaagcctctgttttaaggcttatttccaataatactagaagttcctggagtgccaggatgatgccttctggggtttgtacatcataacccttatcatagtaggttccgaggtaactaaagtgtaggccctcagcacatttctgctgagtaattaattgacaggtgaaccctgagacatacaggtctgagttctgggaacttgactgctttgctgtgatcaattatcaaacaaaatgtaagagttgccaatcaaaaaaaggatggagttatgtgtttaaagagaatactcatgtgcatacaagatacaactagatattaatatgattcattttatattaaaaacacaagaattaacacatctgaaaagcttcttttgggaggtgataacacataatgccaagatgctgccagtatttaaaatattttagaactttctttgggatacctgatactattgactactaacatgaaaaattcctgttgtctgatggtatatcattacatgctaggtagtatagtttggactcaaaaaccagtgaatgaaaagtattgaagccaattttctcttgaggctggtaaaattctaaaatctatcctaatcccaatatcgtgagaaattttccaaagagctaaattattggaagaagtatgttgccttctagggtgtttacaccaaatgaatagtaagtttttaaatgtataacttggagagtatttattaggaaataatagggaaaatctctttaccaatgccttatgtataaccataaatatgtaatcatatattaatactttaatatgtaaattattgatgtacaagttctaaacaaactagaatatttcaagtaataaaataagtatgagcaaatcctataataaatttgttcacagcacaaatgtgaaaggaggtcacggtaaacttgaagaccaaattaacaattaaagtttgtgttagaatacattttttactttagtttgatataaactttttttttttttttgagatagaatctcactctgttgcccaggctggagtgcagtggtgcgatctcagctcactacaacctccacctcccaggttctagctattctcctgcctcagcctccctagtagctgtgactacaggcatgcgccaccacatctggctaatttttgtattttgagtagagacagggtttcaccatgttagccaggctggtgtcaaactcctgacctcaagtgatccactcaccttggcctcccaaagtgctgggattacaggcataagccactgcacccagctgatatagacttttttgtaaacttacaaatatgaaacttttatgtaatgaaaatccttttttcttatacgtatacagagatgcatgttatacaacattttatatatattgatgtgttttagtactttcaaattttaaaaacatcccattatgcattttatttcaaggactgagtttgatcattaatatttgctacaaatcttcttcagatagccccaacgaacataatgggtcttttcaaaatttagaatcttttcaaggaaggctttggtattttcatttgcctgacctggatcctgttaaaattgtttgtagaaaaccaaagacttatcttttccttttatcatttggtcagtaattttttctcattttattatatcagtagaaaatacaacaggaaattacatccgtgatgctagtgtgttatttggaataaccaagactggcataaatgaggcaacagacttcagatcaactaaaaatcagtaacattcacagaacttgtcaggatctgaacaatgtctatgtcccacgttcctgcctgaaaacagtatcttgtcataatcaaagtgagtatatattataggtgacaatcgccagaagataaatctgttcctctgaggacctccagttcttttgtttcatttctaatgagacaactacggctcttataaggccagaatacataccacatcatagttggttcatctttatcactgtttttaatcagctcatgtttgattcattattaatatgttttaatcagcctgtctttcccccaggaagttcacttgttataaaataaataaaatcaacgggatatctactcctgttggaaataatagttattttcaagaagatctaaagcctaataaatgaaattgataggacacggattgataaaacccagggcttgcaaaggacagggagaggtcagttgccctagctccttcctagcaggattgttgagaatcaactgtgacagcatagctagagtattcaggaaatgaaaggcttcagactgcccagatccatcttgaagattcactgcaatccacgattatggcgaggcccaagaggcatgtaactgctaacatgccgccatgcttgctcccatggagaaagccacagaaaggaccatacgtaatcccccagcaaaccttgctcatctttcccagaacatgcagaaagatttcagagtattgggacatcaccaaattcagaaactgtacactgcagctaatttactaataagccatgaagtattgtcataaattacttaaactaactggtacttgtccaattaaatgaacaaactacatcctgcaaggtagtggccttgaggattgatggcagttgtttgtttgcatgctaatttgccaaattttgttaagctgctctgggtctactcattcaccttatgttaatcagttaggccctacagtgctcatatttttagctctgtgtttttccagtcaagagcatgaccatttttaaactcaacaagtttccgctcacgttaacagtggaggccatgcattagcatcaaatgtgcagtgaaagcctgcattagagatgatggagtggggcaactgacaagagagtttcgtttggatgccacaggtgatgcacacaaacaccattaagataaaatgtgcagggctttccgcccccatttcccatcctctgatagggcctaagtcctgacatggatcaacatagcaggcagggacaattctcccgaaatgaaaatggacaaagagaaaaacatatattaccttctcaatgagatctatgcaagcttgcaaatccagaccaaagccaatagacacccattcaatgctttctttcttatattcctcttgctccagaacaaacatgtgccaattgaagaattgttgtaatttttcattggtaaaattaatgcaaagttgctcaaggctattatacttcaaggatatgaataggtaagaagaagagataaaaataaaattgaggtccactttcaagaatgtccagtaaagaaaaaaccataaccattattatatgatcagaaatagacccaacaagtaacaaatgctcaattaacttaattaattgtaattttgaattgtaatatcattaagtacaattttctaaagattattacaataatatagcacttaatggtattaaaatttaaaatcataattaattcctttacctccatttacctttatgtaagccagaattaagaaatcaataaatacttaataccattaagtataacaataattattattgatattaattatagctcttttccaaacaaggtagcccttaaggtttgcatagaatgatccccatgctttgaccatattttcccatcttcaagtaacgttttctaatcttcttataaatatgcattgacttccttcttaccagatacacttacctcaaggatttcaaaaccagtgatgtcaagaatgccaatgaagaactgccttgacagcttggcatccagggccctgttgatccgtgccactagccacttaaacatcctttcatacattgacttggacagggcaccgacagcacaggttacctagaaatcacattgaaaacactccttcatctgactgaagtgttcattttaatcccgggcattctctatcagcaactgccttctagtcaaattaggatgtctttattgaccttctgtgcttccaacattctgctgaatacaatgagaaaaggaagaaaagaaagagagagagagagaaaaagaaagaaagaaagaaaaggagaaagaggaaggaagggagggagggaggaaggaaggaaggaaagaagggagggagggagggggaaaatgaaggggagaggaagggaagaaaaaggaggaaaggagatgggtaggagaaaggagtaagctagcctggtgcctctttatgaaaacacagatgagaggaatcatgttcctattattaaaggactaactatcccggggtatggtgtggtgatgtgtcccaaagccttgctattcaaagtgtgatcctaagaccagcagcagcaccacctaagagtttgttaaaaatgcaaactctcaggcccagtcccagacctactgaatcagaatctgtaagctaacaatccccagctgattcctattgacaaagactctctccttgaccaaactttaatgaggatcctctgaccccttgcctccaccttacctgtcctgtcttcagcctgtctagcccagctgcaggaagaagtctgctgaatcactcacccttgatctctgattaaattccttatccctcacctttgatgtatatgttcttggcctgcctttagcaagaatcctgttaggtcaatttaaaaaaatcctcctaccccctgttagtaattttccatccactgatcccctccttctggtcttgggctgtaaatccccacttatccttgttttacttgcagctgagcccagtatctctcccctgttgcaatatatctattgcagcagtcctgaatgaagtcttccttaccatcttaataagattcagaatatttgtaatactatgcacaatagtttgaaaagtagtggtatagtacattagaaatttataatccctaacccttgttctgccactgctgtagctgctataaattgtgtaacctttggcaagtgatctaacctttctggaaagcaacatcttcatctgaaaaacactcttaaaggatcttcctagccttagcttccaactctttattatattagttcccagttttgctctcaacaacctggacagagaatagccatttgtgaatcattctgactcagattctcctgctgtaaaactgaggctgccttttccttccctggaggggtgtggaaaaggttctaaagtaacctactggggagagcgccaacctttgtgcctggatgatgctctacaaatgcagatcctacttccataactccaatagcgctgctgtagtagcaggtttctgacatactccaaggaagggagaattttagctggccattctccaagcctggaaacagaacgtgctccaatcacttaacatttaaaatagacctatcacatccatccttctgcccaggagagagcacacagcaggagccagttggtgtctggtggtgatttagttatgagtcacccactccctgatcagttatcttgagtcatttccacagtaatccataagccggatggcatcacagttttttattatcagcatcaagagcacacacgtacaaataaagcatcaagaatgattttcatcctctgtaacactgaagaaatcactctgtctacagcagtcactctgaaactttaaaaagaacatgactaacttgctcacccccttttaattccctaaatacttgagaagtgggagtgggagagacactgttaggtcaggtgtggcaagtagtggagaaacacaagaagaaagcctggaaatgtaggcagtaggataaatggatggtaaaggtctgctgaatgaattcatgaaacagatcaatatgttgctcactaattaatcattttcatcattttctgtccaatggagaggaaatgaggtggctaaatctatatttccacttttcaagggttaaatgcacccatttcttagctctttttaaaataacctcacagaaggctttggttactggggggcaatagtgcatatagaaaacaacaacagaaaaaaaataacaaagtcaaatagttaatcttttttgtttgtttttgagacagagtgttgctctgttgcccaggctggagtacaatggcacgatctcagctcactgcaacctccgcctccaaggttcaaacgattctcttgcctcagcctcccaagtggctgggattacaagcacacaccacaatgcccggctaattttttgtatttttagtagagacaaggtttcaccatgttggccaggctggtctcaaactcctgacctcaggtgatccacccgcctcggcctcccaaagtgctggaattatgggcgtgagccaccgtgcccagccaaaatttttaactatgttgatccctctctttctcatctgtaaaataataataatgaaatatgtgtagctcagggttgttgtgagatatccagtgagacagaggatataaactgacagcatatttgacgcttagtatccaataaatgttaatcctcccttttccaccccttttctgcttttatcactttctcatcctcaccccagtatttacttactagttgtgtcaccttgagtggttaatctttctaagggtcactatctgtagctgtaaaatagaaataacaagacctacttcataggcttgttattcgattaaatgagataatccatacaaagcacttagtacatcacctatagttagtactcagtggacattattattattttattattaatcataaagtaacttatttctaggtgacatagttagaaatatcatggaatcataaaatactagacctgaagatccttagttcttgatagtcatatatagcagctttcaccttgggatggtatctcctcaaaggaggaatgcatttagaaatgcaagtggcattttctggttgtcacagtgactaagaatgctactggcattcagttacctgggggccaggaatcccaaacatctacagtgtgcaggacactctcatccataaagaactgtcccatcttaaatgccaattaccattgagaaatacaaagttgttcaaccacttcactgtggggctcagagagatgaagacaattaaccaaggtatcagagttagttagcattatagctagaactaaattttgtatagaatgttaacgttgcaaaaatttttcccatcttttgcaattgtcatcaacagagcatacatgtctctatttttagcaatggcaattgtctctataaaatcagaaaaattcctaagggaaaaaaaaaagccttagagcatgctttcttactatgtctccaggagagagagagagagcgagaggaggaggattttttattttaatgttgaataataatatattagcttgtttcactggtcctattatagtaaaggctggagtccttactataatattgtgtctttaattcctcagaacacaatattagagagctgaagacttgttctcagccctcctaggggctccttatttttttttttattttttatttttgcttttttttgtttttattattattttaattgataaataattatatatatttatgaggtacagaatgatattttgatacatgtatacaatgtggtaatgatcaaatcagggttatcagcacatctatacctcaaacactgatcatttctttatattagaaacattccaaatctgctcttcttgctatttgggctcattagttttatacagagaaaaaccctgttctataaacatagcatgtcatgcatgcatgttgtggtgaatgtctaagaaggtatgaaactgctgaacaactctaaccccctgccaagaaatagctcagttatgtgtcctgctgatcgtgattcaagtttagctcaatgtagtctattttaacatgcgtggagcacttacggcttacagggcattgttttagatgcttggagtactaagatgaattagacacagttcatgcttcaaagaggttagaagacaaaaatctaagcagattatttcaatatagtatagttagtattatagtagaggtagaattatccatttatagagtaagctaaattaataaattgattttgatcagtcatttaaatgttttaaataacacagacacatcagttaccttaatataccaagggaaacacatctattctagtcatcatatataagatgactgtcttatattacaaatttgtacatttgtctatctctttttcagagttagggtgtatactgagtaagacaatcagtatcacctgagtactagctatatatcctttggaatgttacttaacattctctttgactcagtttcctcaactaggaaaaacataaattatgcatttctgccctacttagctctgagtattattgtaagaatagaaggcaataatactgtgaatgctttatccatactatgtgtgacaccacttcctctttccagaaaggctacatttctcagcccctttctgtagctaaaggtattattttactaattcttaccaatggactgttagtgaaagtgatattacttctagcccaagcagttaaaggtggttgtactttctctgcaaatgatcttttctccttgtgcagtcacttgggaggccgtgtgtcccagatggcatagaactacaaagaactacatagaactacaaaacagagaaggctgtatactctgtattgcacttgatgtaagaaatattttgttgtcactgagattttagtgtgtgtgcattactgcagcccagcttatctcatattttcccttacacactacagatataaattattatttttgaaacatactagcatgcttagatggtctcattacccagtggccctgggaatatttactgcattaaggcaaagcctcaaagaatttgttattctctactataacattctcctggatgctaaacaaaatctgcatggcgttccatctctcatttctgttttcaacacacacctcctttcaaatattgatttttagcatatgtcctaaaactgtttctcaactaacgtgtcaccatgtgtcttttatgccaaaggagccaatatgccaaatacgtgaagcatgccaatttgccaattttatccatgttaggaatgaacagctttgaaagcttcctcgctggatgacaaagatgttgatcacaacaagtggagggtttgtctgcatctgcaaagatacttgctacctaagggaaaactttcaaaatgtatgtttcagacaagagcatttactgtggtgtgcatcacaagtaaaaacatttggaatagtcatcccaagagctcttttttgcttatttatagaagctttcattattgcaaacatccttagtagttgaaaaatatacagtacaatatatatacaattattggaagatcatagaataataatgctcttgaaatatcaccttacctgttctatagtttgacctctggtaacatattcgttaccaactttgattctaggatggatcaagcactttaccaactcagaggagttaatgcccatgaggaaagcagctttgtcagcatctggtcatcagaaatagaagaaaaggaaggagagaggaaaacactgttaagattcattccattatagccaaactaactacccagaggacagaaagatagtgtgtttacatcagcgtagcaaagtagattgtagttttcaaataaatgcctgaatcctaaaagtttaaaggaaattatttcttcgaaatacaagtcaaagccacattgaaatctcacttcttcagtttgttggcattaaggaaaaagaaaatataatgccactcacagccactagaatgactataatcaaaacggcagacaataacaagtgttgacaaggatgtggaaaaatgtgaaccctcatgcattgtgggtgggaatgcaaaatggtgtgtatttgccgtgagaaacagtttgacagttactctgaagttaatcatagagttactatggaacccagcaatatcacttttaggtacacacccaagataaatgaaaacatatgttcacacaaaaaattgtacacaaatgtttctagcagcattattcacaatagtcaaaaggtgggaaaaagtgaaatgtccatcactgatgaatggattaaaaaatgtggtatactcatataatacgatattgctagtcattttacaaaaatgaagtattgatgtgcactacaacatggctgaaacttgaaaacattatgctaagtgaaaggagtcagacacgaaaggccacatattgcaggattccatttctatgaactgttcagaacaggcaatccataaggacagaaagtcgattttggttgccacaggctgaggagaagcaaaaatcaaaataactactaatagttgctactaaaagtttatttttgtgataataaaatgttccggaattagatagtggtggttgcacagccttgagaatatactaatacccaataactatacagtttaaaaggtgaatattatggtgtatgaatcttctaaaagaggactagtatcaagaaacagaatcttttaaaaattgagatataatttgtctgaaggacatggaaaatgccatctttataatttgttttctctttctatgtatgtacttgtggactctttcaacaaaacacggacttgggccatgtaatctgataattatagacaagcaccaatcaacagaagccaggacacttgccagctatctgtaaaacacccttcctttcccggcaaggtctctgtttgctccgtagtgccctctgctgcccaacaataatacttacaccccacaaaattgttttatgaaacaaagcttccatttcctcaagaagtggagaataagtattatcagaaggaaaagtaaataggcatgtatcacttcaggtatgaaaaaatgacacaaaataatgacacaggcaaaaatttataagcttatttcaaattgtagattatttcagttaccaacaaaataaatattccactcatccaaaacccctctctgctttctattttaaaggaatttggagatatgctagtatgtctggcatagtcattctgttgaataatgtcttataatagaaggtaatgcagcctttctttaattcactaaagaaaaaaaaagctgcaaattttccagagcaataatcacgaacagaaaataaagtaaaaacaaaacacaattagagagctctatctcgtctgtattagcaatatcaatttccttttcacagcctttaaaatgtttacaaggcttaaaatgtttgaaatgtttgattttcttataaactaaaatcaatatatataatacatacattgctacaagttacatacctactttatgttagtttatttgcagtgataatagcctgggtacttggttgctatgaaacctttcaaaacacaaagcctatttggaaaaataaatgaaaatcaaaggtagagcagacatgcccatcctatactgagatgtgcctgctaacagtgccaggtttggcggcaaaagcttgataatttcaaattgagaatccagtatgtcaaatcatagactttttgaactgaaagagactttatagagtatctaatccaatgtgaaaatatttaaaagacgggaagaaatacaatgtgcctggcaacctgagtggagatgaacagtaaccaacaatgtgaaaaacaattttccagtatctgtccaggtttaaaaaaaaaaaaagagaaacatttgttttttctaagctttggaagcatgaagagagataatacaggtaataatagtctcaaagaatagttccccatgccgagtcttcatatatcctttttccagtgttaagcacagtcctttgagtctatttttatccatgaacaaaagaaattcagattctctgaggagtatcccaccttaagcttaacagaaatagcatctaacattacaggattatttgtcacttactccagagatagttgagtatctacagacaggactagtgtaccctggatttactccagagatttacattatacatcacatatgttctctgttttggggggaaagaggaaacaatagaggtcatcatgttccaaaaagtaaattacttcatttgcactaaatgtttacagtttgcaaccaagatgaaaatggcgtaaatctatgactaaatgcccatctgacattcaggaactactgttgtaaagatagcaatatgtgtaaacatattttaatcatattcccaaataggctttatgaaattcccacccataagcatcagttccttcaggaccttgtgaatgaacccatggacttcaattaggctgcatgatcttacctgggagaggtaacatttagctagagaggtggttctcaagcatcagtgtgtattggaatagcctggagagctaatcaaagattaaacaacaggctccctgaagcaggttaggggctgggccgctctagttttatcgtgttacccaggtgattctgatacacatacaagtttgagaacaaagttgttattgtggtagtcctcaactttgactgcacactggggtccctggcaagttgtaaaaacaaatactgatgcctgaaattcacccacagaaatctggcttgtctggcttgggtaaggcctgagcttcaggattttaaaagttccccagcgattctgttgagcagccaagtttgcaaactactgtctagagaataataaccaggtttcgtaagtttattttgaaatcaggaagatggaaagaacaaagtatgacttcacctgaaaacaggtaaaaaggtagagaaactcaaaaaggaatcttttccaaatttccaattctgtcccagttcagtcccatctgcaaataaccagatatgaaagaatgaagcaaaatccagttttgtcagtctacaggggttatgataaagatattaatctcttttatggaaggttataatacaatttttgagctgttcatatttcattaatttattaaacaaagttaactgagcatttgctatgtgtaagccctgatgctagataatgtaataagaagataaataaacaaggcaaaaatccctggcatcaagaaattataatctatgagagtaaataagacatgggaaaaaatagtatgtcagtaaaacaactgcataagagacacacaaatcgagtatcacaaaactgtgaagtagggaaagagcccttctggactgcatgactggggaaggattaaaaaagaaacaacattcaatctgagccttgaaggatgacaagagtttttgtaggcaaatatgggagaagaagagtttccttaacaatgaacagcacgacttgaagccacaggcgttgaagagtacaaggtatggtcaaagaagaggttgtaacccagagggactggactacgataccagggagtgagtgagaaactgagaaaagcgggtgacttctggtcgcagaagacatctaatgccgctataacatattaattaaagaatggggaaatgttaaaggagctgtaagcagagaaatgacataattagagtcatgctttaggatgcttaattttggaaatgtgcaagacagaccagagtaggaagttttaaagtacagagtgaacccattgcagaatgctgaagtgtgagatgctgaagctccaaatttgtaatgagaaagggagaaagagagactgagaaatatgactaggaggtttccagtctgagaagtagaaagaagaacaataccataaatatgaatagaaatgccaataggaagacatcacttaggggagaagatgatggacttttagccatgcagagtttaggatactagaaaatatgcagctgagagttggaaatatggagttggaactcaagaaagaggcaaaggctaagatgcccctttgggtttgggtgcccttccccgttccttcttctccatctgtccagctccttcaaaaccttcctaaataattaactgggaaaaatttaccaaagcttaatatattaagaacccttagaattaaagaaaaattcaacacctccatttttaaaatgagctaaaggtagaagcatactgaaaaaaactcagtatccagtaagatgcttaagttaattatggtacattcatacaatggaatattttgtagccatctaaaaagatattgcagaaaagacaaaaagatgttcacatataatttggtaaaaaaatactaggctgaaacaacatgaatatgatcacatttttattttaaaaagttatatgtgcatattcaactagaaaatgcgtaaaaaatatgtcctttggcattcacagtgattgtctctgagtaggtagggttcacttaatgaataattagccattactatgtgccaggcacattttaaaacctggaaatatagcagtgaacacaccaaatgaggtccctgctcttacaaagcttacatctggtggagattgaggggtggaggctaggacattcaataaaaactagctgtatgaatgacatgaagaaaaatatttagattagggggatagtggtggaggtagctagagaaggcttttctaataaggtaacatccaagaagttactttaataagtgagggagtaagacatgaggacaggagaaaagttccaggcagaaagaagagttagtgaaaatagtcctgcaataggagtgcttacatgctccaaaaacatccaagaggccaggacatgtgagtggagggaaatgagagacgagaaaatgatagatttcgctactaacggtagggattagagagagacagagaagtattggttggtgcaaacataattgcggtttttgctgttaaaagtaatgacaaaaaccaaaattacatttgcaccaacctaatatcatagaggttaaggaagctgtgacaggaacgtggggttttatttggagccattgttgagtttagagcagaagcaggacatggtggaacaagggctgactgacactgtgaaaggactgacagtagcttctgggtgcagagctatccacctatccatcgtaggcaaggatgcaagcagggagaccaggaaggaggctgtagtaagaaacggtggctcgggctaggtggtggcagtgggcatggccatggtgataagttgtgagcttttggatgtatttcaaaggtagagacaatgaaaaagagaggagtccaggatgattctgagatttgagtcagggcaattgggagaacctaggtggcatttttgaagaagaccgagaaatgaagagttggtagtaaaggcagggtgggatgaagagttcagttctattcatgttgagtttgagatgggcaccaaagaaatgagcatagaaagggaagaggaaagattcaaggctggagccctgagcagccctagagcaattagcagtagggaagataaggaagctccagcaaagaacctgagaagaagccaaaagggagagtggaggagattacacatttcatttgctcatctgtgttttttgatttatcagtaagtatgccttgtttttgtaataaaaaccattctttaagaaaagcctttgttttaaagcatggaaaaagcaaacaggatggcaaaaataaaataagatgccataaaagcatatgtgaatatgttaatatataagatgtttacaagatcttcataacacattgtctcacttcattcacatctgtgctgtgtcctcttctctgagggactgacttcctgaccaccctatctacaacaacctctgtatcctattattccttatttttttaactctgctttacttcctttttgtatggaacttgttacgtatttatgtatttattgtctaactcccacactagacaagacagggacaatatcttgttcacggatgtatccctagcatcaagaatagtccctagcacagactggcctccaaaattatttgttgcacaacaggccaggcatggtgtttcaggcctgtaatcccagcactttgggaggccgaggtgggtagatcacttaaggtcaggagttgagaccagcctggccaacacggcaaaaccccatctctactaaaaatataaaaattagcccagtgtagtggtgcacctgtaatcccagcttcccagctactcgggaggctgaggcacaagaatcgcttgaacctgggaagcagaagttgcagtgagctgatattgcccccctgtactccagcctaagccacagagcaagactctgtctccataaaaaaaaaaaaaaaaaaaatcacaaacttgtcaaacaacaacaaaaaaatcctaattttaaaaataggcaaaggacttaaatagacatttctcaaaagatatacaaatggccgataagcacataaaaagatgttcaacatcaccaatcagtagggaaatgcaaatcaaaaccacaataagataccactttatacccatgaagatggctactataaaaaaaaaaaaccaaaaaacagaaaacaacaaatgttggcatgggtgtgaagaaattggaaactttgtgcattgctggtgaaaatgaaaagaggtatggccactgtggaaaacaatatgatggctcctagaaaatataacagatttaccatttattctaacaattccacttctaggtatatacacaaatgaattgaaagcagagactcaaacagatatttatatactaacattcatagcagcattactcacaatagccaaaaagtggaagcaaccaagtgtccatagactgatgaaaagataagtgtgttatatgcatacactggaatattatttagccttaaaaaggaatgaaattttgatacatgctacaacatggatgaaccttgaagacattatgctaagtgaaataagccagttacaaaaggtcaaatattgtatgattacacttacataaggtgtctagagtcagaaggtaaaacagtggttaccaggagtacaggaaggggataatggggagttttggtttaataagtacatagtttattcaggctgacatgatgaaaaagttctggcagtggattacattgctaattacacaacaatgtgaatgttcttcatgccactgaactgtacactgaaacatggctaaaattgtaaattgtatgttatatatattttattcattaaaaatataaaatttaaaaaagtagttgttgaaagagttgaatgaatgggttttctctttttgtttcggttgtaaggaattttaatattaaaggtaataacaactatgctttcttcttttcataattgtggggatttattttaatgatcattctagacagatcattcattgtaagatgcctcaaatatttctggtaagcagataagagtatagatttttttaaatgtgaagaaaaaacaaggagaaataaagcctcctggtctcacccctgtgagttagttacttcccactggaattccaagggccttagttcacatctccattatgtcacttaatacattttatcataatttgctccttatttttgtatttttattttattttatttttttgagactgagtctcgctctgtcacccaggctgaagtgcagtggagcgatctcggctcactacaacctctacctcccaggttccagcgattctcatgcctcagcctcccaagtagctgggattataggcgtgcgcaaccacgcctggccaattttttgtatttttagtagagacagggtttcgctatattggccaggctggtcttgaactcctggcctcaagtgatccacccacctcggcctccccaagtgctgggattacaagcgtgagtcacggtgtccggccataatttgttcctttctctcattgttctcaataatctatgtgctaaaggcatactgtgtcttaattctccttcacccaagtttagcaaattgactggatcatcaataattattgaggagtgcttcttattctgtgataggaggattctacattagaatggtagttgacagaaccgtttttgaagaacagcaatcaagggagacactattgattaattttaagtaagagatgaagttaactgcaaggtaaaggggagcaggcttgggcccagagatttgaagtatataccatatcttcaaagtaattcttactttctgtgccatctgcttccagttgctcttctctaggtttctgtttaaatttcatatttccaaagtgcatgatggctccagtgagtttatagcatccatacttctcatcaggaagaaagcccaagatgtccatggcttgctgtaaaaagagaaacagatggccctgtcttcatttgcttaatggctgcagtgagcacctcacccccgctgtgttacacctcgggctgtgggctgaggggaatgagacagacagctctgttcaaagcaatgcaaatcagccctgttggcacttggtcacccgcagtctgctcatccctttaaaagagaattaggaaggcacaagactaggcttgtttagttcccaatagttttagaactttccttcaatgccctgcctctctcttgttccttccagcaacagatcactaactggctatatgaggtcaattattttgcctttcgtggttatggcagaaagcaccatatctgctgagttgcttgtttctgtgatcccacaggttctgactttattccagaggagacacatttcaaagactggtgaaaagaaaggtttaagaaaagccacctcaccataaaattgcatcctaagaatccactgcacaaggtgtgcattctcatacaccccaggagggaaaaaattggtacaatctttctagtggttaatttagaatatgtaccaagagactataaaaaattcataatccttagtattttcacttctaggaatctagcataaggtgaatctgatatacagaaaaagtgtttagctacagagatattcacctcagtgggagtgaaaaaaaacttgagtctaacactaagagaatagctcaataaacaacaggacaaatgcctgataaaatcttaagtatccacttaaatgtttatgaagagttcctaacgatatttgaaatgcttaaacgattaaactgagaaagcaaattctatatgccaaatgtctatgcagcataattacagtcttttggtaaaaaacaaaaaacactaacatgaccatacaaaagcagctgcaaatagataaaaacagaataaaaactgtaaagatatacaccaaataaaagagatgtttgccattgagttgaaatatctttctactttttcatagcttccaaagttactatattgacaatgtgcagttttctcataaataagtaaactttggacagaagcagccctacacccctacggaagcaagaccacttctctgggtccctaagaacagaactctaagattctgtctttcatttctcattgccattaccagattttgctttgacaactaacaagccttacttctgtggccagcaattcttcagcatcatccaagctctccacagtaactgctccacaggagcaaaagtggaagtctgagggatttgcagataccaggagcaggtctagagtgggaaaacgattcgttaaacagcttaaagaaatctgcaaggccttagaaaataattggtcaatattcgcagtttagtctacagtttatatcatacttgtaaacaagccaaaataaaatccatattttagacccaaacttctacaatcaatgtttgccctctattaacttgtcagtcatgtgttaatgcctcccaagagaagacaggctggcaaattcaaaaagcggattcaattgcagcagtttcaattggtgtaaaaaaaaacaaaaacaaacaaacaacaacaacaacaacaaaaagacacgtaatgtgtgttggcaaaactctgaaaacaggaatttggcctagatttatgactgagggctggaggataaaagtattttgtaaaattataagtagaacagacctgagcttcaaaagctacgaagcagccagaagctggggtcagcgcccagggaacattagcagggcaaccctgtcacatcacatcctcgctattagagaactgagtctgtctttcaagggatccataaatcagctgctgtgttcagtgctgcaccctgatatgtctaagagtcctgacatgattcacttagtcaggaaacataatccaggctgaagcagaggcaggctgtcagccgcgcatcatcagctgacttggcagaatcacattaacctttcactgtccaacacttgctcccagtgaagtttttttgagctgatcttatttttctatttattgctcaataaagtgaaaatcggttatcttgaactccaaatctcagaaacaaagaaattgggctacataaatgttcatagcagttttgttagaaaacaagtcaaataaccatctgcagttgaatgggttaacaaactgttgtatattcatacagtggattattattcagcaaacaaaggaataagctataaatacgtgctagaacatggaagaatttcaaaataattatgctgggtaaaataagcctgacaagaagaatatacactctatgattttgtctttaaacattctagaaaatgcaaactaatctgtggtgacagaaagcatattagtggttacttagggactggggctgggaaaggagggctccaatgagtgaaaagggacaggagggaggtattataaaagatccaaggacacttttgaaagtatacatgcattatgttgattgtggtgacagtttcatacacactcatatatatgttaacacttacctgttatatacttaaaacacgtgcagtgtactttaggtgaaaagaacatcaataaatttgttttataaaactttaaaaataaaattggcctagcttaaatccagcagaaggtgaatatgtgtattttaataaaaatatcctgtaaaaatttttacagtacttgtttttgaaatgatttttattttttaaattgacaatttaaaattgtatatatttatggtgtacaacatgatgttttgatacatgtatacattgtggaatggcttattccagctaagtaatgtatctgtcatttcacatacttttttttttgtggtgagaatatttaaaatctactctgttagccatttcaagtatataatacattgttattaactataatcactatgttgtacaatagatcttctgaacttattcaacttttttagattctacatgggtgagatcatgtggtatttgtctttctgtccctgccttatttcatttagcataatgtccttcaggttcattcatgttgccatacttgacaaaaataacaagattttctttccttttcttttgaggcagggtctcattctgtcacccaagctaaggtgcagtggcatgatcacagctcactgaagcctcaatctcccaggctcaagtgatcctcccacctcagcctccctagtagctgagaccacaggtgtatgccaccatgctcaactaatttttaaattttttgtagaaacggggtcttgctatgttgcccaggctgaccttgaactcctgggctcaagcaatcctccctcctgggcctcccaaagtgctgggattacagtcatgagctaccatacccagccaagatttccttctttttttaaaggcataatagtatcctattgtgtatatataccacattttctttatccagtcatccttcatggacacttaggttttttctctatctcggcaattgtgaacaatgctgcattgaacatggaagtacagatacctcttcaggatactgagttcatttcccttggatgtattcccagtagtagatgactggatcatatggtagttctgtttgtaatcttttgagtgactttcataccatttttcataatgactgtagtaatttacagttgactcaacagtgaaaaagggttgccttttcttcacatctttgccaacatttgttatctcttgccttctgatagtaagacaatatctcattatggtttttgctttgcatttccctgatgattattgatgttgaggcttttctcatagacctgttggccatttgcatgtcttctttggagagatgtctgtcaggtcctttatccattttttaatccagttgttttcttgctattgagttgagttctttatatattttagatattcagcccttataagatgtacagtttgcaaatattttttcctgttcattcagtagattctctcttgatgatgcacaattgttgtatactttatgaagtgaatacacagggttgaggccaaatgtcaaggattccaggacggaaggacctcttggtcacttaccatcactcctggaatttatacactagttgaatagcaagaatagacacaataaataaatagaaagaaaaaaagtcaaaagaaaaagaggagaaaagggaaaatatatgtaggaccaagctatacagacggcagtaagaactaaggattttgaatgagccctgtccaaaagaactgaagaaatgagccttagctatgcctggaacaagggtcagatataattgagagcaaaggagtgaaggggtgctcatggccatgtagaggtcaaataggggctggctctgaggtaacatgtcacctcatttccttcgctccttcagtgggtgaccagcctctctgctgtgatttccatacccaattcttttgtagtatggacaaatcctcatatttcaggatatgtggacatcatcctcatatcgttaagatatgccctcttgtattaagcctcaggatactctgaagctcttctttagcaaacatggatggtaagagttccagatcatcttttaaaatgtcccccaaaaggacaatgggtgctaaaacaggtagactgacaatacccaatttggaccaccagatgtcagactttgcacagtaatcaatctcagcaacccccaaagaccgaagaagataaatgaactcaggataagcatgcattttccatagcagcccaaaggcatcagatgcttctattagtaaacagagttgctctgaaaataatcttgcagtctctgctggtacccacattagatcttacgtgtcagttgctctataccatccagaaacacatgtcaagagtgttagatttgataggactaatcaatggaagatcaaaaaaaatcctgttccaggttgaggtggagagaaggtggggaggagaatacgtgctgcttacatgacaccaattacatctatggcaaaaataattgtctcgtttgcagagctttccccatttggtaagggtactttaaaaaccaagtagtcaaaacactgctagatttataccatacttagtctaagcataatggactgggagaattgttcccatcagtttactagcctggatctgtaatcttaccctatgtccacttctgtgggagcattgttgtcctcaaaggcttacctcaaatgcaatacctcggaaatcaaatcagcgtgtagttctccccttccaatgacttcctatgccactttaaatggtctgccatggcctgcaatgcactgcatggtctggcccctgcctattttaccctacgttaccctctctactctaccacccacagtggccattttgctattccaagaataaatcaaatgcattattgcctcaggacctttgtactcactgttccctcctcctgggattttattcctggaaatctttgcctacttgctcccttactcattgaggtgtctgcaaagaatgttgtcttttcagagaaattccctgacaatttcatctaaaatagaactatccacaaccctaccaaaccccatttctttctgtcccctcactgtactttattgttctttatagacctgccatataacctacaaagaaattagatcatggttttttttttttcttttttgagacagagtctcactctgttgcccaggctaaagtgcactggcacattctcagctcactgcaacctccgcctcctgggttcaagtgattctcctgcctcagtctcctgagtagccagaattacgagcacctgccaccatgcctggctaagttttgtatttttcgtagagactggtttttaccatgttagccaggctggtctcaaacccctgacctcaagcaatccatctgcctcagtctcccaaagtgctgggattacaggtaggagtcaccacgcccagcctagatcatgtattctttactcatttgttgcctgtcttccatactagactataagctcatatgggcagaggcctgtctacctcgttcaccactgtaccccctatgattaaaaagcagtgcctggtgtacacatagcagctccataataaatatttgttgaataaatacatgaaattcattcccttattccacattttttttcttattttatgtttatggcactatcattctcctaatcaaatcacaaaacttggggatatttttgactgactcatcactcttcctcattcttacattcagtctctaccaagacctgtctattcttccatgcatctatcccttttcccccacccttccattctcagacactctcttagatcactgtcttgtcatctcatactgggacatttgcaatcccttccatccaagtctctgcctccacaccatcctgcccattaccagcttaatcgtcccaaacactgccttcaataaatcatgacctcctattgccgcaccccccacaacacacttgctctgccaactccctgagttcagaaaccatcggaataaaatctccactattcctctgtgcaaaccttttcctttaatcaacctggtctctctgttccctgctcctgctttgccctttcccaacattgtgtacactcttcctcctaccagaagtagcctccactcttcactttgtctgactgaatccccttcccattcttcatatcccaacctaaattccccttctttataaaactccctgagccagacacggtggttcacacttgtaatcccagcactttgggaggccaaggtgggaggatttcttgaggccaggagcttgagaccagcctggccaacatggtgaaaccccatctctattaaaaaagaaaaaagagagaaaactcccattgaccaccacacactatgatgctatttccctcccctggtccttatctataccacccatgtagctctaattaaggccttaaattaatgcttttatacacacacacacacacacacacacactcactcacctctgctgggcatcctacccatttccaaatactctgcttctttttgctaccaaattgaaaaagaagtgttgctatttactgtctgtccatataaaattatacaacactagttctataattgattcaattccctaagttttaaggatgaatatactgaggtctaaataggctaagaaacttaccgaataacactttttcatcccccaaatatgacttatttttcttgttttggaataaccctaagctccagaatcctacacttaccatgaagctctttttgtccagatagaatttgatagaatatgtggtagttcctctctccagcctgctggaaaatcaccctggacttttcaagcaaatctggatgatgagaaatgaataaaaattcatacttaggcattcttgcaaaatgtagaagaaaagtaatcaggctgagcgcagtggctcacaactgtaatcccagcattttgggaggccaaggcaggagaatcacttgaggccaggagtttgaaaacagcctgtgcaacatagtgagaccccatttccacaaagaaaaatttttaaaattagctgggcatggtggcacatgcctgtagctgcagctacttgagaggctgaggtagaggattgcttgatcccaggaattcgaggctgcagtgagccatgatcatgccacggcactccagcctgaacaacagagtaagaccctgtcaagaaagaaaagaaaagaaggaaggaagggagaaaaagaacgagagagagagaaaaggaaagaaagaaagaagaaaaggaaggaaggaaggaaggaaggaaagagaagggaagggaaggaagggaagaaaagaaaaaagtaatcagacagtgcaatgactacttacagatatcaatgtccacagatgacagcatgcctctggcaccaaagtgcatcctgatgaatttgccctagtgtggacacagaacacagtcagacacaaaacacagtttcctattcacattttccaagcacttgcaatggcttcattatatgtaactctcaaaaggactacttccccagaagtaaaaaacaaacaaaaaaaaaaaagaaagaaagaaaagaaaagaagagaaaaatgcaatgtgggtttgagatgagacagcaccagctaatatctggaggaagccagaatgattgtcaggactagcagtggttctggcttgtagccccaaatctgctgattgctacctgtgtattcttgtgggcattgtgaaatctctctgggcctcactgttcttatctaaagatgagaaaaatatttcctcagcatatttgtttattcatgcaacaaacattcattgagcatctactaagatccaggtaaccttctaggcactggagataccgcacaaaaaaaatagacatggcccctaccctcatgaatcttatagtctactggataagcagctactgcaacagctctgacataaaatcacaagaaaagccaatatcttagaatttagaaagtcagagaaagggggggcataaaatggagtcgaagaggtagacaaactccatatcatctaagccatgtagaacacgggaaagggtagagttttattttatgtgtgcttgggagacattgtaaggttttaagcagaggagtgatgtgatctaatttatgtttcatagcacaccttggcataaataatagacgggcaccctttcttccttatcagtgaaaagtcataaggcaggatctagaggggcagaaatgctgtccagaggtgccagtgcccatgtcagaatgccagatgcagctgaggaggtggcaccatctggtggcagctagagcctgtgggatcaggatgctggaacagggaggaagacagcctgggggaggctggcccatgccaggaaggcatcagggcaggacagcagcctggcaagaagacgtgagtggctctgtacagggggatcaaactagtacattaaaatatgtaggacagtgggagtcacacacacaaacatacatgtatatatacccatacacacaaacatgcaagtaaatatgtatgtgtgcacatacacatatacagaagtatatgtatacatacctatttagtattaattgaaaattttaacccagatttcttgatttttttgaactcctttttctttctctcttctttctttccttccatttatccatcttcatgtttatttttctcctctacttctttccttctatctttccaacttttctctcctttctgttctctttcaattgctttcttttctttaaggcaaattcctactctgttacccagcaggagtgtagtggtatcatcatagctcattgcagcctcaaacacctgggttcaggccatccttcagcctcagccacttgagtaactgagactacaggtgcgcaccaccactccaggctaatatttttatttttagtagaaacaaagtctcactgtgttatccaggctgatcttgaacttctgggctcaagtgatccgcccacttcagcctcccaaagtgctagggttacaggcatgagccaccacacctggctatctttctttttacctgatgttcttcgctttcttccttttatttttttccttgtctttcttctttccttttttaaaatgttctttttctgtccctttattgctcccctttgcctcccttgcttttcccccagctttctatctttcatatttcagcagaaagtcctttagcattctaaaacatcccaaatctaccagttgttttatgaaccagtattagcacctgctatgaccagccagacactgtaagctcatctaaatgtggacagagaagctctaaggctttggatggaaactagccaaatcggcatgaggttattatttaattatgcccggagactcaaataggaagccttctgcaaattttcttgtaaattatacagtggctccctgccactgattcttggcataatatggatttgttaaactaggtttagaaatccaaattcttcctcttttatgggagttctagttatcaaaagctacttaaaaatactttctccccagcccgccaaaatgtctccagtgaaaaatatgcaggggttaaggaggccacaggcaacagtacaaacagtaattgtagtaagtgaattaggaagtgcctactaaactgacttgttataaggggtttaggaaatcatgaatgagaaaataattcaaatatgtaaaacataataaaatataaaacattattataattttttggatgagcttctctactgggagtggaatttgaaactattaagataaatgcttttttcttgaaattgaccaaatagaaactcctaaaatgcatatttatttataaaaatttaattgtcttaatgatatagatagtaattttttttgagaaatctaacattacagactttaatcaaagaccttctttggtgttctataattttttcatacctatgtgcttacatataagttttaccattgcttacaaattaaatactttgatattatgctaaatcatgttacttacaaaacgagaggagttgtcatttctcagggttttagcatttccaaatgcttccaagatagtattcgcttgcatgatttgatcttctaacgccccctgagacacatgcaagagaagtacagctgatgaaactattagtagaattctgtaatgcggcaagccctccatctccaggtcaaaccccattcttgctttgataaccaatggccaaaagctgcttccaaatttggttatattatcttcgaatgagaaatcagaaaaacagttggatgacagaggctaacaatatacaatacccctatgaatatgtgggagctcgtttatttgcaatgcttcttttttggttggcattggcctgagggggaaaagcaaatggtcaccaaataaaaaagaaaaacataccaaagcttatttccagacaaacatatcatatatttcccccatcattaatcttcctctcttcccatccgatctttgcacttggaaatttatcctaggataatacaacagactcttggtgttattaaactatacttttgcttgcttcttttcctaagtaatctagaggttcacatgagtagtgacttttaatagtattgatcttgaatttgaatcacgtgtgctcaggctgataggcaaaaacagatcatctacctatctaccatatctacatggctttgttgttttccagtcagcctcaaagaccaattttatgggggtaattatgtagtatatggtatttaataatttgtggatttataaatattatatcccttcttatatccctactactatataatattccccatcttatggggggacttatatagtatactgtactcaataatttatggatttataaatattatatcccttttcagtaatatgggtttactgtccttcaaataagttagagaacattatatatatatgagcaaggatttccataggagtgttatatttatgtattgtattatatattatcataaaactcaatggctagaccaaaccatttaatgcgcaccaaaaaaaaaaaaaaaccacaaacatctaaaatgcttgtaaaaacaaagttacatctagtgaataaaagagttcagtgatggccaggggcggtggctcacgcctgtaatcccagcactttggaggcctacgcgggaggatcacgaggtcaggagatcgagaccatcctggctaacacagcgaaaccccgtctctactaaaaatacaaaaaattagccgggcacggtggcgggcacctgtagtcccagctgctcagaaggctgaggcaggagaatggcgtgaacccaggaggcggaggttgcagtgagccgagacagcaccactgcagtccggcctgggcgaaagagcgagactccgtaaaaaaaaaaaaaaaaaaaaaaaaaaaaagagctcaatgatacccaaagaaatcaataatcaaattcaggaacgtggtggtaaaaaaaagaaacttctatagtttaaaaattaggtcagatggctattttaatatatttcttactttgcaaaaacagcaaacatccagtatcgaattgaaaaaagcaaaataatcattccagacatagaaaaatgagaggtctaacagctcaataactcattgattttgagttccattcagcattacctgattttattttgcataccaatgtttatggtcttagttatcctcaagttattatgatgtccattaacatgttaatggagctaaacaaagtaagctaaactaaaatgaacaaggattttttttttaatagggaaggcaaagtttttctgaatgtggtatgtgattaacattgaggggtatattcattgggcatttagaatttgatccaggagttaggtatgaatgaagaaaaattttattggtgcatatttgtgggaatctgatatctcacagtagctaaagggattcagaaatatccaagccactgatgaccctagcctttaggtaagatggtttgaatcttgaggacttaacttacaggtccaataaacaaagaccaggccagaaaatgcccctttaagcagatgtgaaattaattacataattcatgttttcatgttattgtttggagcacttgatgatcctctcaaggaccaaaggaaatatttaaaaaaatacttttctataatttgcaaattgtcctgtggtgcttgtggcctcacttcccaaaagtggtccggacacaacctccatgatccagtggatagggccacctcatcttttctaccaagctatataaacacttacctgctttttcctggattcaatcatggctgctatggtggcaaaatactggataatatgtttgctgttcacagtctttccagcaccagattctcctctgtgatttgaaattcagtgatacagttaactggttctgattatcaatgcaacgaaagttaggtaattttgattatataggctatggcaagcagggaagcttttacataaaagtagagcttcagatggaacttgaggatatattgacatttaattggttgggagaagggcaaggacatttcaggctggaaaaacagcatgagcaaaaatctggagttagaaagatcacaactttttgtaaatattaggaagcctgttccttgtggtcctaataacaagcagcaggaaagcacctcttctaactagacaagtctcctcattaccagctgttcaagagattttcatgtatgaaggctaccacacagccaagtccaaccctcttctcagaagagggctaccaatcacttcaccaggcagttgggctttaggctttaccttacctttgacaaccagctaactttgcaatgtgggaagagcacagtggcaaatttatagcctcctcaatgtaagcatcatagaatcaaggcctgcctgcctttatctatacaaaactccagaaaatagtttatcctgtctgtgaaaggctgaactcccaactgttcatgtagctctaaaattctgagacctcatgatccctcttgggataactgaagccaatggagagcccaatgtacaaggtggtaacaccatcattgcatgggaaggtaaaggactttagcacttcacagccccttgagtctcagccaccatgctgacactttacctggccagccagggctcttttcatcaaaattcacatacaataagatatcactgtgacacttccgtctatcctttttacgccctttcttatttctctaaatgtcaccatcttttagtttccactgcttcatgtactttgacctgccccaatctggctgcccacaactgcttgttatctgttccatgggcatacctattggacgttcagcccctctgcttagccagtccagaggcctttgaagatgaccatttggaacagtgtagctctcttaatcctcaagaaggtaattaagaccagcttgtgcactatttctaaaggatctctgaaaatgagggaggcagactagctgaccccatatttggagtcatcactgactaaagcactatgacaatttcctgagtatctttttcttacctcaaatgtattgcatctaaagggcaattaattcaaagatggcgaatcaaagttttattcccagtgaaatggaggtatctatttcactgaaacttacttcaggccaaaaaagaaaaacaaggcaaacacttacgtgaagagtatagactgattttctcgatctacaaaagaaagaaaaatgccagaatattcttatattcgatatttatgtattagtatgaacttactcaaaatttccctagctacaatttgaaatcagacacaagggaaaggattagcatcatttatagttagaaaaacatacccctcaaatggtacagggtaaaatcgattttctcttgcccctatgtatgccaatcataagaacatataaaggcctacttctttgcgctacatataaatggtaaccaactaatgattgagattcttgccattttaagccttttaagaatcgttgtgtaataatatctatagaataacttctttgtgccagacaatatagaagatgctgtatataataaaggctaacatctgcagggggcttactctgggccagccactgggccgagcactttaaatgcattatctcactttgatgtacaaactaatcggcccaataaccctaggaggtaggtactatttcacccacattttatccagaaggaaacagaggcttcaagtgattagctaactgtaaaggccatgctctgctcacaatgcctaagtgcctcttagggacatagagaaaaagtagatcagatatttttacttttcattttgtagggcagctactcactgtgaagcatgtcctgaaaggcgttattggcaacagcaaagatgtgagggggagcctctgatcgcctcttccctttgtaggcggccatgacttctttctgatacacgggaagccatttgtaagggtttatggtcacacagaagagacctgaatatgtctgagggaaaatcagaaaagatttcagaaactagattagaaatacttccaggtttgtcagctcttccagtgtcaagtaatatttgctcaaatattacttataaaggaactcagaggggagcttttggaatcatgtagagaagggacttctaacaagaagagacagaaccaggttagagtaacatcaggacctgggattacctttctcctgggagacctgctaattactaacaagtctgacacatgaagcttctgaagacagagaggaccctgatggcaggactgcagagatttcagtaaccagccatcaggcatttgaggccagcggggactctgcctcagcaagattaggggtttgatttttagggcactgagaaggactagctcatgtgggtcactcagtcactgaaggggttgaattgtcgcccccaaatagatatatttatgtcctattctccagagcctgtgaatgtgatcttatttggaaaaaatagtctttacaaatgtaattacaggttaagggtctcaagatgatgacatccaggtgggtcttgaatccaataacttgtgttcttataagagacacacagaggagaaggtgatgtgacaatgcaggcagagactggagtgatacaaccaaaaggaatgctagagccgctagaagctggaagagacaaggaaggattctccccaagagcctccagagggagtgcagccctgctgattggatttgattttggacttctggcctccagcattgtaagagaataatttctgttgttttaagccacccagcttgtggtagttttgttacagcatcccagggaaactaatacagttacatggtaaatcagaaagctgaggagcaagctggttgcatgccatggctcctatggccatgggtcccagatgctacatcttagcttaatctactcagcactgtttctgctgcataggttttgagtaagtcaaagaacttgagcaaccaaccatcatcaatttaaagatgatgaagaaatcatctcactcattaatcactaactaggtgacatgcattgaactacgtgctttacctacattcttttatttaatcccccaagctcccatggaaaggcagacattgttatcccactttatagataaggcaacttcaagaagttaggaaacttaacaactagtaagtgacagggctggtggctactctgtcaggctctaagcctcatgcttttaactaaggatgacctgtgggaaggcatatgaatgttgacaaaataaaattggggaaatgctaagataaggtcccttcccagtagacattgctcaaggactatccctgtgcgagcatgcttaaactcaatgtaagagatcacccaggagagattgggacatgcaatgtgactgccaacatgacagtttagcaggaaagcatattacacacatagatcatccactggccatagcgccgcttcagggtatgcagcacggatgcctcattgaggtgagtcagcattgccatgtcttcaatcatttcaaactctggaggattcatctgctggattttgtcctcctttatgctcagactctgcagagagaagaaaaatatatgatatattcccctgtctcctatgcgtattcattttcccatgaattagaaagaatattcagactcaaaaagaaaaaatgatgcctcattaggggatggggccagaagaaattaagccagccttcatggaaaaaaacaggtgttctccctgaaaaagccctctccttccctaaagatgaagtaaacatagtatttttgttatatcaagattttctatcatgcagtaccctaatcttatggcttctggctagccctgattccctctaagagtacatggatcatattatgtacaatctaacccctaactcccagcccttgatgtcccaacacaccttggagatttaaaagaagaaacttagagtggaggattaaggaggcagaccttatccttccagacctagttcaaaacctgtctcctccctcaaaccttcccaactactccagcttattagtttgtcctcttctgttaagtcttaccatttgtactatctttacattaatactcttttgtatattttaataattgactatgttagactattttctggctagattataaataccttaagaaggatttttgatgttgtcttctttaatgaagttcaaaaacttgcaatgcatgttcatttttgatgttgttgtcataataactatagttattaaatatagttattaaagcacctatcacaatgcttgggatataataaataatcaataaatattaatatattgattaatatggatgcatttctactatcaaagtttcttgggattcttctcacaggtttcctaacaccctttctatagcccttttccatgattaatacatatttgtgtcaactgattgccccatttaatcccagttggtgatggcttctttccaaggctctcacactctttacattcttgattcaatttctatccatctgtcttctttgacattgttctaacagtaatccctcttcttttgagtcccttcactttctgtatttcaaggactcatctcccctcaaacccatgcagaacgtaaacatatctcatacatcttcaaaaacctccccttttccctaattctatttttctatttttttcatttccaactttcatcaataagtagtactttacacccactagatttattgcctttgctaatgttacaaagaccattgtaacattgtgattggaagtgtagtcacttctaacatgaggaagaggaatcctggagccagggagatagtgaagctgggggaatgggaccttcattacatcaaagaaggacaagcaggacaaaataaaccaccttcagactcttctttctacctgcattaatggccttttcttcctatggttgtaaccacattatagtcacaaatcaccttaagtgctgttgaagggacagtagtttgttttggagaatgtgctcagaagagcaagcctcacatctggaggcctaataaaatttagttggtcatcattaagaaaatgaaaaaatacatagactgagagaaaatatgtacaaataatacatgtggtaagggatttgcaaccagaaagtaaaaagaactcttacaactgaataatgaagaggcaatagcccaatttaaaaaaatgggcaaagagcttgaatagacatttctctgaaggagataaacaaatggccaatatgtacatgaaaagatgctcaacatcattagtcactggggaaatgcaaataaaaatcacattaaaataccacttcatgcccaatagaatggctgtaatcaaaaagaaaataaaatgtgttagtaaggatgtggagagagtttaattcttatatgttgctggtggaaacgtaaaatggtagccactttggaaagcagtatggaaatttctcaaaatgcttagtatagagttactatatgatccagcaatacactcctagctatacacccaagagaaatgaaaacatgtgtccccacaaaaacttgcacatgcatgttcatagaaacattattcataatagacagagcatacaaacaacccagtgacaatcaactgatgaatggatgaacaacatggtatatccatataatggaatactatttatccataaaaaggaatgaaatatttattcatgtgacaatgtgagtgaacctcaaaaacattatgcttagtgaaagaagccagaaacaaaaggccaccaattatatgctcctatttatctgaaattgctagaataggcaaatctatagagttagaaagtagatcagtgattgcctggggctagtgcaggaggaaagaagggggagtgactgctaatgggcacaagatttctttgggggatcttttctaataaaatattgtcccaaggctaagtgaccctgattgagtctatttcttagtttactgatttaggactaaggaaaatttcttgctgaattttcccttgtccacctatttatgttccagttaaaaagcaccaagttcttttcttaatttcctgaagagttaaataacatctacctaatttgagatttttttacgtaacagatattgactgtcaggaagacatatgaaagcattctatgtggtagtttatgagtggcttccagaattttaaaaatcagatggcaacatgttagatcgtaaattgcctaaaaacaaagatagcattaaaaagacaaactttctcgatatcaataatatctgtttgttacaggatgtggcttgttatggatttgggaaaaggaagaatttaaaggagtttagagaagtgaatattggcagggaatcatctgtaaaatctataaggaagagttcatttaagtaggacagaaatggggcccggcttacaccacggggtggcaggtaatgtgaagtcagcaatgtaggcaaaggttctgagagtgagctgtcttctcaatgttaccctgctgctctgaatgccttggtggcagggagaaggggctggcgggtattatggcttcactacacatttcttctgtgaaccttacagtctagcttgtaccccaacacttgatataaccttttcttacaaaggtcatagatgacctcctaattctgaaatccaagactttctccaactcttaatcttcttctgtggcatttgtcattactggccattcccccatctcttggcttctgtgacactatgccatttttactcaaattatacatctcattcttgatcctacaaacacagcttgcttcgtggttccttaagtcattattcaccccacaggatacctttttttaaaaatactgacttgaaacattgatgaaaaagtagaaatggctgtgagttctagtcaataatccttgccactggcaattgttttactctgatttattcactgttcttcattaaatctttgatggtaagtggagtttttttgtttgtttgtttgtttttggtgacaggatctcactctggttgcccaggagtgcagtgatgtgatctctgctcactgcaacctcgacctccccagactcaggtgatcctcccacctcagccttccaagtagctgggactacaagcatgtaccaccacgactggtttatttttgtattttttgtagatacaggattttgccatgttgcccaggctgctctcaaactcctgggctcaagcaatctgcctgcctcggcctcccaaaatgctgagattacaggcatgagccattgtgcccactgacttaaggaggagcttcttaaaatgaatgactccgaagtgagtcagtggcatctcctaccccagatctttaattaaaatattatagaaataatatatttagttatttgatagagaacatagtcatcactgcaatgaaataaaaatttctttacctctccatctgctgtctcaacaattactgttccatcatcttcactcccttttacctcagcctcgatataagcattctcaccatcaggaatccagcatttcttcttccctgtagagcaaaaaaaaaaaaaaatggattatagctatagtacttacagaaatacatactggacactttcatactgatagatctaatctcatttctgctaaatcagcttgttgactacaggaacttgcaaagtcagataaaatcatgaaagctcattctgaagatacactcactcacataatggcactacaggaacaagaaacatctcagcaagcagcagcttgggggcaccatagaccattttgctacaagaaagttacctcccaacacccctcccaaccccaacactttcctccactcacaccccaggactttggtggttgccctggtgcttgcaccccttccagattccctcccccgagaaaactcattcagaaaaagtctgggaacaactaagtgaaaatttagattaatggttatgttcttcagggtttctttagaccttatttctaatcttggaatggaaatcagctaagtgaattacatggtggaattggcaggggggcaggttgaggagagagaatatgggttgtttttgttaaacaacataaccggctcatattatttcccccaatatgttatttttctctcttcagcgtcctcagttcctataccccatccctaagcaaagtagccctccataaactgattaaccaacaagaggtctggggtgaaatgagccagaactcttatgaacacctgaggcagcttctctttctctcccagttgaagcagatagacagtgatgatgaataaaaaatatgattttaagggcctgggtgcagtggctcatgttcataattccagaactttgggaggccaaggtgagaggatctcttgaccccaggagttcaagactagcctgggcaacatagcaagaccctttactcccccagtcctgtctctacaaaaaacaaataaggcagggcacagtggctcacgcctgtaatcccaacactttgggaggctgaggcgggcagatcacgaggtcaggagttcgagaccagcctggccaacatggtgaaaccccatttctactaaaaatacaaaaattagctgggcatggtggcgtgtgcctgtaatcccagctactcaggaggctgaggcaggagaatcacttgaaccagagagtcggaggttgcagtgagccgagatcgtgccattgcactccagcctgggtgacagagtgatactctatctcaaaaataaaaaataaagaaataaaaattaaccaggtgtgatggtgcatgactgtaatcttagctattcaggaggctgaatggggaagatcacttgaacccaggagttggctcattttcttttaaaagcatattatatatatgtgtgtctatgtatgtatatgcaatatatcatactttccttttaaaggaaaatgaatatatatatatatatatatatatatatatatatatatatatatatatatacacatatgaaaatgagccttagtagaagctcacagaagtccccaggtcacagctactcaggtacatggggaaagcctttggctgaaggagggaaaatgttagccaatggctagggaagacacaggtgaaaaccccactataaccacagcactaacaggtaatgcgaactcagtcaccaaccatcacctccaatatatgagtcacaaaagctagagagggctcactgccgcaggacaggtggtccttatttcccagaggaaggcaataagactggggaaggagtgtgtacaaaggagctgaagttgggcaccatttgccccttcttccaccatgcttgtttctgcaaagaatttggttgctcacgactttcttgctatcagtgctgccttcttcgtttccctgattacaaacaattcaccactaaaactgcttggcaagaggagtttatgttcccatctagctgattgtgcatttgctttctacttatcatttgtgttttaaatactggctttgcattgtattcattattttggtccctttttgcaaaaactgattttgctttgtgttatgtctatgaaaatatgcttgtttttgaaaagcacccagttagcatacattttgtgtgtgtgtttaaggtaaaatgctctgcattttaaaccaaatgttatcacttgaaagaaacttgaaggtcacctggcacagtctctctccctctgtctctctttctctttctttttagaaaaagaaccttgggagagagatgaagagagttgcccatagtcacatagctaattagtggcagtcactacaataatgactctagaaatgagatcatccacctcctgaatcagtgctcctgcattacagcctgcctcctctaacacattcttagctttttctcctccaattcttctctccaggagtaggctcaccacctgcctcatgatgaagtctctctcttaccacccctggaaacacttagtggggaataaaaattatcagaaatcctttctcataggagacccaaaccctgacagggacattttaaaaaatgaagtaaatgaactctgtcaattttaattcctggtgttcatgaataatgcagagctggaaatgtagatagcaatggatttgagggaggcagccaggattttaacactggctttgctggtaaaaagatataaagccacatgacttcatctcttttggccttcgtattctcatctgtaaagtaggcctttttctatatgattccattttttagacaattaaatatcttttccaatataaagctaatatgtgcttattgaagaaaacttgaagaataatgtatgaagaaaagaatgtttttaatcacccataatcaaacaactcagagataaccactgttatgtattgaagcatttcttttgaatcttttttctaggatattgattaaaacaggggtaatactatattcagtcttatagttattttaaatagatcgcttacatgttctaatataagaattatttacatttggctttcgaatggtgttttgtcctagctctacaaccacctgggcttcttcactgtcacccaggaattctagttttccttctcgggtatcataataatgcattatatttatttttcacatttatagtctcatttggtccccacagcaatggaggaaggcagaccggacaagtattattatctcctttgatacatgaggaaaccagggctcaataaagtgaagtgatttgctctaattacccagccagagatggtcaaggacagggaatttgatcccaagactacctgctaaatactcgtcatcacactacttccatttgacccgagttcaaaaaagcaaactccattgtctaccagcctgggaagatgaacaacttttgctaacacttgtctctgctgccagtgcatttctatgaggaaggattgtttggtccaaaaaattaacaggaaattatgtagattgctatgttttaagtaattatttatggtgctgattttaataaatgcatcatccaattatctctaatgcttaggctcaatttttttttcttcctggcatcactattatcttgtcctccattatctaactacctgcgataagcctctgcatgaccagttctgacctcagggatagttctgttatcgtatttgatttgatggattataattagcctaaaatccaatcacagtcatgaatccaatgactggaaactgggaactgatccaggactggtctgtgatggaaatataatatcctccataactggcttgaattataattggtcatattaaagtctaatgttgactaattctgaatactagaacgacattcagccagtccttatgttgcactgctgaataattttggattaagacatgtaggtagcttcatgttatatcatactgtgaatctgatttctaaatctccaattagctgaaattcaacacagacatgtaaaggtagcaggaaaaagaataacatttatttagagatttcaatgtagaacttagccttttttttttaaggctaaatcctcattaacctttgtccttgcctgtaactaccaaggaattatgaatcagggtgagcaagtctcctaattaccttttgcttagtgttggctgagtgaccctgctgacctagaagaccgctagaggcaaggctccaacatcaaaaaattctggagagccagagacaacttcaaagtctgcagccttaccagagtctttccctttcttcttccccacaatgtacaaaccccacccaccagtctaagtcacaggcccctctctctactgtggcattcactgataactaagaggtttctaggaaaggctttgtctggccattcctgcaggtgtctgtgttacaacaggggctccttgaagagaaaatctgtcttaggatcaagtgtgtagggcccgggcctagactgcctcccagccaccctcctcttctgtgggtacttccattcctaccctggatactcagaggccctcaattgctcagtttcctagaggctgatcataccctaagcaaataagttaggctctagaactgatggctcttctctgtcaatcaaatatcttagtcaccatcttgaaggagcaaaataaagtgaagccagcaaccaccacatgtctcaccatccaaggctgtggcctgtagtagaagcagctcagcttcacttcttctgaggaaggctgcggcttctccaaggtctgacagatccatctttattaaagcaatccaccaaaaaaaggccctaaacgtgagtaggcaagattcaacctgaaaaaaaaaaattgatacagagaagaaaaaagtggaaataaggcatcaagctctaaatgagcaaccattcacatagatagactaaagagtgttaagttttcctgtaactacctgtgccccttctttctcttcgctatgtctcaaatttatacaaaattggactcaagaatatctgactctagcagggctgacttacccactagacatagaaggcacagtgcctgaggcccacaatgcttttaggggcccatgaaaatgtttaatttatttttaaatcagaagaaaaatataaaagtaatatgaatgatacatattaatgaacagagcctggattatattcatctttaggccaacacagttatgaaatctgatttttaatatttttttgtggagaaatggtccttaaaagacagaagtgcctgtagtcagtgaaagtcataatgccaccctgcgccatggagttctgacaggtggtaggatattccagatggagaaacatcaagttgcggacactaggcctttgataggcgtggaggggggtttcgaggtatctaattacccccaagcagacagaccgttatagacagagtatggttacaaagagaagtgattcagataaatgttcagtaatagacagtaaagggataaaaagataagtatcttggcagagataagtgtctgggagcaaatgatttacaaaaatacaggcacagctgggcatttgggaggcctggccaagagcagtaatgaagaagcccaggctgaaggtggcaagcaggttacatggtgatgtgagtgaagctggaataaataaagaagttcattggctcaagcaaggcaagtatcagtcttagagggactaagttgctggacaaattaccaaggctgaagtcactgagcacccactgtataccaaacactggacatagtttatctttaattttcacactttacatttgataacagggagaagaagaaatggaaactgggccttcatgatcttaaatgagaagctattctctctatttggacaaaaaaagtcttcctcttcactcaagcatgcaaggcaagtgttactcatcacatttataggtaagaaggtagagaaggacttgccaagtttgcttagctcaggtgctgtctttgaggacagatcagcacccacttcagaatgaactgtaatcacttactatcttgcaatgaacaaatccaataaactaatgtattttactgcacttaatctgctctcttctttgtggtggcttggataggtatagtgataccacttgtaggatctagtttaaaggagtatgatttaaagcaaagcctactggttcaggctaagagttagttttatttctgccagcaaataggcatgtgacttgtgggaaatcacttagtccctgtagatgcattttcctcacctatgtaatgcaaggactagtcttaatgtataggaacatttcctaaagtggagagaagaaaagatgctcaagagaaacaacataaatgatggccctccagagatgcgactgaaggcagcatttctcagggaaaaagacaaaactgatttttctgcgggtgagcattcagattcaggttttgtaatcattataacagcaataacattgttagacatctgaatatagaagaactcaaggtaaaggaaagctctgaaaataaggcagagaaatttagaaatagatggtaggaaacatcatcaactctgtgggcaggaacatgaggaaagcagtattttgggaaaatggctctggtggcatattctgggtagatgaggatgaggaaaagctgtagtcagggagacaagttgtgagtctggatttgtctgggtcctcctcctctctgtatgtgtgacttcctagtggcttgcactcagtagacagtagagcttgggaagtatatttggaatataaaagatatccattaatacatgtgtgtacaaacttcctgaaacatacctaagaaatggatgtctgtctgagtagtgagagaaggagatgggtgggagaaggagagaactacctttcatttcattccattctagtctgtcaatgtgtgccatgtgcttatatttcataattaacagattttttacaagtagttcttattataacatcagagatgaaaagatcacagcaaaacagagcacacagctgtgtaactctccttccaagtctggagcatttaacatatttaaaggtgtacaaagaacagaatgtgtaggagcaggcactggaaagtaggaaacattaggtgccaggagtggggcgggcctggcaaccatttggagataggtaactgaagccaagagaatgattcacctgagcaaaaaaaggatcgaaatccttctatctccttggccccatccagcttccattaaccccctaatgtcctactgacctctgggtccctttaggttccagttgcacatatggctttacaattttatagaataacacacttgtcacagcccagtcctagcaacatcttaaaatagaaaatgaaagagcccgaatgcccaaaagaagtaaacaaattaaccttgccagcaaaagaatcaggaagctatattttgtgaatgacagagaaacacagatgagtatagaactgaaggtaattctcttagaggaaaagttcatctacatgttgaaaggaaattatatttgagactggtatactcacacatgtttatcggagaattctgacaccatgataaacaaacttgtatctgatactgcatatatttacaagacagaagagagcagggggcagcactggaatcctggaaggagaataggaaaggatagggcagacgggctgcatgcacaatgctgggagtacctcacttctaggacctagctctgcctttgaacattcaggagcttgatttatcaatacatactgattaggttctgggaatcacataactatgctcagaagtgtgcatacaattcatcacccaaacctggacctattttttcttactgggatttttaagaggggatgccattaatatttaaatcaggacaacaaacttaatctaagactgacccaagtgaatagggacatatggacactccactaataagagaattgaggacttgagatggcaatttctaaactgacaatgaatgtacacattttccataactgcaaagtccaggttacttgtctgcatgatccacagggcacatagacaacgtcatcactatcagaaggttggattcggagaaagacattagatcatcatgtacatgacataattcagtttgtaacacagcaaaataatgcatcctgttctgttctagagttcacctttacagggactgagcaccatataagccatccgtatcctgtttatattgatacggcacaatttccaggtgtatcttagttaccagttgataaagtaaagacaaagaatgggaagcccttactgggaagggagagctgagatgtaagcttttcctcttagccaagaaagaatcatgttggtctgacctagctgcctttcataaaaaatatgtttgaacagctgccagctgagacaagtcacgagcccagatgaccaaccatccctgtcttcccggaactgaggtatttcccagggcttgagattttcagtgtgaaaaccagaaaagtcccaggaaaactagaacaagttggtcaacctacttttaagtgtagtgcctgtagttcttttagaaattcagtcacaattttggaaattagctatttttatactggttgtatttctgcagctatccccctctccctcctcaggtattttgcaaacaccttttttgaaaacgtccttttcaaatatacgtttgaatatattcatgcaatatatatgtattgcccatctgtaattgcccatgttaggcccaggggtacaataatgggcagaataaatactgtgccctcttggagtaatagatttgaatagggatagaagtttcttctgtcttgaattattatgcattagacaaatctgtagagagaaattttcacactttggggtgggggggtggagctggtcatatggcaaagttcagaaaagaagcccagagggggactgtagcagtgaagggaagaggtaagcttatacagccacgactcctaactcactagtctgaatggaaactgtaggcagagttatgttttcttaagatgagaaaacacgttcctcacattattgtttcacaggctctttcactgtctcattctctgcccaccattccaatggaagggtctcatcctggagcctcctaatcccctaggatagaacccttggaggcatctctaattttccttctatctcatgccacattcaattcatcgtcaacttttattgataattaattttattgataattaattgtataattaccagttcttatccacttttagacgacacagtttggagtgcctgttgagcccacactcctattagaagtgcctgctctcatccacaggaatgagccgcaagtagccatgtctgtaaggtgacactggtgtcctggcccaacttataaaccaggcttcagtatctgatctgggacaatcagagacaatcagggtatccccctggaatacagatttgggatttagatgccactctccatctgggctctttgcttgaatggagtgatgcaaacttgagggttgaggttggcattgtggtgtggtcacatggtgccacatgcacgctaatcagcaaaagcatccatagagagggagtcacagggatgaggagaagcagcaataagggaccaaaggaagagagagatcactttcttatatctcaaagacccttcctggtaacagtacctcctgagacctatatttaatttctgcctttgatttccataagcgctctcaatgaccttccagtacattctaatttctttcccaactttaaataatctgaagtgagtttttgttatttgccatcaaaatatccttaactaacgcattatgtctcagtctctgtcccaacaaagtttcttagtttctctcctaagatgatgtgaagattgtgtataaaactcagcacattgtctggtgcatagtaaaacctcaatcactgttaactgttctttttactattcaacaagcatttatgcagtctttgcacactgtgctaaatatgtaagacagtagctttgctttccaaattgcttattgaatctgagatgtgcaaaatcataatggaggatggtaccatggggaagtaaagagggaaattcacatagtggcagctactagctgagtagatggaggtgagacaagggaattgtctatttagatggtgatcgctcctgaaaggtcacactttctagtcttcttactgctgaccacagtaaatctatcactcagcactcatctctttcaatcagagctagacaataaatatggggatgagggggtgcagaaattcatttcaccttggcatttcagtgccttaactataagcagaaactcaaatgatgcctatgaagtaaattgttaaaagagttaaactcttttcatgttagcagtcctgacacatttttaagtcggtttcatcataattgattagattcgcttgagttcttcatcaaggtacgttattatgcatgtttactttcaaagccttctactgctgggaagccatgatgcaagtaataagaacaaatattaatattcctttgagtaaacaaacactaagcatcttttgacatagcctcttccattattaaaattggagacaatgcctgaaaatgagaatggatttatctagatgtcaacagctgaagggaagaattatcaagcacttaaatgatcccaaacaagctgaaacatatgtcttaaggcagtaaatgaaacacatttgagttacaaggcccagtgaatgccacaaatctggggaaatgctgcaagatgctcctaattagggacactactaggtagacaaatgatgctgctgcttcctagtattcatgctgctgggataatcatgttatgtgccttaactgagcaaggtttcctccatagaaaatcttaagtggttagtctttaggcacacatctaccaccccttaaccagctacgctacctgcaatttatttatttatacgcagcttatttctctacaaaagcaggggtttaggcaggtttatcttcttcaaagaggaatgttaaacggttgaattacaaatcaagagtattgcacaaattattgattatttaaagcatttacttcaaagggtgattattattacagctataggtctccaggcaatggagtttacactcctagattctgctccccgctcccctcccactgggatgtggcttttcctcccatccctccacagaaactgttctttctaatgatctcctgaagagaaatcctaattgtgtgcttttcagtctctaatcctactcaacctctctgcagcatttgacactccctggttgctggggtcccttcttccttttcttctctttcccagttgttcatttactaatcaaaggtccatccacaatacaaattgtgagtatcattgacatttctcttttgctccctcttttcactagtttctatctcccagcgtttgctggctctttaatcctttcagaactaccttctcctacactttactacctcccaatctctgatcaaaatgctggatctctgcactgagctattcgctattgatccagagaagaacttctgattaattttttttttgagacggaattttgctcttgttgcccaggctggagtgcaatggtgcaatctcggctcaccgcaacctctgactcccgggttcaagtgattctcctgcctcagcctcccaagtacctgggattacaggtgcccaacaccatgaatggctaatttttgtatttttagtaggaatggggtttcaccatgttggccaggctggtcttgaactcctgacttcaagtgatccacccacctcgacttcccaaagtgctgggattacaggtacccaccaccatgcatggctaatttttgtatttttagtaggaatggggtttcaccatgttggccaggctggtcttgaactcctgacctcaagtgatccacccacctcgacttcccaaagtgctgggattacaggtgtgagccaccgcacccggccaccttctgattaaattctgtcatgcattcattttaaagtatgtcctcttaggatctgtggattaaaagagtaataagacctcaagaagtttccactctaatggacatggacaacagagatataatcagtgactataattcagtatgataaatgctaggtgctaggatagagcaatgtacagggccatacaggtcaaggaggcataacgctctcatctacatttgtatttttaagaataacagtttacaacttaaaggaaggaatctcaaacatccctgaaatgatacctttggaaacagtgccaatatactatttaataaaagcaaatctgagttctgagtgtgtatcacacaccaggaactaggttaagtgttttatacataataactcttttaactttacagtagctctatgaaggatatatgtaataacctttattatatgaaaacactgagtctcagagaactagcaagtgttatctctagttttaaatccagatacattaaagtcattcttgtttcctactttgttcacctttacatccaatcaattgccaagctctgctgactctttctaaatatcactcaaaaccatctccatctttccatcacccctgccaacatctggatcaaggccatcatcatttttctgggggcgtattgctgtattctctcagtctcccgacagcagccaatccagaatgaggcccccaagtagagaaacacagttactgtactatcttatttaaaatcattccgcatcctatgataaaagcccaacatgttaacagagcctatagagctctccatcctcttgcttgactgacacccacacctcatctctcttgctgtctcatccccaggcctgacctggctggggcactactagtagatgccaacagcactctctgacctctgggtgttcacacgtcatgtgacccctgccgggaacattcagccctgtccctcatctggctaattcttaatcatcctttgggtcttcagtaagcaacatttctacaagaaggtattctctaggttcgttctgtcagctagatgtgttcttagatttctttgctacttgcatcatgataattttcatcctattttattattatttgtttaattgcccatcttcctaatgaaacataagtaatctgagggcaggactaggtctgcagcactcagagaagactctagttctttgggtagagcattaataaacacgtagggaatgaaccaacaaatagagcagacccatcagtctgactcctgagtccttgctcttaagcatgatgctatacttcctccttggctgagctccagccagcaaggaggctgatgttcttggttagaaaagcatctaaccaagatgcaacatgtccatacaggcaacatgtccttggtttaaaaagcatcaccacttcatttttaagttggatgagaaaaatttagatttgtggttcaaaagaagtatgctaaggataaaaatcaactggtataccatatcaagaaaaccagactggtaaggaaagatttaaataagtagtttatttttaaaataaaggtatttaagtcaatacatctgaattgtattgctccaagatttttgaatccatggagtcttagaactaaaagttctttaataacagctggctcattgctccatattttacaggtgagtatgcagggaccagcaaaatacatgattggctcacattcaccaaccaataacaatggagcaggctgaaagtatggatagttttgagcagagttgagagaaaaatactgatgatagctctatgaagagaaactgaaggaaactaagatcgagggctatacttttgtgcttcagaattcaaggcaaatataccctcctataaaatactaggtaataccacagtcaacggaataaagattagctgaaatggaacattgtcatgataatattccttagggtcagtgacccacgatctgcataatagagtaacacttactttagaattgcaggtgctgttattcagcacaaaagacatgcattaaatatatttagtgattctaaaagatgatatataaattcaaggtattaatagcattattttcatcgatttattggtttcatattttctgaatgttcttaactcaggataattatgagttttaactaagtacaattgtagtcaacatctttgcataatagatattcagatacacttatctaaaataaaactagaatattatgtattccagttcaattaaatataacaattttttgaacattcaataagtgccaagaattgtcaaaatgcttgggatactagaataattaagatgtggcttctgtttcaagatttaagtctagcagggaccaagacttgtcaatatagttttcagtatgataagtaaaagacatacattctccaaaagattataccgaaagtaaaacaaattgctgttaaaattctcacctcagagcaactattctattctatgaatacaccatctttttcttaaaatattttgtttcgtataacaacccccatgcgaaaactatcagtaaaaatagcaaattgtttttaatacccactattcaatgtattggtggaaaagggagagatagaaacctaccttggaaagatcaaaagaaatgggcagaccagtgctgagtcaagactttatacactcttgtcaaggtcaaggatgacagcttcagtcaactttgccattgtttctaaatttgtctactggtttttaagaagttgaacccttggatctggatttggcaccccaaatgtctctgaggcaagggtatgagatgtcagaaaacgatcccatttctataaccaaaatccgcagactaatttaactcattcctcaaatgcttgctacataataggattagacaatattaaaagagaagcagcaacaccgtctctggtggcatcaattttggagtcttgggctctagtgctatctctccagtgatttggagcaattaagttaagggtctcaacattttccatatctccaagaaaatagttaatcatagatatctactatttatttaggctattctgagaatactaagaaagaatatttattaagggtggattatattccaagtgattgttccaatcaatttgcatatgtgagttaatataatcctcataacaaccttgtaagatagggtttattattcccattttacagatgtggaaacaaaggcagaggtgataagctagtcattttgggagaaaagatttgagcctagatgttgagcttcaaaatatattcttgtaataattataatatataatttttatctcatacatctcatttggttctttaatttcttcccccctcccaaaagtgtaatttttaaaagtgtcttgtctatccaaggaaatgtatttctatttgcctctttcaacattgagaaaattttcttttactgagtgtctaggtgaagcaaacagctaattgattgctacaaaaggggagattagccagtcgacccttgactttgaattactttcttaggacttataagctttttacaaaacctgaaaatgtctttctggagcaaaggactttctgaacttttttaaaatgacttttgggaaatgatgttaaaaaaaaaaaaggaaactctttgagttataggaaatagttcatgcgatcagttctcactactcatgggtcagttctgcataactatttcccagaccaatttattaaccatttcccactgagcaataaaagaatagagagacacctctcctgaagcctattacaacagcattgagggcagaagtaaactaataagaaatgctgaagcaagtactgtataattatacccaatcaatttttaccaaaatgaatcaatatggcagtctaattgagatgatctttgttgcttcatacaggaatgagatttaattagaatctccagtgattgtaaatgggtaaactgaagtcaccagtaacctcacagaaatcccaggcaatatgagatgaagcaatagatacagcgccctggctggctttttgttcacaggaaatggacattaaagtgccctacttggcctttgggagactgcaaaccattttcaggtgtgcttggggcctgagtaaaagggtgtggtattgtgtccagacatttgtaaaagattcagttcagataaagcagacaaaacagtttaacttgcatttcaaggagctctgaggattcaagatgttcagttgtggaagaaactaacaagaccggttttaagaggggtttagtttgaaataaatgagagacagctgttaatagtaataagcctgtttccatttttgaaaggttgggagggacatgcaccaatagactcggagggcaggtggtggggagcaataggagatgtatgtggtgaagatggtggaaagacagagggggactgtggttctatcaacaacaacaaaaaaatcccaagaaagggcatgaggcatgatcagggagattctgatgtggcttagtgggtatttggtagttgacaaatctaaagggtagataggtgtggtgaccctggagattcaaatttttcctagggcattattataaccccagaaatgtgaggcagtgttacttcttctctgggttgaacagagaataaggatcaaaacaagggtcttaatgtaaagtaagtggtgtattttaaaacaatcaagtgagaataagctctgtcaatagttgctgtattcaaatgattgaattccatagaatctatggataattgacttgacgacaaaattaaagtaactatgcccaccatagaagcccctttgaagatttcttgcatgttgacaaccacaagttgttctgcttcacatgtagttgatctagtagtgtaattcacagaaccaaaattcaaacctgaaatcttactaattgattaataattgctaaagaggaaatgttttatagcgtttactatacagatgctacagaactatttgagggcgaaataattcatacgatggtgttttgagacacaatttaaaacatccgttattccttcctgttcctaatctcaatagaagggttgatatcataaaagatgttagaatgtattaggtgatacagggaggaaaagagggcatcttccacgcagatttgctacagatttacaaaggaaagaaaaaatcctctcacttccaaggcccccatcttcttcctttaccaattttgttggtgtgatttgagaacaagaacatttgcgaaaggacttgatgtgtggatataaagtgatagtttcatacttgttacaatgtaagatcatatgcttctgagaaggagaattcattattaaagatgtttgtgatatttaaataagaatgaattataaaacagtatttacagtatatttaagattatatgcataataaaagttccaaattggctatctctggatggtgggattatggattcttttaaaaattattttgcaactctaaattttctactcttctctttctataatgaaaatatcattttgtgcaataaagattatcttaaaataaaataaggtgatggtcagtatttctgggtataaattagggtcagaattagatatatatcatactgaaacattacagtataccctgtaaatatatgcaattattatttgtcgaataaaaataaaattgaacttccaaaaacattaaagaattatgtaaatgtttttgtatacatacatatataatacactcctgtacatatataaataacatataattaattttacatatcaagaagttaaacatgtgataaagcttggggtttttttgcttgcctttgtcctcttgctacagcccatattagatcttggattctcttacccttctactcacattatccttcttgcttttattcaccccacacataatccagattaacaatttaggatgtattcttcaatatttttctccgtgcttatgtgttcaggtaaacaaatatacagacatatcacatattgttgtaggtcatttaacaaaataagatcaattatatacaggcctctatgtcctaattcttctcactcaataatacctcattgaaaatctgccaaatcaactgctacaactcaaatgcattattttaatgattctatgatatttcacatcataccatatgtatcataatttattcaacaattcccctattgacatttccagaggttttttgccgttataaaaaaatgtaatcagcatccttgtacgtgtgtcattactcatgattttatttatttgagaaagtgtcctaggagtgggaatgttaagtcaaagaaaatacacatttaaaattctaatagatattgccagattgttttccaaaaaggcagtaacaattaacaatttcaccagtcatatatgaaagtactttttcctgcattactgacagtaataggccttttcattctttataactttttgacaatccaataggtataatgtaatatttcattgttagtttaatttcatttctctgttaaagaatttgaacatcttttcgaatactcatttggattagttcttgtctgaattgtttgttctgtctactttttatttcgtttatcttgtctacttttctatgggggtatttacttgttcttttcaatttgcaattgttctttgtacattttgtgtgctaatcctatgtcttttattattaatttaatttaccaaatctattatttttcttttgaattcacttatggtaacttttgtcatattttttacagttaaatatgcctatcttttctttttataacttaacattttttttggtccagctttggaggattataaacagttatatttagtcagtatttcttggtagtcctggtattagttgccaagggtaacaaaaacaataacaaaattgccctttgcaagtagcgtagttagaaacagaaaaacctcaaaataacaatgacttaaatacggcagaagtttatttctctcatgaagtctggaaggagttaatccagggctcctatgtataccccagtgtgagggatcaggtttcttctgtcttgatctactgttcatggctttcattccccaggtcaaggcatgattcaatattctgctagagacccagccattttgttcatttacacttgggaagaaacaagaagaagaaaagaagagccatgtcctttaaagattcttcccagaaattgtctgcccttttccattcacatcacattatcaagaacttaattacatagttacacctagttgcaaaggatgcttatgttttcctggccactactatagaaagtctattacattgtcctaatttcagctaaagattgggggttccaatctttagaagatggggaaaatggatattggtcactgcaattacttcaaaatagtaattagctgacatattttaaaactaacgatttggggtaaaatgattttgtgaagatgttatactactctaaataaaacagatagataaataatgatgaataaatgaatgaactcacttttaatatttttctagagctcctttatttattttaacctctcttttccaacacaatcactctccagtaataatcttctgtagctacatgggtacagatgttttagcagataatgcctacttatttggaaattttctgtcagccagaatgacccagcacattgcattgctcagtttcattaattgtttatctcacacatctgatgcttttagcaatctagaaacttccctcgtgaacctggtaaaatgataaatgaaagaatcaattgggccaaaaacactttccagctagaaggattaatgctactgggtgttttttaacgagtggctgtattcaaatgagtaacttctgtttagatactctcatgtctaccctatttttaataagattacacattgaaaaaaatgtaatacattttaacagataatgatggcggcaaagcagatgccatgacttataatgtgggttgttatctatctgctgtttggacccgagcaataaatttcaaaatatatttcactgatgtctgctatatattaaaaataatgcagactatttgagcaaatcagatctctaattttgaaataaatcatctgtattattaaacaaatggtctggaattagaattaagggcatatagtaggcaaacaaacatctttgattttattctttgatcatgtctagtagtgatatggaaaaaaaagaaaagggaagaaatatcctgttctgagctgctcatctataattccaatatctgtgaaaactcccaggtctgtcattcagaaggacgacttcttccctcatgattgaaactgaactcaaatgtgccaaatgggccaataaagctagactcttatacagtgatgcttcgataaacaaactcaccatgcagcactttattaatcaattcatgccaccaacaagtacattaaaatgacaacttatgcaaattagagctacctaattttccagctgtgaggcatatatttgcacatagagcttctattagtcttcactaaactgaagaagataaagttgtcaactctgaaatttattttccctgttcccagtttccctgttcgcttcctttttctatttctgttctctcacttgtgaggataatgctctctgatctattcacaggtttccagtcagttcagctcatgatctgtttattgagcctgacacagaatgagcactggtgaataaggaaggtacctgccctcagggagcttgtgctctagagcagaagtcagacctgtgttaagacccctgatagttacttgaaacaagccaataataattgcattcagatgttttccagggattttcattttaaaaagtataaattagaatagattttaaaatatccatccattaacacttactacttgccatcactcacatgttttctccagtggaagggtctggctgacactttctcataaactgcagcccatctgatcgatgttgcaagccttattaagccttgactttaatgaacatgagtcttgcatgtggctgaggaaaagggtgaggactggtgttttggttgacttatttccatcaaaaagaattgaaaaacagatcaaacgcagtgagttaaaatttatttacatttatctgtagctaatccactttgaagagctctcacctatgttcttacatttcaatattcttacttctagttgtagagctcaaaaagttttctgctttcagttgttcttaaaatttagtgtgcatcagaattatttagagggtttgttaaaacgcagattgccatgtgtcactcccagagtttctgattcagtagatcttggatggggcctgagaagttgcatttgaacaagctccctgttgatgctacttgtctgggggatctcactttgagaactactgtgctagactagaggaattttccaccacagtaagcaagcaggaggattctgtttagccaccagggattagtgaattctcatcagatctgcctacccagccagccctacaaaacagcctcaattaacctttctctggtgacccagacagacactggcattccacagcccttctccatagtccaggagaggcaaatcttgctcctcccatgcacttttcaggtctgcctaaaaacatccttcaccacctctcattgtaaaggactctcagctatagacagttacatgttttatgagacaatttatgttattctaatagagtttaattatttttttaaaaaaatcatctcctatcttacccctaagaagttatttgcaatgcatttccataactcctattttgtgttgaccatgtctctgaatttctcagtatctacactagtcagatcaattttaggtttgaaaaatatgtcaccatagaaaaaatcttatggcttatcaaggagcttagaggttaagagtgggctctgaagtcaggctgcctgagtgtgaatcataactctgttcttgtctaactaggtgatgctgagcaattctttattctctctgggctatagttttctcatctataatatgccttcatcttaatctgttttgtgctgctatagcaaaaccccagactgaataatttataaaaacagaaatttatttcttacagttttggaaactgggaagttcaaggttgaggagtctgtatctggtgagggacttcttgcataattatcccttggtaggggactgagaaaaaggtggatggggaactcaactttttgtaagaacccacttccttataacagtattaatccgttaatgagggtgaagccctcatgacctaatcgcctcttaatactgtaacaatggcaattaaatttcaacatgagttttgaaggggatgcatattcaaaccataccagtctacctcataaggttttcattttaaatacaataatatctgtaaaatattcaaaaaagcacccagaacaggttatttaataaatagaaaaaaataattattgcaaaattactgtgattatattgggggcatatataagtagaatttgattcagtttcttaataataaagaatggccatatcattggaagactaataggcagcataaggtatgatggatttctttgaatcttaaacttcttgcaatagtcttcttggtaaaacagttgagattacagacacactaaaatctggatgatggttgggtttttctgcactctgccatgggttttaaatagtttgataaggaattttgtctttaaaagccatgacctaatttaggtgtatgaacatgtatctcaattcaatccaaaagcagtaaactcccactgagtgtgcagaaagatgatctaagttcttgtgtttacacagaactctatgtgctgggtactattattgtcttctatttgtagataaggaattgaggcttggaaaagagagacgactacacaaggtcacagtgctaattaatactcagcagaaccagtactccaactcatacagtctgacactatagaccatgctcttaactattctgactttttgccttggggttggtcccagagaaaactactctcagtaaataattagaattcaggcaactctggtatcagcaaaaatagagaaggtgacacgtcatactccatcccactaagtacagagaggaaattcagtggaaaatttcagcaccatgacccttggtgtctgagaaaagggaagtgagaagttgtgtgttggggactggacacaagagcacacagaatgaaatcacatgaagtgttttaccatctggatttttaaaaagcagaccggctacatttatgtcatataatgatcactcagaaattacatcatagcctatttttatactatcatgtagtaattggtgtgctgctgattaagaccatcaagaataaaattctaggctgctactgtcaggctattcagcattctgttagacaaattaaaacatatgttgggagtccactcaccatgatctttttggtaagatgaggtaaatacaattaaaatgatcatatgaagtagaaatgacctaaattgaggatccgatgagagaatgatagccaggaaggcaacattatgttgacagcatgggaaatctgtgaataaagaggtggaaacatacaagatatatttagtcattgtgcttgggacagggaaataatttcaaaattcagactgagagcacattgtggaaggctttggctatctcgctaaggagtttagattttattctatatttcaaaacattcttttaaggcaaaacacattttttcaaacaatctccaacataggtctcttgactgagacattttcttccaacaaggtggggaaacagggaaaagatttagccccctacctaaaacaacttaagaaaaaagcacagaacatatgatacaatgggtttaaataattgattaataaacacaaaggacactgatccctgaaagaggggagcaaacaaggtgagctccatgactgcctcagcttgaagagtttccaagacataacacagggagttttcagaccatgaccagcaacctctttgagttaaggagatgaagctagcagtctgtagtggctgagatggctagagtttatagagcagagtactggataggagagagctgctcagagagagctctggggaactgcagaggatccttatcaagtcatcagtagtgtagtgatctgtgcatgtgtatgaggaaaggaccacccaaataaattagaagaaaagtccttggagccctttagaaatagtttttgttcctgcaagccagagtggaaaacttcatacttcatggggaatcaggaagtgtattcacaagggtttcatgtcaatagtggagattagccgtaaactaaacactgctcttgtcctttctagcaaaacttaaaaatccaaatggaaagaatcagtttctaagtaacttaactgcaactcaaaacaaagctcaaagatatctataggaatacaaatatatctaccacctaacaagctagaattcacaatgtctggcatctaattaaaaattaccaggcagaaaaggctatacactgtttgacaattgtatgacattcttgaaaaggcaaaacatggagacagtgaaaatatcagtgatttccagggagttgtgaagagggagagataaataggtggagcataggggattttttagggcagtgaaacttttctgagtgacactatagtggtgaatatatttgtccagacccataggatgtacaataccaagagtgaaccctaatgtgaattatggactttgagtaataataatgtgtcaacgtaggttcatcaattataagatgtgtactctggtggggatgttgataatgggtgaggctatgcatgtgtagggacaggggatatatggaaaatctctgtattttcctctcaattttgctgtgaacctaaaactgctctaaaaatacttaaaaattaccacacattcaaagaagcagaaaaatacagcttaaatgagaagaaaagtccaatcaaaatggacctagaaatgatatagatgatggaatgagtagataaaaacattacaatagttattataactgtatttaatatattcaagaaaccataggaaatattgaatacaataagtagagcatggaatagctgttctggttcaagaagtgttgacttcaagatgagcgctatcatggggttcagtgaagcacaatttgagaattattgctgtaagttattggaaactattgaaggcttttcagcaaaatttggcttaaaactagtggtattttacaaagactgaatgggtagcaggatgcaggacagaactcatgaatgagggagaatgagaccaaagatttcaggcaggtggtaaccataatacaacagagaaatgagaaacctaaaaccagtgggaatacaaagaaagatattattatttttaaaattaatgtgtatgataacatgacagatcccagagaagccggtgggaccccagggagagttctctttcctttgagaagggcagggtgtgcttgaatggcttcattccaagagagtggcctgtgcgttgtaaagtgtcatggttcctgcagcatctggtgagttctcacgggcacttgaaactctgggggagagggtgtaaatcgcctgctgggccatacccatatttgcagcaggtctccaaggtcaatggcctctgatatgctggaataacataggtaagagagaatatttctaaaatattataaaagtaaaggcagatcacgaggtcaggagatacagaccatcctagctaacatggtgaaaccctgtctctactaaaaaatacaaaaaaattagccaggcctggtgggcacccatagtcccagctacttgggaggctgaggcagaagaatggtgtgaacccgggaggcagagcttgcagtgagacgagatcgcaccactgcactccagcctgggcgacagagcgagaccccatctctaaataaataaataaataaataaataaatacataaataaaataaaaataaatactttattactaagaacacctattagcaacaggtcttgccatttgaaaaattaaaacttgacacttagagaggttacgtaattatcccaagggcacaatattacagtagaaactgaaagaggtaaaaactgaaaaacaactgtcagatttgtaggagaggtccactctcatcttagaataagtaatttttagggaagcactggaagggagggaagcatggggagaaagtagttgagcttttctcaagaaagagaaaaaagagagatcaaaattaaaatagaacattttccctatataaagatcctaaatgttgtcatctgtgacagttaaatttttgtcttgacttgagtgggccacaggatgctcaaatatttggtcaaacattattctcggtgtgtctgtgagggtgtttctggacgagattaacattcaaattggtaaactgagcaaagcagattggtctcactaatatgggtagaccttatccaatcaaaaaatctgaataggacaaaaaggctgacctcctgagaataagaaggaactcctcctgtttgactccttagagctgggacatcagtcttttctggtctttggactctgactaaaacattgtctcttcttgagtctctattcttccagctttcaaactggaacttacactgtcagatctactggttctcacactgaaactacacattggctctcttgtatttccatcttgctgactgaagatattgggacttctcagccttcataatcatgtaagccaatttcttatgagaaatctctcactcttgctctctctgtacacacatacaacacaccctattggttctgtttctctgcagaaccttgactaatatgtcatcttagaaggactttcctactattgatttaggaagtactgtagttctttaagatacgatcaagggtatggaacccttgttgtttaagagaaggcagtaaaattaaaggtcagaggtgtaccagggaataacatcaaggccatgcctatctggatgatgaactcatcaagaataagtatactgccaaaccaatgtattggctactgagcgtgtagttccactttaccaatgtttcaacaactggtaactaatgtattcagggttgaaacatgatgacagtgattatgatgatagaattaaataaggttttctatgggccagggtccttatttatgagataaatttgttgttcctagtctcaaattacgtcttttgtgactgtactttcatttgattcagatatatttttaaaaacaataaaagctttttttttttttttttttcatgagtattgagcaggaggttaggcaaaatgggcgagaccaagtttgctctgaagagcaacctgtccttgagaaggtcccaacagaatgcagtagaaagaagttcaggcagaagtgcatgccagaatttcagggaggtctggcacaaaggcggggcaataaaaacactaaattaatgcccagaagacctgatctcccctaattatcaattatttactagctctaggatcctgggcagtttacttaatccttctgagtcttagattttctgtaattaaattattgaattaaattaaaatgtgaccaccatgctcacctgataatttttgatgatcaaataagagaatgtataaaaagattaaggtggtttgttaaaggtaaagtcctatacaaatattggttatgatgatcaaccagggagagatacactggaatctccaatgggcaagcaaaaggtttcaaagtatagggtaaggtgccagactgtgaggagggagttgggactatatttcgtgaaagacttggggactgcataagaccttaatcatggaggaattggggttctgtaaaggaaaccagaatacatgtcataggtcaggaatccatttattaggacttggttttaatttaggatttgattaaaagacgaaagcctaggtaatggaatctggacatacaactacaactggctagtcagcaagttcaacaaggtgaaactgctaccctgccttcccctgcagggggtttaaatacctccagataaaagctaggactgacctgagaatattgagtgaggctgaatctatagatgaagggaaacaatgtataaccaagtagatctttaccataagcattttttaaaaaatactcttaaaacgattgacttatacatttgaagagcttttttgaaagattcctgctttccattcatgggtcactaccaggcatttcttgtcattaatctaaggagtcctgtgaaatacatgagccttctccagctgctgcacaaatgattgcactgctcagaaacagaattctaatgagatgcctaggttttatagaaagctgaatgatagtaatcactaaggctcacatcagaaaactccaattgcatattataataaaacccaatgtcagccatattatttatcttgaaaatagaaaattagaccagcctatttgatagtatattttcttctaatatttttatccctagaaggatgtctcacgaatgctctatcaaaccaatgacatttaaagctaaattaaaactatttggtctttcataagtcgaaaaagtgaagtattcaattatcattcagccagaaactggtttaattttgtctcaactttttatcataaagtaatatggtaaaaatagtctcataattgtcttctttacaagttgtttctgaagcttaagaaaaatgatacaagaaatcattaggtcagattcagtggtttatgcctgtaatctcagcactttcggagatcaaggcaggaggagcacttgaggccaggagttcaagaccagtctgggtaacatagtgggatcacatctctaaaaaaaaaaaaaaaattttttttttttagattagctgggcgtggtgggatgcacctgtagtcccagctacttgcaaggctgaggcaggaggatcacttgagcccaggaggttgaggctgcagtgagccatgatcaaaccattgcactctagccagggtgagagtgaaacattgtctcttaaaaaaatcattaaaccaagatgaaaataaaacttcactgtttctttctgagaaggtaacttttgatgatgtgcttggtatttcagttcttctgtattcccacctggtggaaatttaacataacacacagctcctcacaacatccaacaccaactggggtctattatctcaaaataggtgtggaagacaatgcagcattggtattgtaggacagcaaatttcaaaacatggttcccagatcagtgccattaacattgcctgggaacttgttagaaatgcaaattcttgagctgtcccagacctactaaattagaaactctgagtatgggtgtcttagttccatctgggctgctatagtaaaataccatgaactgggtggctcacaaacagcagaaatttatttctcacagctttggatgctgagaagtcaaagatcaaggcatcagcagatttggtgtctgatgagggctttctttctgctgcatagatggcattttctcactgtgtcctcatgtggtgggggggcataggtctctcttgagcctcttttgtaagggcactaatcccatttatgagggctccactctcatgacctagttacctcccaaaggccccacatccaaatatcatcatattgggagttaggattcaacatatgaatcttatgggaatgcaaacattcagtctatagcagtgtgtctggtgggtcccagtaatctgtagtttaacaagacctccaagattttaatatacacccaaatttgagaaccactaaggagattctaacaatgtgagagcctagtaaaagctatagagtgttttttggggggttttgtacactaaggtaagtgtattaagaaataatattaactgtttcgacttattatttgatcttcttatagttaataaaacaggccaccccccaaaagacaaaacaaacaaaaaccacacacacatccaactctggcatgagtattcgctaaacaagatgtcccctaacttgcaactcagaatagttggtaagggttatttatatgcatattgacattctctttgttgtttttgttgctgaacaaattgcattagaaaaacagttgcatgtttaggcagggcgaggtggctcatgtctgtaatcccagcactttgggaggccgaggtgggcggatcttctgaggtcagaagttcgagaccaacctggccaacatggaaaaaccccatttctaaaaatgcaaaaactagccgggggtggtggcacatgcctgtcatcccagctatttgtgaggctgaggcagaagaatcacttgaacctgggaggcggaggttgcagccagccaagattgtgctactgaactccatcctaggtgacagagtgagactttacctcaaaaaaacaaaacaaaacaaaacaaaacaattgcatgtttaagacagaaaggaggaggaaaagggggttgatgacatttgtatctattttcttttattagaaaaacagttgttcaagaacatcactccactcagcagatttctacagctcattggccaaaaccatgtcttgggacaatgcctagcatcaagggatgttggaaaagcaaatgcagaatcttatttctcacactgtaaagtttatagttctttaagaaagaactcatacaggtaaggaggggagaaaggtgctaacattgataatgggtcaatctatagaattacaaataggggatgccactcagggttctaccaagggggaatggcccaggtggccataatgaaagtaagtatacaagcagcatctttgagcttcagtgacaaaagagtaagtggggtatgtcaaatagaatctaagcccccaagtttccaataaggggccttcccatacaccttcaaagaactatattagaatgtacacttacgggatacctcagcatttatcacttgcccctcctggaagtaataacttattggcctggcaaaacttgggagactctcctatcaaagaacacagcatcctggtgacaaggttactgtttgaaaacagatagtgcagatctctcttttgaagctatttctaagtgaaacatattctccttcctcagctacttctcccacgtggcaaatacactggatagttctcttcagagtaggaatgtatttagtgctctctccctgcaattggatggggaaattcaaattgagtcaggagagaggcaggcttgccaatttgagaaatccaccctttctattataaagctaaatctatattttgactacttttgtttttaattgattataacttacagagatgggagcaggtatgatcattcctctaaatctctaacaaagaaagagtaaagtcatagggaggcctgtacaaccaaaacagccacacactctcctgagaggacacacagtcccatatatcacctcattcatgggtgatgtctattcctctttaggctcaatcattctacccctcagaaatcttgtgttatggtctaaatatgtccccaaaaattcatatgctgaaatttaattgccaatgtattaataatagtattaagagggagggccttcagggtgatgattaagacatgagagcaaagtcctcacaaatgggatacatgaaatattttacccatataaaagaggctagagggaactagctagatcttttgcccttccactttctgccacgtgaggacacagcaacaaggcagcatcttagaagagagcagccctcatcagacactgaacctgttggcactttgatcatggacttcccagattccagaacatagtttacaaattacctcgtctgttttgctgtagtagcacacgtggactaagatattctgtaacctaaatactgggctacaaagttaaccactattaatatagcttaccttagacagcagataaatgggagacggggaaaaacaaagaaaaataattaaaatgggaagaaaataatacatagcccacttcaaggttgggataaaatatgcataattactacagtcttgtttctcaaagtgggcatgtgatcatcgctgatatttctgtctccttgcactattcattctgtccctttccccttggcaaacacttcagttggtcagtttgttccttgtgggatgatccaaactgtcatttctgaaaggcctgggtccattagcagttaatgtggttttccactgatttttatcccagatctaggaatactaagaggtgctccagatgttctcctgtgtttcgggcattcttcttactgcttccgttgtgtattgtgtgggatcattcatcctagctagttgacaaactcctcctttcctgatggcttaatatcagaagctccaagttgttagatgccagactgagcttccagtttaaggaaatctttattgtatctcttggcaaaagaatttcctacttgggtaaccggaaactctaatccagcagaacctaacgtcaagaacaggaagctgaaatcctgcctgatcaatgagactagaggagctcatcctccttgcagataaagcatttgataaatattttaaattctttcaaactaagaagtaaacctctttaatttcataaggcatttctaggaaaaacttgcatcaattatacttaattgtgaaatgttaacagcatacacttcaagattgggaagaagataaaaaatgtctattcaaagcaaaattttattgcaggtcctagctgctgtaatgaagtgacagagagaaatgaaagtcatagaaatttgaaataaagaaataaaactatcactgttttgtggacaatgagatgtgtatataaaagttccctttaatttcataatttatgagattgagtttatcaagttggctggttgaggtgtcttagtctgttttgtgttgctataacagaataccagggactgggtaatttataaagaaaagacatttcttacagttctagagactaggaaatccaaggtcaaggaaaccacatcccgtgagggtcttcttgctgcacatcaccccatggcagagagtggaagggcaatggaaggtgagagaaagaaggcaagagggaactgttctcacttttgttaacaagcccactcttgcaatacttgcaagcccactttcttggtaacactaatccattcatgaaggcagagcccttatgtcctagttactttttattaggccccacctcccaacactgttgcattgtgtagtaagtttcctacacatgaactttggggaaacattcaaaccataacacaaagttaatatacaaaagtcaactgtgtttcaatttaataaatttagaaaataaaaatttaaaacagctctcatattattgagtgaaagacacaaatacatactaatgagtccatatatataaagctcaaaagcaggtgaaacaataccgccgtgttaacactaccgtacttaagt

SEQ ID NO: 1292 - DNA, 42902 bp, Homo sapiens
gacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtctacatgctctttattggaaggaaagtggttgaaacttgctcttaaagatggacaaagagacctgtgttctggggatattttaagcagtttagtcataaaaaaataacaaaagttgaaaatgagagagccgtatttgtctgaccagacaactaaagacctaacacagcttctgctctagagtaaggaggaaagtcatgccatcagagtcgaaggactcttaaaaacctccatgtaacaggggagggcatggagacccagagatctggagtgggctcccagaggtcacccaactaaggcagagctgagacaggaagccaggaattctgccctccaggcctgtgaccttttcagggtctctgtggatcacctgaccccttttggatgtatccatgggcacactgtgatagctgcgtgcctgcctccatggacacataatcagttcctgtaatgctgtgaacaggacaccctagaggagggggcaggggaaacagaaccagcccagggactcagcatcccgcgtgggtgtccagacctcacctgaagctccttgagcttcttctgcagctggctgccgagggcctgttcatcctcaatccttgcgttgagagcattcagctcaaagtcttttctgtggggaaggagggatggtgaggtaagggagactcgtggggcctcaggagggtccaccagtggttgaaaatggtaatgatacaggtaaagagtaggatttcattagaaaaacagcttctgggggtgatgtaggatccctggaagtgtaacacctgcggtgagattgaaatccaacaagaatgtaatgggaggagtgctgtagacagggtgatggggcctgggctctacaggacattcccatctttggtccttgttttctcataatgtaaaatgagggggtcggactagattgtttcaaaggtcctttttagctctgatggtctttaattttgtcactattgctttgggtaactcagctaacctttctgaaacttattttcctctttggtaaagtgaaattaaagataccatccttaaaaggtgttttgagaatcaaataggatcgtgtatttattcatttattcaacacattctgtgcctgggaaggtatgaagattcctgtgcaaacacaaacttgatgaggatgtagattatgatgattctcaaagcctttcaaagtcctgagcctgaaacaccataagaccttcaattatcaaaatatgttctgcaagctcactgtttaccaagtctggaaagtctatacattttggaagaacttacactaagaattggaaccacaagttaagcaaaacaaagaaatggccctgatcccctgacttctttaatgtgagggcatttcttggtgccctgtgggctctctgtgaaaagccacaaagggactttcctaagaggctctcatgtggagccttcctccatgtcaaggaactggtctccaaagagagatgtgtatgaagggggaaggctgttattttcattcccactgagtgcctaacaagaagaaaggactcatgggatacaatggactttttgccagggaggaccatctaactaaccctgatatctgggactaggggaggaaagcccttgcctgggaggccttttcccatggtttgcgcctccacttgtggaggctgcgtgaggttgttgcctcagaggatggctgtcttgggtctgcttgtactgttatgggctggggaggaggaagggcagcagggaggggacacagtactttttcagccgctcatccagctgctgcttgtcattctccaggtccatgatgctctcctgggtcagcttcaggtcgccctccagcttccgcttcgctcgctccaggtccatgcgcaccttcttctcttgctccagggatccttccagctggtagagagaaggagccaggcccagtgaggcaaagcatcctgacttggtgattttgttgttcagttacctcaggacttggtaaatctttgtgttcaggacttgggaaaccttccccagagtgggccaaatgttattaggggactgtgagattgcctagatataggggatgctgaatcaatattttatagataaaggaataaatgactgtgggatgaaaccccaaagccgtattctttctttctttccctttctttctttctttctttctctcctttctttctctccttccttccttccttcctccttttttttttttttttttttatggagtctcactctgtcgccaggctggagtgcagtggcgcgatctcggctcactgcaacctccgcctccctggttcaagggattattctgcctcagcctcctgagtagctgggactacaggcgcacgccaccacatccagctaatttttgtatttttagtagagatggggtttcaccatattggccaggatggtctcgatctcttgacctcgtgatccacccgccttggcctcccaaagtgctgggattacaggtgtgagccaccgcggctggccgccgtattcattctttcagcatcctataaacacctactgggcatcaggctctgtgctaagcactgcagtccccaaattgaatagatctaagttcctatctaaaggaagcttgtagtcttatggctgagatagaagcttaaataattaaaatacagagtgataagtgagtcaacagacatatgtgcatcagagggaacaatgatcagattctgccttaaatattggaatttcaaaaattctacttggggagcctcacaaaatttccaaagaaatttatcatgttcttatgagatgaccctctaaatcttgtgtcaaaggcagagatatatgggattgcacttaaattaaataagaaaactcatctctattattgatcataccagtgagattagatacataattcagaattgatcaccacctctgacttttcattccccagctcctttctagaaagatatcagaaaagttaacatcctctaaccctacccccctctaaacataaacacaaacacacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccgagtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctcagcatctgccaggttgtcttgttcctgaaggtgaggaacagaggggaggctgttcagggggtaaggtcctcattcttgcaggtagagggaaggagaggcacatcactcaaataggagggtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcatggtctgcccaaggtcacaaaataattaagctgtgtatctaggttgaacccaagtagaaagcctgtgcttttaaaagtcagctcttttccctctgccctttcctcctcctgagggacctctttggaggtctttagaagtgttgatcccagagtcctctgactgaaggaacaagacagtgagcccctgtgcagggaggtgcagggttgtgggaagtgaaggcagagcagggtggaagagccaacagtagcccaggagcctcaccgcctgcacttggagctgcaggtcattcttctcctgcagcagggacaccatcttctcctccagctccttgcggcgagcctcggacttctctagcgcctctttgaggcgtgtgaactcctccttcatggaggccatctccttctctctttctgcactcttcagcagcggcttgatcttgaagtagagcttcatccagggccaattcttgacccccatgaaggcccgaatgttccactggattaccagcagggagtctctgcaggggcccattgaaaggagtgctgagcctcctgcctccttcctacctgaggtcctgaaaccttgggaatatcccatttccttcatccctcccacccttcctgaggcctctgaccctgtgactgcagtgtgttcatatgagcccctcctgcaggtctctgtgtttgaagatctgctgagctttttttcctgacactgcccctgaaccagcctgggcctcagagaagcgggaaacctcctcttgagatctctcacctacgttccagcagctttttgtactccattctggcgagcacacctcgggactgggcctggatacgcgtgatgatgcggctcagcctctcgtccctcatttcctccagcagccccagcagcccggccttgaagaacacctgcaggcaaggtgtgtgttggccatgactagggaggggtacgagggaaagagatggtggggattaccttaggaagggtaacagcctagaaaaggattgcagggaggaggtcaatggcagctggagctgggatgaggggagtggtgctagatgttccactgggaggggtagcatacaggtaagagattttgctaagatgattacaacaggaaaagcatcagaggagtcaatggaaaagagatgtcttcctttaattaattagtctcctttcctcaccttggtgtggccaaacttgtactggttgtgatcaatgtccagggagctgagcagcttctctgcccccttcctgctatcaatgaactgtccctcagggatggccgctgggttcaggatgcgatacctgaggagggaagtgtccagagtcacccatgctctgcagtgatctgctctgcccatagaattccagggtcacctgcagatcccattcccatcagggcagcctggctccccctgttctatgagctctggtgcaccctcatacccacctctgccggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatcttagcaagtcagttagtaataatcatttgtttcattttcttctagccacatttttaactaaaaggctttcacattccttttttatatgattcacacctattatcataggtggtagccagaacagatatatccaatgttctagatgagtaaattaagcccagaggggttatgggactggcccaagttcactaagctgatcaagaacagagccaggtcttgaacccaggtccctgagcctctgtctcctaattagccaaaaatggattaacaatttgaatatgtctcattgggggattaagtggttctgcaggtaaatttaaagttgaactaagattctgtcttggacaaccagctatccaaggggttgtagggccactgatgaggtaatgtccatcagagtgccttacacatcaccctcattacacactgcaagtgcaaggtagcgctgagagggaggtaccctgggaggcctcatgcgggatgggaggagaagaatgtggtttggaaaccactgtggtggtaggtagggagatgtcctaggaggtcctgttcccagggcggtgtatgcccagcagtgggttggcctgagtttgtggcctcacctggagactttgtctcattagggatgatacaacgtacaaagtggggatgggtggagcgcaagttggtcatcagcttgttcagattttcctgtggccaaaaatgcaatagagaaaagtaaagaaaatgccagaaagagatgcaggaagaagagaggagaagaaggaaggaaaagagagatggagagaattcgagaagtcacagagatgaaggggccctgggggcagacagggataaggagagagggtgggagacagaagggaaagaggagagaagggagatgggaagtaaataagtgaagaggccaggagatgacgggaagagaagacagagtgaaaatggtcccgaatgcaccaaggagacagggaacgggaggagtaggggatgaacaaggcagggaagggtggggctgggtggggttgggcagatggggagccaagttggctggggctgtgtcccactcaccctgtgcagagctgacacagtctgaaaggacgagcctttcttggccttgcctttgcccttctcaatagctgcaggaaggagagtcaacaaaagaagcatcagtgtggggaggtagggtgtgagtaaagaatcacagcccctctttacatccttgctggcatttggcccctgggtgagggccttcaatgtggctgcctcagtttcttcacccagttccatcccactgagtctgtaaaccttggggtacaacctgacattgaagtggtggggtgtagcaattgacctggctcagaaccttggcagaatccctgctcctctgtaccgggagcctcagtccctacttacgcgcatcagccccagcatagttggcaaacagggtgctgagcagcttgagggaagacttctgatacaagcccacgacagtctcattgagaggatccttgttcttctgcagccagccaatgatgttgtagtccacgatgccggcatagtggatcagggagaagtgggcttcaggcttccccttgatattgcgtggcttctggaagttggcggatttgcccaggtggttgtcaaacagcttggccttgaaggtcatgtcggtggccttggggaacatgcactcctcttccaggatggacatgatgcccatgggctgaggaagcaggagagagcatcactgagtgtccttcacacaggtggacatggattctgctctatggtcaatatacttgctcgtggaggtgccatgttgggtgttaaggtagtaggctcagctctgagtacagttatctactgactggaaccggttcaaggtggaggattttgtctgatgacagaaggacctttgtgaaagtctgggaatatggattctatcgatgctgtacacaccactccacgacccagatgcctgagatgctagggttgaaaataggtgcactcttatgatcccctacaccaccctcacacttcctgatccttggatgcataaaccaggcccaataaacatgcaggtgtgggaggtcatcatgcaggtgcccatcctccatgtgtccactttcaagcccctgggaaatcagctgtccctggtgccaccctgtcctgggtgctcagcacaacataggctctggaaccaagggctcggatccttcagccccttctatttttatattccccagaagggagaggggctgctattttgtctatggtgttcttgttgggtgtgcagggagaattcaggtggtaaggccaaagaggcaccttctcgatgaggtcaatgcaggcctgcaggtccatgccaaagtcaatgaatgtccactcgatgccctccttcttgtactcctcctgctccagcacaaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtccactgtgcctgagcccagcagggcgtggctggtcccctccatgtcaaggcagtgaaggagggcttcccctgaagacagagaaaatgactgcctctgtcaccacacagtccccactgccttcccatgtctggtccacagctggctctaagcaaatagctgttgaatgtgggagcgagtgagtgattgttctcccactcccaggggtcccaactcacatcgaagatctcgaagccagcgatgtccaggactcctatgaagtactggcgtggctgcttggtctccagggtggcattgatgcgcgtcaccatccagttgaacatcctctcatacactgccttggccagtgccccagtggcatatatcacctgcaaggtggaggagagacccatattgagcagggttgttgggaagagtgaacttgaaaactctcatcccaccatgccagtctccctaccctgcccacccattatcatctgaagatggacccacctgctggacattctgccccttggtgacgtactcattgcccactttcacccgagggtggcacagccccttgagcaggtcggctgagttcagccccatgaggtaggcagacttgtcagcctctggaaggaaaaggcaagtagcaaagttggtaaagagatgactgctggccaggtgtggtggttcatgcctgtaatcccagcactttgggaggccaaggcaggcggatcacttgaggtcaggagtttgagaccaacctggccaacatgatgaaaccccatctctactaaaaatacaaaaattagccaggcatggtggtgcatgcctgtaattccagctactcgggaggctgaggcaggagaatcacttgaacccaggatgtggaggtggcagtgagccaagatcgtgccactgcgctccagcctgggcaacagagcaagactccatctcaaaaaaaaaaaaaaaagaaaaaagagaagagagatgactgctgagcagacatggccctccatgacttgacagctgcccccaagaatccctgcctcccaccttcagtgccgtctggctccgcctgctcctcccgctgcttcagcttgaacttcatgtttccaaagtgcatgatggcgcctgtcagcttatacatggagtttttctcctctgaagtgaagcccagcacatcaaaagcgttctgtagggaggccccatattggcggaccccagaaaaagaagtatgatgggtaagtgagatcccttgtaagttggagagaaaacttgtctccttaatccctgtgggttctgagactcccatacccagtggggagctccaaaacaaaggatgtaagatgcagggaactccaaaacaaaggatgtaagatgcaagagcagagcagacgtcagttggccgcagccccagtgtcagtggccacagcttttctgagttacccacttatgcttcctggccctacacttgcttcctgcctggccttccatacctgtctgcatctgttcacctaacagcccctccagccccatgccgtctgcatggccttccctcctcgtcctgctccctcggtgatgcttgtttcttggcttgtgtgtctctctgtctcatggctttcagctcttcctggtttgatagaacaccagatactggccagtcctgtctcacctcatccattccccagtacaccctgatcacagggcacattctggctctcaggaggtccataccactttaaacaaccaatggccagcgtcttagctctgcttttggacccctgtttgcccctcactgccaatcctcccaccccctggctgggtcctcacacactcacatcagtggccatgagctcctcagcgtcatcaatggaggccacggtggtctctccttgggagatgaatgcataatcgtaggggttgttggtgatcagcagcatgtctaggggaaaaaacatggttagggtgggacacaagcccccggctctcatggaggctgctcgccacagcacatggcctgaggaagagcacaggacagggcttggcttggccccacatcccactgaattgaatccagcagtgccatgaaacccagggcatgccagctgagtccagccacaagcagaggggaccaggttgccatggagatagttggtctcagtcggtggctctgactcacccagcagctcaggctttttgttagacaggatttggtagaaaatgtgataatctctctctgctttcagctggaaaataactctggatttttccagaagatctgtgaacaggtggggagaagaaggagagaaagaaaagttagggtttgggcacaaggaaaattaatgataaatgtagcaagcaaaaggcagagggaagggaagagccagagagactagttggacagacacaaagagatcacacagagagatggaaacagagacccagaaggagagaaatagtctcagagagaaatcccagagaaagacacctagccatgcagagacagaaatggagaaagatgcagaggaagtctcagagagagacagatatgtagacctgaagacagagacacctacagacagagacttaaagaggagaaaaacagagggagggaggggagagagagagaggtcaagaccagatggtctagagcaagggtgagcttaggctgagcctagcagattcatggcactcacaggtctctatgtctgcagatgccaactttcctgttgccccaaaatgaattcgaatgaatttcccctggagagatggaagagagtggtgatgagttgggggaaggctcatatctgagaccattcctccaccagtccaagtcccaaggccaaggtcagggaccactcacgaagcgggaggagttgtcgttccggacggtcttggcattgccaaaggcctccagagcagggttggcctggatgatctggtcctccagggtgccctgcagaggccaagaaggaggcaggtgagagctcttctccctccctttctgcggtacaggaccttggagggcagcaggcctaccttgcccgggctctggtccttcttgctgcggtccccaatggctgcaataacagcaaagtactggatgaccctcttggtgttgactgtcttccctgctccggattctccgctgtgaagacaggggcttattgggcagtgaacaatactactggagaccagcaagcctcaaatcaggagagaatgcctgggcctacccgagagtaggagccctgggcaagaagctgccaggttatctacacccaaaatccacaactgtcttctgatgcacagaggtcagggctggcaccaggaaggatgccaccagaaggcactggtttgggcaggctgagcctgtgcttggctgggcaaagtaaacaggggagatgggcctgggctgttttgggaaaagttggtagggctggaagaatgggaaatgtttctgaagggaaagaaaatgcagaggtgaagacatggcgataatgagcttctggataaacgcgtgatgagttggagagtgggtgaaggaggtgggagaggaaaaacatgaaggggatggaaagcagaaaggaagagggagagcaaagagaggggtcagggtaatggtcagagaagaaggagatgggcacgaggttggggggaaagaggctgagtctatgcctcggggcctgggacacctgatggggctggaggctgggatcagggagattctgaaagggaatacagtagcagctacactcacgtgatcaggatggactggttttctctgtctgtggggagagggtggggaggaaaggtcaggagctgcacaggatgctctcgtggggcttctcccttccttctccctctccctcccggcctatcccagttcccttcaggaagacccttccagggcctctcacctgtcagcatgtactgataggcgttgtcggagatggagaagatgtggggcggggcctcgctcctcttcttgccccggtaggcagccaccacctcaggagtgtacaccggcagccacttgtaagggttgacggtgacacagaagaggcccgagtaggtctggggatagaaaaggagcagtgacttgccagttgcgaagggggagggctggtgattttgggagttagagaaagatcccaggagagaaagaagagaaaggaaaacctctgcatgcactcaatctgagtaatgccagtccccagagtgttggaattgaaccaaggatgttgggacgaggttagagtgtaaccctgcctagacacaaacagaagacactcttggctcctggggtggacatggatggagcaagaacagagatcccaacgtagggccaggtgcagcactcacgtagatcatccaggagccgtagcgatccttgaggttgtagagcaccgcgggctcatgcaggaaggtcagcatggccatgtcctcgattttgtcgaacttgggtgggttctgctgcatcacctggtcctccttcacggtcactgtctgcaagagcccccacccaagccctcctgtcagcctgggctttccctccttcctcaagagggttaggagttggtgagtgacagggcaatagtgctcaagagagaaggaaccaggatctcacagggaagacagaagggatattgggaaggagagggctctttggagggtctggattcttccccaaagggaaggagaatgggaccatcctcaggtctgcatgggcatggggcatgggtgtacccctctctgtccacccaggtgtacaggtggccagggtggactctcacatcagcctgacacccaccttgccatactcggtctcggcagtgactttgccaccctctcgagacacgatcttggccttgacaaactcctgtttgtcatcaggcacgaagacatccttcttgaggtcaaaaggcctggtctgcgcttctagccgctccttctctgacttgcgcaggtagggggcggcagccccaaagactgccatctccgaatctcccatggctgtgcctggagtgagcagaagctggctgccctcccatctgcccattcttcccttccctccctgggctctccccttcagtgggagccccaaaacctagcaccatgctcaagagtcaagaggagttaccagtgagtcccttcctctttgaggttaccccttaaccagaggagcagcctagcaaacctgccagggtaaaaggaacaactaactattgttcaagctggggctctcctaggggaaggaagagcattctgagctccctgtaggagcagaaatctaactatttccatctctgaccctcatctatccctggaccccctggtcacaggtaagtagctcttgatagccaagatattctctccagcacatggcagaaactagagttccataggctggctttggggctctaatgcccagtcttactagattttcaacactctagcttcagcttttcttacctgggctactcaagtgtgtctacagatgaggaaaggggccaaggcctgcaggggacctggagagagggaagaggctgtgtcagggcaggctgtgcccaacctgaccagtcccaccttcctgcttctccctggctctgttcttcagcatccaccctcttccaaaacaaggtggaaagggtggtcagcttctctggtcccatccttcttgtttttcaaaccctattccctttttcctcaagaactagttctaacagcttcctggtgtcaactcaacctgaaccctaatcctcttcactcctgcgagatggtcccacccctgcctgtacccatctagtggtacctttctttgagccatctgagagacaactaatggtcacatttgttcggcactttccagtctaaaagcacttcaatgcactttctcctactcagtcttcaccccatttgacagatgaggaaatcgaggttaaatggcttgcttggccaagagcccatgacaacaagtgggagagccaagacttgaatgcaagtctgatgactctaaagagacttcttttccatcctgtccccattttgttgtcagactttgtggacattctcagagagaagacactgtgggcttcctctcacagacacacccatcacatagccaaacaccctccacaagccctctgatgaacactcatgcctgctgcttgggcatgcctctcacatgaagacaggcttccttcccatacctcaatccgcaccccaaccccagggtgccatatatgcctcaacagcaaatgtgcacatttcaggatgtgtgccacgtaagtagatcacatcactgcgtgttcttcagtacacaaagacctggaacatcctacacccccgtgcctgtgagttccttctgcagagggtacagatactataacagtcatgactcgtggaggcatagacaagaacctctgcatgcatggacaggggtagctacacattccaggcctcacagaatcacatgaaggcatacacacttcctagaatccttctccaccattctttctccctccctgcaaaggaacctcctcgttcacagacgtgatcatacacccacatctcccacttgatatttctgtatcagtcagtgaggtacataccctttctcacattcagactatgcaggcttgtccacacacacacacacacacacacacacacacacaccctgtaatgcatattggtcccatatgctcagatgcagatatcttcccctaggaactcctgtggcacatacgcccatgtttagacctgcacatgtgtgcccagtgactggacctggtactctgcatgaagtcctgcatgaagcttgctattccaagaggaatcccttcctaagcctggagcccccttatcccagagtaaagcctccagctcccgctcctacctgagagcagcagggaaagacacagagcaggacagagctgtggagccagacctggtctcaggggctgtatatatggggcagcagggcacccccacccccaacggcacccagtccctagccggatttagaaagggctgttgtcactagaagcatttcccccaggctcccccccttcccaaacagtgctcccctccccgcctctccagctaggaaacaattggaagtggtcgtcattgttatggcatggactgtgcagggtctgagttccagggggcggggtggctcaaagtgcagcaaaaatatctcccaggccaggcctcacattccacagctggcaggagagggaactgaccacgaccaccaagaccacaggcagccaatgtcctggctctcccgcagggcacttctggccctggacactgctccccctccagtcccctgctgcgaggcccctgatggcctggccgcatttccacagtgtcctccctgctctcctggcccaggtcctgtatccaactggaagctgggaaggggctgagtgtcagcagcagagaagggtaggacagagttgggggcatggccccagggtgaggcagctagactggggcagctggaaggacatttcctagccaggtggcaagaacaataaccatggagcttagagatggggactctggctcaggcactgatttccttggaccagcaggcaatgtgttgaggtcaccaagcctccgagccagacaggcctttagcaatccatccaagcacttcatttaatggagagggacagtgcattctttaaggttatacagctaatcggggcagcaggattcaaggtgggaaacctcagcagatgggagtggagcccggcctgtggagggtagcctggaaaggtgggctgggattccaaagatgtggggaccccctatgcgcagagagcaggacccagctgcattggtcctagtttggagcggtttgcctgactcacgttcctggctctgccccacaggtactaaaggcctgagcccagagacagaccctctcagagctatagataatacaactacttggagctggaaggagacccctaagacagctgttgtctggcccacccagcctcagctttatccagagctggaggcgactagtgttctggcaagtgaggcagagtaacaggacaggaaaaatcttcccctctgcaggcctgaggaacagccacaaaggaggggaggaaagggagctggggcccagcctacgagcacagaacacaaccgatgccatgctcttctagcaacggggcatgcaagcttgactggctccgtgtctaggcaaccactgcacgatttggtgtgaaatctcccccttcttcccaagcacagctcttccgcgcatgcggattagtccatctgattagctgtcagcttggaaggagtgaggcaggcctgggggatgggtgcagcaggtacattttgaaggtggggtgggcatagcagggaagggaaaatccaggaggaggcctctgtgggggttgcttggtaaccaaggcactaaggtacagtctgaggacattgagcagctataaggggggtgcaggcaagtgggggtagaccacgaactgcaagggctgtgtctgacaacaccgcagctctgcagtgctaaggtatacagttgctgaggttatcccagtagtctgtgctactaacatgcccggcagaacagactctggcagtcccccccaggccctgccaggtgctgaggaatcagccccattgacagagacagaccctctcaaagctatagataatacagctgcttggagctggaaggaaacccctaagacagctgttgtctgaggttccctgtaggaacctcaaggattggcgatgaggggcaaaaactcctttcgtccccaccttccagctttccaagctccaaactgccacccctccctgatttcccagggcaattaagatgcacaaagggtgcttgggacgtagttgagccatttcaaagccagtgtcttcaccacaggccagcgtccttccttggctggggacttgggtagtcttttctgcatttgggaaatcaatcacactttgtttctctcctttcgggtttgggaggctctggtctgttggtgtttgggtgttactgttctccacccatgccccctctcattgcagatagaactcacctccctaactaggctttgcctcacagctcagacagatcagagggcctgctgtccttaaagatccccactcactccctagctcctccagcacctgctcttggttacatcatgattctcttcctgctgcttgctgctgtctgaagactgagcagctttgcagattcctccattcaacaagtatttattgagtgcctactatgtgccaggcattattctggtcaataaggacataacaatgacccaaagaaagatccctgctctggactgctttagtcaactgtttgtagaaatggcatccaggcctaccctttgcacacatgcacattccttgtggggagagtgaggggccaggggccccaccatgctggggtgggtggggattgtgcagagtgtgctacaaagtgatagcaagataaaggagagcaaagcaaaatgctataaataaagagaggctggaaggagggccgcttcggcaaggtagaccaaataaggcctgaagtgaaaggaaggtgatctgtcccccgtcctcccctccccgcattgtgccggctttgtctgcactctgtcaccaccctgatcaagtgtcaagccaaaacaggggccatttgctgtgaacacgccagcggtagttcagaggaaaagttgctaaaattactcccagtaattgtgagggagggagacaccagggcgaattagaagcgatgtcagcatggagagaggggaatcagaaaaaagctccggtacccaaagggaaggaagaaacggggcaggaagaggcagggcacttggtgcaggggaggaatgaggcactcgttgtttgtgcacagggcagaggggagccacccaggagtggaggctgactctcccatccgcctgcccccagaatccctgaccttggggggaccctgccctggctccacacgagcctaggattagggagctgagctttctgcctgtctcagatttccctttacaaacagctgctccttcttgtcattcttttgtcttcctgctggcttcaaaatcttttgtacttgtgcaccccctctcattccctactctaggtctctgctttctgatggatgtgaacaaagagagagatggagggccggagacaggcttggggctggcctagttcactttggggtagttagggcaggttgatcttgccttcagggagtgtttggagggacacaactcaccaaaagggagactttgtggggagtgaccggtctggagggccagaggcctcagaagcatacaggatgagcagtctggtcagctttggagtcagtcacaaaaatccactttgaaacccagtgattccattttctagctgtgtggtctacgtcagtcatataattgctttgagccagttttgtcatctgtaacatggggatagccacattttgtttccagggctactcaggccattagagattgcacaagcagagtctacacacagcagacacactgtgggccctcactgaatggcagctcttaggttaggaacacaaaattgaggaagccaggctgcagacaggagggccggttgccctgccataggttctttgtccccacacctccttcagccccactaagtccacttggttcaaaggatggtctggaccagagtagatcagaaatcctgcagtcttgtggtcggctctacccagactgtgactgcccttgggaacgtcatgccaggaggccaaggttctcagactgtcctagactcagtctaggcccacagtccagccctgagctgggataggcatcactgcttgactgctgcccactgagcttccctcatgacaagccagtgtgtcctgaggtccagcaggagttgacccaggccaagtggtgacattggtcaggccaccagataggagcaggctgggcgttggtggctcacacctgtaatcacagcagtttgagaggctgaggcaggcagataacttgaggtcaggagtttgagactagcctgaccaacatagtgaaaccccgtctctacaaaaaatacaaaaattagccgggcatggtggtgcactcctgtagtcccagctactcaggaggcatgagaatcgctgaagcatgagaatcacttgaatctgggaatcggaggttgaagtgagctgagatcgcaccactgcactccagtctggacagagtgagactctgtcccaaaataaaataaaataaaataagctttcaagatggggacatgacagtggagcttggtgaggggagggctttaagaagcactgagtatcaggatatgttctgggcaatgagaatcacagagtgaccaaaggcatggaaggggaacggtgtggtgagttcataaggactcggaggacacatgcctgatgaggctatgcgtatgggggatctggagacataggtggaaggaaaaaaaggtagggccccaatgtcggagaggggaaagggctatatacatattgagtgaccacctgtgccaggtgcacagtgttttatacaccatgatctcacacatgttcacaattgtgtgtcactttaattgtgttttatggaggagcaatggggttcagagaggctaagatgtttgctcaaggtaagtagcaaacgtggcactgggattcagacccaggtctgtcttgctcaaagggctttctacggactctgccctgtttcccaggacagcaaaatggataataccctggaagcaatgaggaatgactaaagttctaaaccatggcagtcattgtgatgtcttgaaaccagagtttgatgggcctagcaggggtattattgggtgctttgcggaagagaggctggaggcagggagacccgagaggaggatacagtagccatcaacgttggcaggaaagcgagaccagcagcatgaagcggaaaggcaaggctggaaggcctttctaaagaaggaataaaatgccttgctaacagcctggacgcaagaaatgaggaagggagaggcatgactgcacgatgtcggcaaggatgggaataatggcaaaagggacacgtaggaggaaggacagtgttccgtttgggggaaatggaggtaagagtggggcaaccaatggaagatgttttgctttcctgaaggaagctggagctatgagaccagtgggcagaactggataaagagggctgactacctcgggggatgtgaaagaagccatgaggttggagagaagaggaaaggcctgggagatacccacagtacagcgatgggagaaggaagagaagcccgcagagaagagaaggagattcaaagacagctaaggagagtgagaaatgggcagtttcctagaagccaaaagaagcatttcaagaagagcaggtggccagcagtgtcagatgccaaagaaagcctgtgtatcaggaagacagagaaaagaacttggattatcttggagcaagcagcttgtgtagtgtcacaggcaaagccaggccacagggagttaatgaggaaaaagatgagtggacaggaagtggaagcagtgggtgtacaccatgcatttgaggagtttggcagtgaaatgaatgagattagacaacaactcaagggaagagggccaagtagcacggtttgttttgtttttaaggtagggtattccagaatatgtgaagagggggtaataaaagatgcccttgttttgttcaccattttcttttgcactttctggttgttttcttattctcatctccctttttggaagcctggggggtgctttgagaatgcctagagagtttgggtacccaccaccagaaagtgggcttgcaaacatgaggctcagctggctccctcctcatcttcagatatgcacgtagggagctcaaggcagagctcgatacagccctggctgtcatcattgggcccactcactggctggagaagggtctcagcctcctgagttccatcgtataaagattaaagtagggctggagggcagggagtagccctagcgaatgatctggaaacatatgtagtgctcagcaattcaatgtcttctgcttgtttttgcttcactatttttactttacgtagaaagacaatgtccctggtgtgaaggtacaggtgcctttactgggcccaacctacaactcagccccaagagagcttcctagtctcttagggcagggcttttgctggtgctccaggagaatggtggaatgctgacccttctgggatgttctgtgctgtagcagacatttgagactgcagcagcacttgctgggtgtgcaagcccagcagaaccttaattccactttagtgcagaaccttaattccagtcctttgctatacatgcctcaaagttctccacaagagttagaaactgagtaagtaggcaacagatacacacattatgcaggttcttccagccatgggagaaggtggtaagtgacctccctgggtctgagagtcacaaagtcagatttggaacagaggggcctggggagctggctggtgcttttctccagggaaacttttccagggcagctagcagtcccagtgccagactgcctcttgggtccatgaatcagattggaggctgagagctggtcaggctcctggatgtctgaagggaccagtgcagaggtttagcttccctacctgtagcaaggaaagaagggcctttatcaaaggtctgggagtttactagattaaaacagctgaaccattctaagcaggaagagtgggaaggaagcaagatgggacagtagttggtttgctgggagtgaggaaaagtcaggaaaggggtccatggagaggctgggagaggggcagagggggagatatgcagagatattgcatagtagcggggctgggggagctgaggtccggctgtgggaacaaagacagtggagtgacgaggctaagactgcagaaaaggtgcagagctgtgtgtctgtgcatggtggaggagatgaccttgcccaagggcagagccttgtggctctgagaagccagggcagggggcacaggctccagcctggtctccccgtgcctgggccccttgtctctgagattacagccttggctgccaagagcagctccatgggggtggtgtggaacaaagcgaacggcccttttgtgattctgggttcctaagaatagcttggctgtgtgtggggaggtgtctgtagcctgcctgtcctgggtcttgttctcagaggtgttcgaatgcctggtgttggcggggctcattgctagttgctggggtagtggaggccgtcagcccacctcagcctctgttacctgtgcttgtccagctcagctttgggagaaggctcaaggcccagggacagtggaggggcagacacggagtggccccaaggtgttaagggagagaagacaaaggccacaagcctggaaaacaaatttgatgcctgaaagtgaagacagggagggttctgggaaggtaggggttgagggacagcagccagaagaggccagagcagggatggacatgtgggaaggacttgtgggacatggaggagaagcagagagaataggtgcacgcggaggccagaatgtggaaagcaaagggatgaggaatggtccaggggagggggagcaggatggacgggttgacagagaagagcagatggaaggagagaagagaacgaagcgggaaaggcagtgggcacttccacagagattggaggggggtggcatgactcttggaagagcttggaagcaaggctctcaaacgccattcctgtgagataacaatgcagtcaaatccctccctaatctcccctcctattattagcccagcgtcctctcagagaataggccacaggtccctgggctctgtcctttcccccatgcccttggctggaattagacagacgtgcctgcatggtcatctgctaaccacggtgtccggacttctaggcaatgtcattggacaagaggatagagaggtagtgggaaggggatggaaggtcaccggacaccctccgtggacgaggcagcagctagacacagagaggggtgaaggggtgcactagaggtctttgtgctcaaagacttttcagatcaatagaataaatacacaagcaacatgatcacaagtacaaaataacatggttaacacgtgcaaaataactggaaagtcaaacacatagccatggggatgcaaaagagctgtcatgaaagggcagagcagagaggggagggtttctggggaaggtgagcttggaggtgggtcttgagaggatggatctcgaggaaccacgtccacagctgctggccaatgctgtgggcattccggaggaaagaagggaatcaaggagacagtggcttctatgtctacttttctggcccagcctctaggggcaaggttgttaaaagcttaatagcagactcctgggtttttaagcacactggtatttgttgctatttatttaaaactgctgtttctttcttgtccagcgtggtccttttacgttttccccttagcctccctcttgcctctagtatccctaaatactgtttatcattttgatacttaaaatggccaaaagttatcatacatatttttattttgagctcttttgactctgacaaatcgaaacaaaataaatacttgatgaataatgtaccaaagaaagtgagcagctgctgttctgtgttcctatgagggctccaattgctcttgcaggatgagggacatagatgagattctctggatcatattcagggagagggtggaggagggtggaggtagcttgctttctctctctctttttctttctgttccttctctctctcaacttgcttttttcttcctctctccttctttccttcctttctttcctttctcccaaattataaaagtaatgctcattactttaaaaattcaaacaataaatcttctataaggcaaaacaagtgaagtcccttccgctgttcacaatcccatccccaaaggttaatagtcagagtgtatcctgtgcttgtccatttggaaccttttatgtatatgcataaaatacatgttgggatttttttttttttttgacagagtctcactctgtcactcagcctggaatgcagtggtgtgatctctgctcactgcaacttctgcctcccaggttcaagcaattcttgtgtctcagcctccccagtagctgggattacaggtgcgcaccaccacacccaactaattttttagtagagatggggtttcaccatgttgcccaggctggtctcgaattcctgagctcaggtggtctacctgcctcggcctcccaaagtgctggcattacaggcatgagccaccacacccgtggattaaaaaaaaaatagagacagagtctttctatgttgcccaggccggttttgaactcctggactcaaacaatcctcctggcttggcctcccaaagtgctggaattattgggatgagccattatgcccagccacatgggaatttttttcaactgggatataaaaaaatgaaacatatatattcaaccagggaatgctgacttaaaaaaaatgtatgtagtttttggaagcttctcaagtcattaatgattccaggatccctcttcaagtgacacatgtggacagttaccagagtcttcagaggctatatagtaatcagcactcaaaagtgaatcaaagtgaattttgagaaatgaatgaaagaggccaaggaaggataagaaagaggatgccaaccccttttaacttcagcccttctttgttcctggacatcctcctctcaggagaggtcacttggacaacatctgtctggggtcagaagtgacagtaggtgcatggtagactctcgggtcatgggag

SEQ ID NO: 1293 - DNA, 292007 bp, Homo sapiens
cctgtcaaggagcaggtgtccctgagaacccaaacattccagagagtatctgagaacctacctgggaaaaaagtcccataacacacacagtaggcaaagagccagaaaattagtttaaaagcagcatagggatgggaggcagcatgggcctctaaagctgtcctgctgctgtccgggagtacctcctatataagtcctaataaactcatctacttgccaaactggacttgtctgagtcattgtttggtctcttggctccctcccagcttgggggaaggtttttctatatgattccaggtttttctcattacaggcatgataatgcatgcatgtagtcctgagctacttgggaggctgaggcaggaggattgcttgagtccaggagtttgaggctgccatgagctatgacagcaccactgtattccagcctggacggtaccttgctcaaaaaaaaataaaaataaaaaggcatattagagaaacagattagcctgtgattccaatttaacatataaattgtgtaactgacttagatttgggattcaagatttaactcttactaaatttataacagtattggaccatttaagtgacattaagtcttattgtatttataaatttaattatcatgagacatttcatttgagaagttatttgtaggagcttttcttgggaagttttgttataagccaattgaagaatttaaaatgaaaatgaaattattatacactagtaataattttcatttgtttgtttgtttgtttgttttgagacagggtctcactctgtcacccaggctggaatgcagtgaggccatatcagctcactacaacctccgcctcctgggttcaagagattctcctgcctcagcttcctgagtagctgggattacaggcatgcaccaccatacccggctaattattttattgagacggagtttcaccatttggccaggctggtcttgaactcctgacctcaagtgatctgcccacctcagcctctgaaagtgctgggattacagatgtgcaccactgcacccagccatgtttgtttgttttttgagacagagtctcactctgttgcccaggctggagtgcagtggcacaaacatacctcactgcactcctggccttaagcaatcctcccacctcagcctcccaggtagctaggattacaggtgtttattacatttatgaacatgatttaaaaatgattaagggaattaattaattagatgctaaaaattcccttaaaagttaatattgcattttggtagattttataaacctaccaaatcagatctggaaattgaatttaaaagtttaaggaagaactaggttttaaaaattgcaataggtaaaatatgaattaaaaagaacaaactggtctctgaataatttttctgtgtgcaaaaaattgccattaaatgcataaagtacccacattgacaatttgatgagaattggatgtttttattgagaaattcccatatgacagtatatgtgggtcatttctctagattgtccagtttccaagaacagtccttcaatcccttgcttgtgcaagaataacctgcagcagggctggcttcatgggccagcatcccatgcagtctcacagggccctgctcttagaaggacctcacacttgttctaatgctctgctcaaaaaaaaaaaaaaaaaaaaaaaaaaaaggcatattagagaaatagattagcctgtgattccaatttaacatataaattgtgtaactgacttagatttgggattcaagatttaactcttactaaatttatcacagtattggaccatttaagagaaattttgccatcttgaaaattttattttaaacaaggagccctacatttttattttgcactgggccctgcaaattctgtagccagtcttgccctgtagtcagagttgtggcagccaagcagtaggagagggctggagtttcaaaggtcagtgtgcagactctccccagtccctgagttttctcagttgcctccctctcacccaccaagttgtgcctattgtccaccagtccgtggtctctccagtccaactttaaaagatccactttcctgccagggtcgaggggaggaactgtcagctggccatatgggctagaggaggaggagatgaggggaatatctagttcccctgcttttgctaattctgtggtaggaattaccttgcctttttcatttgtgtttttgagacagggtctcattctgttgcccaggctggagtgcagtggcatgatcatagctcactaaagccttgaactcctgggctcaagcgatcctcccacctcagcctcccgagtagctaggattacagatatgcaccaccacacccagcctgaatcaccttgtttttgaggctttctcccctgcagacacttgcagaatggaaaaagttgaaacttaattaccaattagcctattccaaaattttgctgacatctcaactctaatgtatctcctttctcattctttgcccttatggatttatgccttttgttcctttatttaggttttgggagaaacaggagaaaatgcaggtgttcaatctgccgggcatgacaagtggtctcaatttagcttccatagaaacaaggacttttctccttagtactcgatttttgttgctttatgtaatacttaatcaaatgatataattacaatgacaagtacaactggcataaataagtttaagaacaaacccattttggccgggcgtggtggctcacgcctgtaatcccagcactttggggggccgagactggtgggtcacgaggtcagcagatcgagaccatcctggctaacacggtgaaaccccgtctctactaaaaatacaaaaaaattagccgggcgtggtggcaggcgcctgtagtggaggctaaggcaggagaatggtgtgaacctgggaggtggagcttgcagtgagccgagattgcgccactgcactccagcctgggcgacagagtgagactctgtctcaaaaaaaaaaaaagaacaaacacattttgactcttggtaaatatgcacctcagttagtggggacagaagtatgcgggcattagtcattttacagaaggaatgagagttgtggttaagttgggcaagttggattaaatggagattagtcaactgagtttctattttaaataaatgaatataaggcattcattaagagggtgcattattgaaagtctaaatgatttggcttcttggacaaccaatttaactttaaagaagctaatctgtctttttttttttttctttagaaaagaatggggtttcattctttttgcccaggctggagtgtagtggcgtgatcacagctcactgcagcctcaatctcccaggcccaagcaatcctccctcttcagcctcccaagaagctgggactacagacacataccatgacacccggctaattaaaacacaatttatttttgtttttatttttttttttgtagagacggggtctccctatgtttcccaggctggtcttcaaggctcaaggaatactctcgctttgtcctcccaaagtgctgagattacagttgggaaccaccgtgcccagcctaatcggtgttttaaaaagccttaagcaaacaactgcctttctgggatcagagtcttttctgcactttgacatgggtagtatcgaagagtccagagtaacctcctgactcttggcccctgctctgtcctaactcccaacaatccctgcctctgcctttatctcctagtggacttttgagctgctttgacctcaaagaccttggtttgcatgtatgagtcataccttgtgaggctccctttcataggtacctggctgtctagcctctagcctttggggaattcagggcagactgacttgtctttctgttggcttcctccaatgcaggatgttagcttcagtttctctgctctacgtcagttatccattctttgttttccatcttccataattctgacattttccatctatcatcacctgtatttgtctttatatttgaagagtttatatctctattttattttattattattatactttaagttttagggtacatgtgcacaatgtgcaggtttgttaccttcacagatgggaactgaacaatgagaacacatggacacaggaaggggaacatcacacaccggggacatcttttttaaaaacattgttatccctttactatcagtttaatggaagttctgaggggtagagaatcactgcttctcttgagtaattcatgtttgactttctctctactgtggtaggttcctatttcctaagctgatatttccttcatctcctgattcttctgaaaacaggagtctcagtttttagctttctagacaatttgaaaaagacatctactcagccttcagagccctatttgttctgtggttaatatgcagccagaaacaagtcaatgtaagtcagcttttgcaaatatcaattagaacttaggggatgtgtcaggataaaacttaaagtgtaattagtttaagtcaagctaactctgggaaatttcctcttgatagaaaaataatattcataaggtcagatgagcttttctcctttgactgttaagaagggaatatttagggattggaagttaaaattttccttagaacgagatttagatttgtaacatttcctaaactcacagcaattgtttttttgtacaattgcatggcactttcagtttcaaagatccttttttttgggaggtgggtagaacttaaaataataccttccatctttagtacagttgttagtggggtattggttccaggacacccccacagataacaaaatctgcagttgctcaagtcccttatataaaatggcatatgtagtatttgcatgtaacctatgcacattttcctgtatgctttaaatcatctctagattacttataatacctaatacaatgcctacacatcacttctttcacatagattcaatgtagtactaggtgaacagcaaattcaagttttgctttttggaattttgtggaactccccacccccaaatatatattatatattatataatatatataatatatattttatattatatataatatatattttataatatatattttatattatatataatatatattttataatatataattttatattatatataatatataatatatattttatattatatatactatatattttatattatatatactatacattttatattatatatactatatattttatattatatatactatacattttatattatatatactatacattttatattatatatactatatatattttatattatatactatatattttatattatatactatatatattttatattttatatactatatatattttacattttatatactatattttatattatatatatattttatatataatatataaatataataatatattttatatataatatataatataatatatatgatatatagtatatatattttatatattatatataatatatattttatatattatatataattttacatatatagtttatttatatatatatatatatatatatatatatatatatatatatatatatatatttttttttttttttggggacagcatctcgctcagccacccaggctggagtgcagtggtgtgatctcggctcactgcaaccactgtctcccggtttcaagcaattctcctgtctcagcctccttagtagctgggattacaggcacctgccatcatgctcagctaatttttatattttagtagagacagggtttcaccatattggccagactggtcttgaactcctgacctcaggtgatctgcccacctcggcctcccaaagtgctagcattacaagcacgagccaccacacctagcctcccaccaaatatttttcatctccagttgattgaatccatagatttggaatgcatggatacagagggctgactgaatataactttttcacatatttggggttttttttttcctgcagaaatgtaatctgttctttcagagtagagattgtttctgatacatcttagcatctctgagtgccagaatgagggcgtaccataaggtcaggcacatagagcttgtttaatctttctatcaagccatgagtgaggaactactataactctaattttataactgtggaaactgaggcacaagctacacagctgtagtaagaggtagaggtaagaggtagtaacttattttacagagggaatgaaaatggtgggtaagttggacaagttggttcctaggatagcaccaagaggaactgactccactgattaaccaggttagctgcctcctacccaagcacactgcaggatttgccttcagtgacaacatgcaaggtgctttctggagaggcatatctgggacttcatggagcttgcagaatcggttgtatggctgctggctaataggtgtttgacaagtttggcctgagactatctttgaaacataccacctgaagcgtggttgtggagaagccccatagctcaatcttatcttaactattggaggctactgatacctgccttaaagatgttattaataataaatatgaatgaccaaattgacttaggttaatttgtaacctccttctcccttagttatctccagccgaaagaaatctagtctaagagagtcacaaaatatcttgtgaaaatttaccacaggcctcaaacagagactcgggggactgaagtctctgacatgaagcgcttcctgcagggtataagcatttggaacacgggtaaggcctatgggctaaaatctccagccagcagcggttagaaattcaatgttgtccccaagcactttagatctcctgagtgttttgaattccagtgggaagggagttctgataaaaggcagctgagtttggaaggattgtagcctcaggatggctcctctgccttttgacccatggttgaggaaattctgcctcagcagccctgtctccctttctgcatccatctcatagtccccactggtgatcccccatctcaagtagcaaattccaaagacgttggagaatgttggccttgttggttgtctcatatcagaaataatctgagagttgcttgtgaattgcaggactatttagattttgaggtcagaagcatagaactggtacttttttttttttttgagatggagtctcactctgtcgcccaggctggagtgcagtggcgcaatatccgctcactgcaagctctgtctcccgggttcatgccattctcctgcctcagcctcccgagtagctgggactacaggcgcccgccatcacgcccggctaattttttgtatttttagtagagacggggtttcaccgtgttagccaggatggtctcgatctcctgacctcgtgatccgcctgccttggcctcccaaagtgctgggattacaggcgtgagccaccgcgcctggccagaactggtacttttaaaatgtctttttattttttaattaattttttttaaagaaatagagatggggtcttgctatgttgtgcaggctggtcttgaacttctggcctcaagcgattctcctgccttggcctcccaaagtgctgggactacaggtgtgtaccactgtacccagcctttaaaatgtcttaaaaagtgaaaaactatatttgaatataaataaagaattaagaacaacaacacttgagtatcgagactatattatccaatacaattgatgaaactatagaccatactctctagactttcacacaagcttttcagttttaatttcacataatttgaaaagtgatgtacatgtgactgtcgagcatttgaaatgtaactcatacaactgaggaactgaattttttattttattttttaaagtaacttaaatttaaatagccacttgtgagtagtggctaccatcctggtcaccacacatccagaacatggtgataagcctgtatcaggatagtctaggttatgttgcagccactgagaaccccaaaatcttggtgatttataagaacaaatgtttatttcttgcttgtgttatgtccccattttgggttggctagagacccagatggctgcagcagccaccatctcatgtgttgcccgtcattatggagaggcttgtaccagcacataaatgctctggtcccgagggtacatacatcacttctggtcacagctcactgactaggactagtcacatggccccatctaaccaggaagccgagagtgaagccctaactctgtgcagagatccttagcaacaactgccaccaacattagccccccctttcaaattacaggaaggagtcccaagggataaagagagtagtgctacttgtgttttcttgaaaaatggagaattgggtttctcacaactcaattatttattacctcctatgtacttattagcacagatttatcaaaaacaggtgaggtgtggagcaaaaagcaaatttcaaacattttaacaaaaataaaaaatctttacataaatttagagctgacaacagtcagcatgtcttattagttgcatgtaggaaatatcttttaataagatatgcaatgcaaggaacaatcaatggattattttttatatgtttgggatgaaaatgaatggaagaaagtatatctgttatttttctcagtgcagcatataaattgtacatttttcactagcaaggaataaaaagtcattttctttaaaaataataaattgttagggacatttgtggattgtgagtgtcttaaaaatgaaaacactaaatatttattaactggacaatggattgtttctttccagactacatcaaagaatcagagaattatctagccctacatttaacagcatgtcttaaactctttctagaccatccacaatattgtttgaacatctgaagacatggggaacttgccatctgatatctgataacagacttcctgtaaagcaggactggtagtttcctgataacaaattcttcaatatgaaggtatggataaagcatttggctgccaataatgaactgcaccaaagtcaccaattcaaaccatgccctggtaaatagtatcatcagtgatgatgatgatgatgatgatgataatgtcacatgttaaaaatgtcatatagattttagcatcttgaggacctgatactctgtaacagtggtccctaacctttttggcaccagggaccactttcatggaagacagtttttccatggaccaggagagggggtggttttgggattattcaagcacattacatgtattgtgcattttatttctattattattacattgtaataatatattttattataatataaaataagtatacaactcatcataatgtagaatcagtggaagccctgagcttgttttcctgcaactagactgtcccatctaggggtgatgggagacagtgacagatcatcaggtgttagattctcataaggagcgtgaaacctagatccctcacatgagcagttcacaatagagttcgttcctgagagaacctgatgctgccgctgatctgacaggaggcagagctcaggcggtaatgcgagcaatggggatcggctgtaaatatagatgatgctttgctcacttgcccactgctaacctccttatgtgtgacctggttcctaacaggctacttaccgggggttggggacacctgctctataagatatccttctagaatgattgatatagtactaagctgatgctcaagagaaattttgaactaaatgtgtaaattcggctacctatataaacaagaacttcctaaatcattctgttccatagcaaaacacaaccacataagccagttcttcacatctaggcaccacagtgtttgtttttcatttccaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagactaatatcaaaattctaatgttgatactgtgtaggattgcactgaagtaattttaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggccaatagataattaagactaacttttcagcaaactgatttctcctatattcaaacacaaaaatctttaccacacgttcagagctgatattctataacagcacaaataagaatcctggtttacaaaggaaaccacattagcaaggattttttttttcccatgggttcttaaccaaatgtctgaagctgctagacatctgcaaagaggggataagtttagatttcctactgattttggaagaaaaatattttcctaaggaagccagagtcatccatgagcagggacctgtcttcagaatcgaagaagcataatgtccttaatgcttacactcatgacaagttgagagtcagcaaaactggcaggtggaaggggaaagagaaatggagagtttgaacatctgcagtgtactttggaataaagtggctcaactgctttcagaaatgaattgctggagtactgggagaaaacccagttctctagagtcagggggtggggagagagaggcctcccatccccaggaaccctctgggctgagctgtggcccagaactcttgttttggccttatttttcatgagcgcattcaagtggagaatttatgactttgcccagataaatatttggtttggttactttctctctaaaatcaattggtcagtcaagttactggtgatttccctaaatgaaatctagctgcactagtatcttaaggtgccaactaacatagattaatgcccatcaataacgctgctaggtatcaactgctgtttctgaagaatcaacccacaaatgacctaaccgataatctatcacactaggtgcttttactatcttgagttttttttttttttttgagttttagagaaatagtccttttaatatgacttagaaactgcttttctctggctttgtttcactcttcttcctcttccccttccccttcaccttcctccatcgtttccacaatgagctctgctgtgcaggtggcttctccaagactgttgacagccttgcaggtgtacttggcatcgtcatccccgcaaacatcactaataattaaagagcagttcccgtcctcatcgtagtctatctggaagtggcgggactccctgattgactggtcatctttgaaccagacaacctcggggtctgggtatcctgcatcacagggagagaacacaagttgcaggaactgttattcaaaatttcttatcaactcatgcaagcaacttgtaagctaccactattgattaaggtggttaaggagaaaattttgatgttggcctttatcgactgttttgatatctacattagaatatggacatgtcttgtaaataccaatatctgaaaccccaaatagaatattttaaagttgttccatttcccacacatgttggactagcaccacatcccacctattaaaaaacttatttaatagtttttttatttttttaaagtgatgagtctcactctgttgcctaggctggagtgtagtggcatgatcgtagcttactgttgctcaaattcctgggctcaaacgatcctcccttctcagcctcctgagtagtgagactataggcatgagcgaccgtgctcagttaaacatcacacctttcactttttggggggtaggggggcagggtctcattctatcacctaggctggagtgcagtggcatgaacatggctcactgcagcctcaacttcctgggctcaagtgatcctcctccctcagcctcccaagtagctggagctataggtacatgccaccatgcctggctaattttttaaaaagttttttttttgtaaagacagggtctccctatgttgcccaggctggtctcaaactcctgggctcaagtgatcctctgaccttgacctcccaaagtgctgggattacaggtgtgagccaccacacccacccatctttaaacagacatagagtactacctgaggctaggcatggtggctcatacctgtaatcccagcactttgggaggccaaggtgggcaggagttcaagaccagcttggccaacatggcaaaaaaataaaaattaaaaatagagtactacctgaaatactgctccaattccaactctacacctagatctgaataccttcttagattgaaaatacaattttctttttccttttttttttgagacagagtctcactctgtcgcccaggctggagtgcagtagcgtgatcttggctcactgtaacctccgcctccttggttcaagtgattcttgtgcctcagccttctgagtagctgggattacaggtgcacgccacgacacccggctaatttttgtatttttagtagagacagggtttcagcatgttgaccaggctggtctgtatctcctgacctcaggtaatctgcctgccttggcctcccaaagtgctgggattacaggtgtgagctacctgtgctcggccgaaaatacaattttctatctttttttttttttgagacagagtctcactatgttgcctaggcaggagtgcagcagcatgatctcgggtcactgcaacttccaatgtccaggctcaagtgatccttccacctcagcctactgcatagctcagactacaggtacacaccaccacacccagctaattttcgtattttttgtagagatagggtttcaccatgttgcccaggctggtcttgatctcctggactcaagtgatctgcctgccttggccttccaaagtgttgggattacaggcgtgagccactatgcccagcctaaattttcaattttgtataatagtttaagtgaaataatttaaatgaaaaataagagtcaaaacaaaatgggaacaagggatctttttggagtgatgaaaatgttctaaaattggattgtggtataaattcattaaaaataattgaattgtgcatttaaaataggtgaattttatagtatataaattataactgaataaagctaataacagctatataaaacataatttaaaagagctgataatattgctaagaagaagaaagcaatatttgtcttagtctgatccaaagcaggtaatttgcctatggacaattggaaatggacctcaccaatgagcctttatgcattagtcatatctctgcaaagttcagcattaaaaaataaaatacacatgcatataaaatatatattatatgtatttaatgtgtatgtgtacatatatatgtacagaagcattaccaacattatgcattttgtttgcaggtacatagtatatacatgtaccccgcttttaaagtcatatatatacatacatttaaaaatatacaatatattccacctgactttctcttaaatgttggtgaagtatttttataggaaaaaaattgtagccctgatacggtttggatatttgtgccccttgaatctcatgttgaaatgtgatccccagtgttggaggtggggcctggtgggaggtgtttgggtcatggaggccgatccctcatgaatgtcttggtgcccttcccgaggtaatgggtgagttattgctctgtcatttcatgcggatctggttgttaaaacgtggcacgtccttctctctcgctctctcacttgccatgtgacatgcctgcttctgctatgattaaaagcatcctgaggcctcactggatgcagatactggcaccaagccaaataagcttcttttctttataaattttccagcctcaggtattcctttatagcaatgcaaacaggctaatatgagccctaaccagaataaaaattatacataagaaatcaagaattctaatgttcttttcaatgttgttttttcaaaataattttagaaattgttttttcgaagtaattaggaacacccagaccatgaggaaaattgggtcaggaagagctggtcataaagtaccctccactcccatgccctgcaccctcagtgcaaaagtttcaattttgtttttatcaaaacagcatccatatgctttaatttctcatcagagccccaggcaaaagttacataaatatcaatgaaacaattccaaagagaaaattaagtacgaaacaatcccaaagagaaaattaagtacaaaatgataatcattatgttattttaaaacattcaaaaaggaaaagaaacttcagaagacccaaatgcaatggtaatggtgagaattgcaagcagtggctccagagccttcagcagaatccccagtccgagaattttcacattatcaaaggcagcacatccactttcttttaattgagtgaggaaaggaaaatgactatggtaggcgaagcattgataaggcactttgataatataaagatgcagaagaaaaactattttttccattcctaactttgggttattttactcaaaaggcattgtctagtcacattgctggagaatcaaagaaagtgggaggcacagtttgttttgactgctgtactgtgctatgcggcctcgggaaagttgcctaataaacttctgtgctttatttggtcagaccaaaatgggtgataacccaccaccctggttggcaggtgaaagtcacagacttgaagcaaagagcctgtcttatcttgtcccttctctttctagacggttgcaatctatatgaaaatggaaacgctttgtgtcatcaactttgctcatttctcaggtgctatgccatgaccccttaaggtcccttgagctctgaccactgacaggtctgtggctgcattattcccagcaggcagataagcagcctggggaagatggtgccggctgagtgctttgtcccgggtgcctggctcccaactggcctcagtctgaagtcacaatgcatgcactctctctgtacctgccagtcccacaacttttccctttgctctgtgacatctttacaagatctaaaaggttcccccttctcacatatgtcccctcacagaatccccagagccactccgtgacttagctatcatcttacagcagagggaccgtaactcaggggagttggaccaccatccaaggtcacacagcctgtggacgagtagcagagcctgccgattccacatcctatgcctttgtgccagccttcctttgagggcctcatatgggcaagtcacatgcttttcagcagtttgcaaagctcatttcactaagcatgttccaaagccaggtaagtccatgcaaggccatttctaaacttaggtctagtggctgatgtaagtaggtgaaatttcaaatgtgccccctggggaagtgactgaaggacacaccttcaggaggtgggagtgcagggcatagccctttatgagcagctcctgctgacccagtttcccccaaagcttggcagttcctcattgtccccagctgcacagaactgacttcttgcccacggtgcatggtagggactctaccatccagccacaccctattcatggtgaagagaagcacagctacaacttaccttcaatcttgcagtcaaatctagcagcacttccctccacaacttctaaatcgcgaatggtcttagagaaatagggttttacatgaggcttttcctcagcaacagcctcaaggaaagcttgggacacatcttctagaagacagagaagaagaccaggtcatttcttcactcgttgttctcgcctcgcctctagcttaaagaaactaacttttaaaaaagttgctatgatttagcaaagaaggcagctttgagaactgaatcataagcacgcctttctcctggggacaggttggcctgctgccaaatggtttttggcagaagaaggaactgtgcccaagctgaggaaggatcagactcccccttccccttatgctgacatgttgaaagaggaaatcatctttaaaaaggatttctggctgcatttcatgctgctttaggattcagctgagggtatctgagcagggcaggacctcatcagccttcctagtcttggtatccctctgccttccttctgcagcaggtgttccacctgctttttacaagggaggagtcaggtcctagccgcatctttagcttccagtggctctttctccatgctcacactgccttcatgctgtgtgactgtggaccaggatgtgggattggttcagggaaaagctgtaacttggagggacacctgtatctcctcccttcccttcaggctatgtctgggtcatctgaggaggggcagaagtggctcaggagggaccaggcctgtgtgctgcagtctctatccctggctgtgaggaagctccagagcaggcagttgctggcctcaccaataaccctacctttgctcaccaagggaatctaaactcagattctcacctgtggatacaaaaagcaccaggcagggagggacagagggtgtctctggccaaatgagataagggtctggccctgcatgcacctgaagcaggaaaaggctggggttttcactgaggagatggacgggacagcatctaagatggtgagcaagtaactgaccctattagtctccaggaggagacctgccagtcccagtctgcccagttcaaatgacacgattcagcatcatgaacaatgccaaagaatgtggaccatatgagttaatttttatttaaaacaaaaccacaaagatggtagaaaatagaatattttataaatcttacacaactacatgtaattttaatgttatttttgcctattaatatagaatatcacttttgccataagaacaaaagaagattttaatacaatctttgttaattttaacacaaaatatatgaaaaagcatagctgaggtcatctagttctattagacaaataacaactttccctccgaaaatggttaagcttaaagttaaacgattaagaataattattagacttagtaattgtcagggcaacccaaaattacttctgaatttatccttgcagggaatattaaaataaaaaaaaaaagaacaaaaccaaccaaaacctcaaaatgcccctttgttccccagccctttctttctcaccagctggctggagaaactcctccttaccttcagattctagtttttctgcattgagcgggctggttggtgaccctgttgaggatttcctgccactgagccctgagatcattgccatagaggacagtcttccaatggctctcacagcattgcccgttttctggaaaatagacacgagggttggactcaggcgttgtccctggttccagctgggtagtgcgaggggctgcagggagtagagcccagccccagagaagcagctgttccctggaacaaggacctcctgagagccgaggttctgccagaggagcgaacccaaccttgctctgctcagcactgtcagtgtgtcagaagatgttcagagaatggaatggggcctggaactgatgtgtgcgttaatgtgactaaacaaggtcaacatgagacaaaaacccttttcatacagtgcttcaactcccataaaagggatggtttatataaagcaactgcaggctgagacagctccaaagacttattgctgactgggcctagcggggctatttctcgtaaaacaatgccagtgatgtgattataattggccaagagaatagttactacagatcccacaagtcctgatgcaaaaataatcataataataataacacagcatcctgttgaccttgggcaagtcacttaaccactctgagcttcagtctccttctctaggagggggctggacaagatgatctccaaggtcccatttagctctgtttataattcagagacttaaaagattttgagaaacactctggctggcccctgcacaagtctatgatgcagtgaagctctggagaggagctcttccttggtgtgcattcaggcaccaaaaagaagcattgaagaaataaaaggcaacggcactttgcttctcagtgactagacttgggagaggaaagaatttctgctgaaaaggatcagaacttgagatgtaatttatttacattgcgaaaattctaccaagcataggatccctaataatgtacaattgtgtcttattgtttcttatctttcagtaagtttttcaccttttttctaaggttaacaggaatgactaagataagaaaactaaggcacaaccaagtctttccacccctgcacccaaagcatcttttttaggcatcgaaaagctgtgcatctagacaacagatgtcaccacagactggctacttgtcctccctgagagagggaggaaacagcctcttcataggcaaatggcttgtactcgttgcatctcaaactctgccggcaaagccattttcctcctcagttcacttcacatgctcaagtacttcagtaaagcctcacaatttaggactagttggaaagccagtaagcttcagtaaaaagactgatcattttgaaagtgaataacttctgggtgctaaggaaacatacagaaaattgtgtgcgtgtgtgtatggttaaagaggagacctactgcagtgagcgggatgaccttactgtcatgcctcctgccatccttgctgcagactgctctcatgcactttggacagacatttcaccttgctctgtcccctggccatcccttctcacacacatcacactgtatggtgtgggtatgtttctggcctctgccaccacagtgaggctgggtcgctgaacagaatccacgcagccccaggtggaggtgatgaggaggggaagatggtgagagatgaaaactgaacaacttaactgtgcgcagaaccaccgtgtggccctgcggagaatgcctctgcaggctcaggccacgtggcaacctttcatgctcttctgggagatgttactggttcaacctgtttgttgtgctagacaaagtgtagagagagagagacccagctcttcccatgggaggttaccctgccctcaggaacaggtaagaggtggtaccagccatggcagccctccctacgtagtcaatgtcagaccagcctgcttcctaatcaacccgattctcagactcggcccttctctgctctccattccctttatccaacacagattggtttgtcctgggctaggagcctctaaacccagagggttcattcccaacaagggacaggttagttctctaaccctaattgctgggagaccttgtgcaagtcagttcccctctctgggcctcagtagcctgggagcagaagattctaatcttcctgcagttccagacctctacagaacgactctggtttatatccataaatgtgtagcaaggaacacccgccttgagcccatgggctccccaattccagacatcaggattgggactgatgaggactgtcttcacctgtgtggtgtggcgagacgatgtcttttttcttccagattttatttcataacaaaatgactaaaatgaagctatcagaatgaggaaacaaaagagttatagtatttcagaggaagtagtaaatatattaacaaataaatatgtctcacatagggagaacttttctaaaagatggagatatccagcatataatttctaaaacatagaaaaatatttgggaattgatttgtgaaaaaaaattgccgaggaagttatttgtcagaactagaaatgaatatatcagtatgttctagtcttccagttttatgcctttgagctgacaattggttgttgctttactgaccaaagacctttggaaatttttggaacatcaagatcgccaagttttgattttgtaatttctccctttttcttgcttgagggcaattgcccaggctgggttcctgtgtcgctggtgagcagtatctgcaccagcctccttcatgcagcacaaattccctgccccttggagagcttgtggggccagccatcctggcttgcccaggcaggcttgtggagtttcccaggattagggtcttttggcaccaatactaagacattccctgacatacatacagcaagctggttacccatcaaagccccccatatataccagtagccccaagactacagtttcccctgagcagtgcataccatccaaatgggatggccaagaatactccgtgctatactgagtccagtgttttctcccctaatgcccttggtccatactgctggggtctttatggttcccagaaaataaagatggctacctaagggcctctgatgtctagtcttttgcttccagtgtgcatgcggaaaccctgttaatctgctcaacctacctgcccccattgctacacctttccaacatatctttgtaaaattcttttaatataaatttaaaatataccttctttcggaataacttgattccaagatgagtaatatgattagtcatctatacccagcctagctttgcttgtagggatttgttcccatgtcacttcattccttctagggctttttatgaaaaccacaccagaataacaagaaggtgccttctctggcacagctgcagagagttctgggccacctgagcctgatcttcccctctccctctgcccccgcccacagcccactccaccccactgcacagaaccttggctgctgcaagagggaaccctcatattccaaggggagctaaggccctggtgattgcagttaaaatgcagaaaacgttttcctgagggagcaacgtaacatgaaatggttagagctgttaccagggaagctactcttcagggaaactacttgttgaatggaatttttgtggacaacttttgtgtgcaattttgtggaaaaatcatttccaaatgtcgccatctatactaaaatataaaattaaggttcattctctgaattctacccttttcttcccccgcccttccagaaaaccctatggctaataatgccgtaaacaagaagaaaaaaaaattgattaaaatatcagcataggctgggcactcaacacttcgggcagccaacgcagcagcatcgcttgaggccaggagttcaagactagtctaggcaacatagtgagaccctgtttctaccaaaggagaaaaaaaaatattagccggtctggtggcatatgcctgtagtcccagctactcaggaggccgagtcgagaagattgcttgagcccacgaggttgagactgcagtaagctatgattgtaccattgccctccagcctgggtgacagcatgagaccctgtctctttaaaaaaaaaaaaaaaaatcagcaccactatgattccctgactgatttaactgaaaaattccctttgcctcctctcctgtttcctcatctcttctctgctcctagcccctgggtttaggcatcctcctggctttagttcatctgcagatgttcccaggtgataaggctgccccttaacctatagcctcagccaagcaatatccacttagactcactgctctgaggactgccccgccctgacatcagcttccctatcctttccagaaatatttctttgagacctgctggctacaggattattaatacagctgactttgactttgtagatcctcccccacatttttaaaaagaatatttgctactcagatcctagtggcaccaaaaggtaagcagctacagatgtttcaactcaccttgcacttgagggaggcctggagacccaccttcccatgaggggtgtagccaggaactgacttccatggtggaggagcacagctgatatgtgctcaggatggtggtcacttaaactccacacttgtggcccccattcgcctttgctccctctttcaacctctgagtgacactctactttctgaggcaactgtgatttagtcacctggtgtggtaaatgaccagtgttccagttgcctccaacacagtgatttcccttttctttgccacccaggcaaagtctcaatgcccctgggtcccttgagtatccagctaaaagactctgctcctgtccagccaagcccagccggaatgggtccggctcccacctctgtgccttctcctccacctgtgcagtcctcttctctgtattctgactgaggttccacacctaattcaaactcctgcacctgggagcatttcctcataatcacatccaactctggttgcgaccaggtccgttctatccatacacacccatggctatggagaactatccggatagtttatacatcttggtgcgtgttacatcctttcatgtctagttgcttcagttccccattgcactacgtagtccctgagtaaggaaaccatgtcctctcaattgcttgaacctgggaagcagaggctgcagtgagccgagatcgtgccactgcactccagcctgggtaatggagtgagactttgtctcgaggaaaaaaaaaaaaaagaaaccatgtcttctccagcagcctaagaattgtaattctaggtcgggagtggtggctcacgcctgtaattccaacactttgggaggccgaggcgggtggatcacgaggtcaggagattgagaccatcctggctaacacggtgaaaccctgtctccactaaaaatacaaaaaattagccaggcgtggtggtgggcgcctgtaatcccagctacttgggaggctgaggcaggagaatggtgtgacccgggaggtggagcttgcagtgagccgagatcgtgccactgtactccagcctgggcaacagagcgagactccatctcaaaaaaaaaaaaaaaagaattgtaattctaattgtggtaataaaaatgataaaataggtgatgatggtgataaactgaaaaacatcctgtggttttggataataattttatccacccatgccttttatcagaggcagtcttggggttaagactatgtgttttgcagtcaagctctgggtttgaatcctgacccttctgcttattagctgtgtgatcctggatggctttcctaaccttttctctgcctcaattttgtctgtaaagtggggataataatagtacctgcctcctagggttaaaagatttagtgcatagatagtgctttaaatggtccctgacagatggcctaccttcatacctattagcgactgggatcgcttctggacactcaccatgtgccaggcattgtactactaaaggccacatgaggatgatctcgtgtaattctcataattatcacaacaatgctgtgaagttggtaccactattatccccgctttatagatgagaaaaatccacagcaaggttacatcatttgctaaggacacatggctattaacatacaaccttcctagatggtgggaccatgtctctctctttagatcatgtgccctccttcatcataaagaaatgtgaaaccaccatactaccaccccattctcagggttgacaaatggaccttaaagtgatgttgctcatcccaagccatgaagacacaaaatgtcattggcttaatctgaataagggtttacggtcccctggggcaaaggtgagcaggaacagagagacagctaagctaagaatccatcccatctccttgagaaagggactctgcactcaggactaagcaaaccactgtaccttaatcagctgcctaaattggtcccagactacttcagaaataaatttaaactttcttggtgtgaggccagggcaagctgggaatgaaagtggcttgaacaacacaaatatgaggggcaacatcccagtccaaagtgaccctctcattacctgccatttccttcttgccatgtacttcttcatccggtccttggagagtttcttggcctccatgttcttggtatctttcattagccatggatgctgaaggcactgcgtgcagtccaggcggtttctgacagaggcagagatcaggagatttttgagcaggaggagacctcagagaccactggttagttcagaaatgggaggccacctgtccctggtcatgagggcagagcccagggcccctgctcccggaccatccaccgtgatcaggatcactgtgctcttcacctttctcctcacttggtctgggtcacactaaccagaaccagcatgggttggtgttaatgaaagcccaagcaccaaggaagtgactgggctccatggcctgctcttgggatcgaggaagagtaagtgctgcagggcagacgtttctgggattggctggcaccctattccagggtggcgtcattctgctcctctcatgagggctggggcccacaaagcctaatcctcctgccaccctgtctggaggaggggagagttaaatcctaggataaaatctccgacaatcactgaactttcatgtttaatgtcttacggtgttgttgaatatcaggtttttccattacaactcaaagaagtaggtcctgcctataacctatgaattatgactactttagaactgcgctgaaactcacttcatctttctgaaagctctggggatctagaaacattttagagccattgccttaactgtaacaggactaggaaagcctaaagaaccaaatgctaacatacatagaaaaatgactggaaagaagtatagcaaaatgtagtgaactttagataaagggattatagatgatttaaattttattatattcttcaaatcctctataattttcatgcattatttttatagtaggaaggaattttttttttaagtgctgataggtggtgatttctggttgaagagaggctgggtataagagtttatgggaatttagtgtcttgatctatttgaataagatcagttctttggtgaatccattttatgagcacagagggatccagtacagcctgttactgacttaattcaaggtcagatgagaaaataagatatatacacacacaataccttgtttaccaaatcttcagtgaataaagcttggatgacaaaagccatccttgtaccagagttactgaggaggtttccatctcctgaggcaccttgggtgtgggggtccctcatattggaagagaatttagacttcccacagtatctcagttctccttgggtcatgcccatttctgatacagactgtgacagcaaaaggctaaaaagatctcattgtcaaggagtgtagaatgtggcctctgggggagtttggccctgaactggctaaaaaggactgagagtggggtgcatcacaggaaagcctgacagagccatctgagacactccaatattgctccttcagcaactaactgtgccttcctgccccgaacagccattcttcctcaggggagccatcggcagccccgcaaggctgcaaagtcacctgggagtgcagagcctcctgcccgccctggagccaggcccctccccttctctctagcacgccacccatgtcaacaccacccttcttggcaaggctacaactgctccctgggattgccaagtatagctccaagctcctcggcacccctacagtcaggccctgcctcatctagtcacctatttgcagagtgggtgagctgcccaataggccagctgttctcacctgagtcccactgctccctttccctgggcagctctccctacacatgcagagcccaggacagttccttccaggagattctgtctaggcacacccactgcccaccttcagccaacctcccactctggtctcctctacaactccaagctccaatcttctactgaaacccagagggcttgagtgcctgacctttccccacagcccatgcatgctgacctcccactgttcactttcctatgttcacagctgcagcaggcacaggtggggaacctcaacagaggaggagctgggagagggctaagcccagtggtctgggatcatagcctccctttggccagatgttagaacgtacctggctgtattcaagcaggcagttattaaataactgagatataaaaaaacactaagccagaataataataataatctggggatatgatcgggacccacagagaagttctaagatgcccgtgtcctctgctcttgcttgttgagagggtccttcccctgcagcccctgaagagggctgtggctggccacaactgtacccagaaaataagaagggtggtcattattcacacagaacagctgccccttgctctgtaacgtggtcaagtgtcgcttttcaagtcaggtgtctgagcctctgaaggtgaatcccatgtctagctccagggggcagggcctaggaagtcgcctccccaacccacatgcattcgggtctcttaccatgcccaccctcccttcctcagggaatgctaggaacgacccaaggcggggtggcaaggagggcaccccaacaggcaaaggaatccccctttgcttcccaacacagggcagggagtagggaagcaaagactgaaatcccaactcattacttcatatctttcttcagcagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggagagacaagagcaggacagcaggtgtggctaggagagggcgcgacgaccaggtgagtggtaactgaggtcaaaggcgagggtcggccagcctccccacccccaaactcatgctctgtgggccttgcacctgcctttcttccacttgtggaaagaaaagagggtgtggttcacagccctgtcttttcttggtcacctgcctcttgacaccacctacctgtgaggctgaggtgcagcaggttggctttagattacgggcttctgcagggtacgcggcagggctgataagtccctctgtcctggttttctattattccccaaagcccaggctagagccttctccaagccccttcctcccgtgctcctgccccctctctgtggactgggcacatggtagtgatcaccactgcacccttctgtcccctccttcccacctctctccacacaccttcagctccaagaagagggcccggcaaataagagaggctcagcaagtgaagtgtgtgcccaatggatagatggactttgaatcagcaatgtaggttcggggaacttgaggcatttatgccaaactagaaaacttccctatgaggtgccatggcagaggacagagtgcagcctctccgcttgctgtatggccttggacaattccctgatctgtgtcagttttctcctctaaaatggagaagctgccatttaactatagggtggtcacttcttcatcctcatcatcatcatgatggcagcagacattcattgaggtttttctatgtgccaggcactgggtcaagtgcctaaaacaagtgaactcacttaatcttaacactgccctatgatgcaagtaattcttataactttgttttacagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttagaccagcacagttgcccacagtcccacccttagacaggccctgtgcttggtttaatgctctgctgctgtcgtctcaagattctcaataaggtttgaacaagtggccccacctttcatgttgcaaattgtgtagctgttcctgccctgatctcagctgagccccatgagatgggtctgggggccaggcgtggtggctcatgcctgtaatcccagcactttgggaggccaaaatggatggatcacctgaggtcaggagtttgaggctagcctggccaacacggtgaagtcctgtctctactaaaaatacaaaaattagctgggcatggtggcaagcacctgtaatcccagctactcgggaggctgaggcaggagaattgcttgaaccctggaggtggaggttgcagtgagccaatatcgcaccattgcactccaacctgggcaacaagcgaaactcaatctcaaaaaaaaaaaaaaaaagagagatgggtctggggccctcctgccatcaacctgtcaagttagggctttaccaatgtcccttctcccaaatgcttatgaatccatcatcataagccaagcactgacagcttcaggagtaaggctttggttgagtttgacagaacaaaccccacttgaaatattgggagaaaaagcttgccatgggaggaaccctctggtgaaaccttttgtaaagagaagaaagcttttacaatgtgaattgtctcatcctaatcaacatatttgtgtttctgaataatagatctttgtggatgggatttttttttaaagcaagaccctgatttatgttttaagaaggcaaagagaatcattctcggtcatgtccccatgagggaagggtgggcatttacctgtccccgagtctgcactgttatctgctgctcctttcccctctctgggcctcagtttctcctttttcttttttttttttttgagacagagtgttgctctgttgcccaggctggagtgcagtggtgcgatctctgctcactgcaagctctgccccctgggttcatgccattctcctgcctcagcctcccgagtagctgggactacaggtgcccaccaccacacccagctattttttttgtatttttagtagagacggggtttcacagtgttcgtcaggatggtctcgatctcctgacctcgtgtcgtgatctgcctgcctcggcctcccaaagtgctgggattacaggcatgagccaccgcgcctagccagcttctccttttatacatcaaggggactaggctagatttcctaggggcctcccagctctctctgtctctgtgaccccgacccccacgtggcccatgcaagccccatcaggaagcagcctgtctcttgcctgtcagccacctgctgcttctttacattttccactggaaacagagaggggggaagtccggcagtactccaaaagatggcaggaaaagcaaacaaccctgctgtggaatgcagaaagttccccttctgcaaacctcccttccttattaggaactataatcctgcaaagataggtcttaatctctgcaactctgggcacagtcagggagagcctcctcgcctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttttaaaaacctttttggggaactttttctttgtggcagaatttgcataagggatcatgtcttttaatttttttttttttttttgagatgcggtcttgttctattgcccaggttggagtgcagtagtgcgatctcagctcactgaacctctggctcaagcgatccttccacctcagtctcctgagtagctggaaccacaggtgcgcgccaacacacctggctaattttttgtattttggtagagatggggtttcaccatgttgcccaggctagtctcaaattcctgagcttaagcaatcctcccacctctgcctcccaaagtgcattacaggcatgagccactgtgcccagccttgtctttttatttataaaatagtcattattattatttctttttatttttttgagacagagtctcgctctgtcacccaggctggaatacagtggcgtgatcatggctcattgcagcctcaacctccccaggcttaggtgaccctcccacctaagccacccaagtagcagggaccacaggcgcacgccaccatgcccagctaccttatgtatttcttgcagagatggggttttgccatgttgcccaggctggtctcaaactcctgggctcaggccatccactcaccttggcctcccaaagggctgggagtataagcatgagccactgcgcccagctagataacagtcattatttgttaaaaaaatcaaccggtcaacaaataatgttagcattaaaacacctctttatctccctggtcttatctagtttttaactaatggattgatctgtttttcacaaaactataatcagtctgggcaagtccttggatgctttactttttcttcactggatgtatcaagtacagccagactctacatgttgatttttagtggtcaaatattagtctttgtgctgatgaaacacaatggtcatgaatgcagggcattctaatttcttaattctcagctcattgccaaagaaattcccccagggaatctgatgtggaagcctgtttggctgtgggggcagaaggttaggagagcagagggtgcagaaatgcctcttggactacactttctgtgtgtgtgtgtgcgtgtatgtgtgtgggttttaagaaatgggggtctcgctatatcagccaggctggtcttgaactcctgatctcaagtgatcctcccatcatagcctcctgagtagctgggaccacaggtgcacactactgcacctggcttctgtgttgtgtttcaagcagcagacagatgccccgactgtaccagtggccagctaaggggaccacacatctgctgatggaactactgactgctaggaaggggttagtcttttatccatattagccatctgatactctggtgggagagctgagagggctgagtaggtccacaggaagagctgtgcatcattttgtggactggccgaggaagcagcgacctggggtttagttgtgttagtaaaagttgaaggtggtggccgggcttggagagggaacagggatcctagggctggaatcagagcgtatttccaggctcagcagcagagagggcagcggcagccccaggtggggaaggcagaggttactggatctggctgaggagccctgcagtcagaccctggtctgaggaggcccccgatgccccggcactgtgacccctcctcagctgactgggcagctgtcaccagaagagctgacctgcctccccaccatacacacctctcctccctcctggcatctcccgaccacacaccagggtggggagggacagctgacagctgtctgcaccacggtgggtgttggacaaacaaacaagcatgaatgggaaggctgtgctgctgggcctggtcaggaagaggcaggaggaggaagcagagcagccattgctggttcgctctggcttgagggaggctgggagagaaggcattgtggagtagggtgagggaagggctcggagaagagctgttgtggcctccccacaggcagcaaggaagtaccaagtccaggaagtaggggagggagacagcagggggaggagggctcttaaacggaggtggacttaggatttctcccgtatggaagtgtggcctccagctctctggtattctcacttcctgccagaaaccacatgggtattgctaacttcagaaggtctctaggtactcacacaacctactatctcctttcaggatccggggtaagagtgtgggggctccacgaccccattctgctccttccctatagggccagaaactgccctgatggctgggctgggtgggagagagtaaagtcacatcgtcctatggtgacacggtctgttgccttcccttccaactccctggcctctccatctctcactggccccagaaaggagaacaggaggggctctgtggtacaaaggtggaagtcgccctgacagggactgcccgacagatgactaggctccaaagagagggatagagtgggccagaggatgccatgagggccaccagagagcctcttttgggtgctcccagcagtggctccagagttctgcatagcaggcgcttaaaggaaaccatctccttggcgccaatgtttgttttcagcaccgctctctgttgagagccctggcttgccgggggaactccctgacttccatccatgctgagagagccaggctggaaaagccccagagggcagtggctcacagtgggggtccaggagctaagatgtggcacaggattgatccagcctgagtcagtgccacctggcctgggtccttgccacacacacacccctcctccctcctgacaaccctctgcccaagcactggcagcatcaaaactatcttctccccatttccaaaactctgccctagttcttggtctttgctttaaaagtaatctggtaaacaaggtaacatagtgcccaaattactatgttcctccaccgaaaagaactctcatttgacaataaagtgccctatgacccaattattctagttctagattatatatccaacagaaatgtacaaatatattcactgaaacacgtgaaccagaatgcttccaatggccaaactggaacccactcaaaagcctatcaaagcagaacggataaattaactggattatattcacacaatgggatactacataacactgagaataaacagtctacaatgacacatagtactatgaatgagtctcacaaacgatgtcaagcaaaaaaagccagacacttctttctgtatgatttcattgacattagccttgagggtaatggtgacctctgggggttggtaacagggaggggtgccagagggctgtgggggcctggcagtgcttggtttcttgatccgggtagaggttacacaggtgaaaacttagtgagcagtctagtcactgctctgtcactgaccagtagagagaccaattgtcctggtttgcctgggactgttcccatgttagcaccaaaagtcctgtatcctggcagactgggacgactggtcccctggcccgactgtgggaagtgggcagccacgtgggcttccttggcccctgtcacctcaacgccacatgaagatggaatccctgccatgatccactcttgggtttgttgtgagcatcaaacaaggtcctatgtgaaaatctgtagctgcagaagatcctgatgccacggcagtgggaaaacccactgaagaataaacagtaaggcaagtctccatgacggctggagggggaccctgggaccaagcgagaccacagcgcagctggggctgaacagtgagagctgaccaaggactgcttctcaagggtctggtgtttttcccagggccagaggttagcactgcccaggcctggggccgccctgaaaggggcaggctggccccgccccctaccctgctgttccttacttatctagggagccagggagtcaagctccagtccagctgctgtcttcacttgtcagcgccccttctccaagagggggcggggcagggaaacaggcagggaaatgcacacctggcccggggtttttctgctgatctggggaaggctgtggtggtggggctaatcccaggcaggaaagaggataactgtctggactacaatgcctgtggtgcaggttccactgaggggactgtcctaacaggctatagtgagtaaagttcctgagcatgtgaaaaagtcacattgcacaaaattcacaccacttctgctaaagcttttataacactggtttctaaacctggctatgcatcagaatcgcccagaaccttctctcacactggagtctgaaggccccaggggtctaagaaagtattcatagaggtcttcctcattttctatgaaaatgttaaatttttccttttgttctgacagtaaaaacattattgaatgaaagcatacacatctgcatctttggggacaccatcccataactgcatgtggccacacaggttcaggggctaatgaccgtccgcaccctggggcttcagggactaaagcagccagaccccaccgacagagtgttctcaagccttgttactcagagcgcagtcgttgaaccagcacattcacaaacctagagcctgttagaaatgtggcattccaggtcacccagacctgaacaaaaaccctgcaatgtaaggagccgcctaggtgagtcaggcatgctaatgtttgtgaagtgccggcctagatggctggcctcccctctcctgcattattgttcattgaaatggctttggatttcccacctgatttttcagttctaattactgtgttactttcttttatctgttagtcccattgaaggctcgatcatcaatagtgtttattaattcatccatatactagactcaaagatgaggctagtagttggggtccccgtgccttggggatggagtgctatgccctgaagacaatgaggatgcccagagattcgcccctggcctcctgccctccttctttgtggacccacacaagtgaggttttattacttggtgccagccacatttcccaccctcctgaccaaaggccccaggctggccagccttggggacagtgagcacccagaatggggatcttagcatgtgtagctacatgatgctatagaatatgcatgctactgactccctgggagcccaggagcagggtgggctgccagggataggaggggagcctgccaccctcctgactctggggggggctccccatcatgacaatggcagggcagcctggggaccctcctgtggaaccctcagcccccacccactggtccaccaagtggtccaccagtccaccaagtgccccaggactcacaggatgtagcagatgaccccgatgctccacatgtctgtggcgtagccgatgggctcatagttgatcacttcaggagccacaaattctggggtgccaaagaggaccttcagagaccccgcattctctgaaaccaggatggagagggataaattgccagcacatcacggagccagcttgagaccagcagctgcccgaatctgtgtgttgaccccaacctgggaggggccagacacaggctttggcacagagaacaggcacagagacatctgacctccttgttaaacaggtgcgtcaacacaccagtgaaaccaacaaacctcacactcacctcaaatgtcctgtgcagggtgggcagggggagaagaggccgctaaatcacccgcccctgaatggtctttttgtgagtctgtctcatgagttagttcccctaggcagggactgtgacttatgcttaataataatctctagcattcactatgtcctatgtaccccaccggcagctttacaagggttctcacccaccccaaggggtaggtataatgcccgtgctactgagaacatgagtgaggcccagggaagtgcagtgatttccccacccggttaacaagtggtggtcgggactcaagcccaggtagtccaactcctgagccatgcttaccaccgttcctccctcctgcctctcctactcctcacacagcttcatggctgtccttcaggagctactggtagggtagtcgggagaggcttcaaccccagggtggtacctcttggccataaaggaccagagatgtctgttaatatgtgcaaaaggcaggtacctgtgggctatgcctggtcttgcttaacttcgcagagctcacagcaaatgttctaaaacaaagcatttaacagccctcagatgtgaaagctctgctccaattcctgcctctcagccctttctgctacattttagccacttctcagttatctggtccttggtggacacggttgttcccacagtatccctcaccagtggaagctggacattgtgttccctgggctctgacactgccgactcctgaggacagtggcctatttgtttaatttattggtggtcactgttcaaaggcaggccctgtatgccagccactgcccctaccctgtcctcttagcaggagtgagcagagcagagcaggcacatgcgcccagcgccgaggcatgtttctcacctgactgcgctgaccaccagaccggtcatagtctatcggaacctcgcccctgcttacccctttcctctttatgaccaacacagcctcagccagcactgaacatcgtgggagacatttattgggtggcattcatttggcccctcctttctactacctgcagggtggtgaaataaagccagctcaccccagccctcgggctccttgctagcagggcagtggctaagaagggaggatgaagctgtttcctcaatcaccgggacatcaaagggctgcagaggcaggctggatgcaggcagaatgtgagccaggcaggcatctaccaaagtgctttcagggcggccttgagaccctgaccgcctacccctgtgacctctctcctggctagcataagaatcagaggtgctgcagagcaccctgagcaaggtctggggtccttgttccaatcccagcacatcccctggctcacagtgggacctcctgggcaaagctattgtgaacctttgtttcctagtctacaagttggggctcataaaatctaccctgctcacctcatggtgagaatcatagggtttattttttatgtgaaagtgctctagaaactgtacagtatgatgcagatgtgcagagccaccatcaccaaaatgacttttgctgctaatggcaccagagtgaaaaacaaaaggggataatcatcatcatatatacagctaacacctaagcagtcttactatgtgcaaagcactcttcccatccctttacctatattaacacatttgatcctcctaacaaatctgtgagttaggtcctactatgatcccacttttctgatggggaatttgaggcttactgtcacgtctagtatgtggtaggggcaggattcaaacctgggaagtcttcatggtctcggatttaaccccaatactgtatgtttcctctcacactcagtgtgagaggaaacggccagtgcaatacacactggtgtccatgggagaggcagatgagccttacccagcctcctggccagaccaaagtcgatgagcttgatcctggtgcccgtcttgttgacacacatgatgttctccggcttgaggtccaggtgcacgatgccctgcttgtggatgtactccactccctccgagatctgccgcatgtacttgatgcactcacgctccgtcagctcaaagtcctcgtcaatgatgcgctcaaacagctcccctcctgacacgctgcgggaacacgtgcacggggtggtcaggccacaggctcatggaggccaggctggcagggagtctggccagggtaggctgggggtaggagaaattggcaggaaagcccagggaatgggggtgatgggcaattcctgaatccccaccctccgacatgggagaagggtcagggcctcctggtttcccatcagggaaccctgccctgcaccttctaagctgctggggactcagggaagcatctacactaggcagtttcagaggtgggtgtgaacacagagatccagacatgatcttcttagcaaaaagagtgacctctaaacagtctctttccctcaaatgaccacacatgcctaagggaacattcttgtactctagccgtgtcttttagtcacagggaactcaagttcaaaatactcacagttcccacaagcatttgttctgcatagccaggaacggaaaaatatcttcaatcatcaataatgagcctcagcaaattttctaaaattagttggctgtaactcattatacctacagctgtgacagatttgcttactctggccaggcctatagtattggtttactccctgcagtcataattaactggtctcccttggaccccttccttaccccagctgtgtaatcctttctaactggataggctttggatcctggctatttctagtgaactttgcttctgcagccacaggcatgcatcctctgctagggactgccccggggtctcagccatcagcatattgcccttcagtgcaaatgcatggccccaccgcctgagttgcatgagtcctctctgttcccctgtcctagccctctgacccacctttcttggtctctgcttagcaagtttaaagcatctctctggtaacttatgcagcacccagatatcagtaagcttgcttttctttttttcttcttcaattttttttttttggtagagacaaggagttcaaagttatgttgagctatgatcacacaactgcactcaagcctgggtgacagagcaagaccctgtctcaaaagtgaaagaaaggaaaggaaggaggaggggaggggagcccaagctggtctggaactcctggtctccagcgattatcccacctcagcctcccaaagtgctgggattacaggcataagccatcatgcctggcctataaccaaccaacctacctatcttccttccttccttccttccgtccttccttctgtcctgcctgccttcctccctccgtccctctcttccctccctccctctcttccctccctcccttcctcccttccctcccttgcctccctcctttcctccttctcccctcccctcccctcctccttcctttcctttctttcgcttttgagacagggtcttgctctgtcttccaggcttgaatgcagttctgtgatcatagttcaacataactttgaactcctgggctcaagcgatcctcttgcctcagcctcccaagtagctaggactacaggtatgtgccaccgcacctggctaatttttttaatgttttgtagagacagggtctctctctgtcacccagtcataagctcatgtttctgcagtggcctgtaggtccaccagttgaacaaggccgggtgggttctgggcctgtcctcttgcaagggtatttcctctcctacagagagtcctcacgaagaggaaaggagctgagtttgaatcctgcttctgccttttatgagctgtgtgacattgggcaagttgcttaacctttctgagtcccagtttccttatctatccctgcctcatagagtttttaggaatgtaggaggctttgtaaagtatcatgcctaacacacagaaggtgctcaacacttattacttatcgtttgataagctgtggtgggctaggtggatcttgtcactgacccctgcaggagagagacagggatgcactgtggggcccagcataccacagcctctgccacgtgacacacacactcacttctggaagggctgaactggagaaggtcagtctgtgccagtgacagctggagggagctagaactcatactttaaaacccatctgagaagaaggtccccaaatggcctgcaggtggcgctcttgtccttatgccctccatttctattgctctctgccaaggctccaagacaaactctcatctacaagtattcttaggtctcagccagttattaacatctctgtgcttcattttcctcatctgtaagatgcagattaaaaacagcctcacctcacagggtggcttcaaagactaaatgagtcaacacaggtaaagtgcttggaagtgtctggcacacagtcaatgctcaatattaatgatcaattttctatgtaaagaatcacttggggctcttattaaaaatacaaattcccaagctcctcctctggagattttgatttagaaagtcttgggagagatctgaggatctatatttgtaataattactccaggtcatccttatgatcagacaagtttgagaaatactggcttactcaactaccactcctgggaggccagctgaaattcacgccctctgaaaaagtcactccccatttcttcacatggaatgatctttccctcactgggcatccatggccttatgtccatagccttgtctctgcactttccatggccttatgtccatggcctcgtctccgcactttgtgtatcaagttggctttgccttgaagttctgaacacatcacaggtggcaggctcatctctagacccttatttgcctccgactatatttggcacagacaaggtgctccaaaatgtttacatttaaattttaaatattctgaaaaagcaagcaaccattgttttcaatgcccttgggaatgtctgaggcagtgagtggtgggaatctgagccatggagataattcctgctgcatttctggaggaaacctattcaatataaattcaaataggttcaatcctattcagatatacttattatattttgaaaactgttcctatggttcaactttctaagatggaaggggttaaagaggcaggattaatggttctgtgggtttatcttcaaaatacttaatgctatgggtggaaaatattggtttgatagacagaaactgccacccacagtaatgggataatgccaagggccaagattaggcttaaattaatggtgagtgagtgaatgactaaataaataagtgatccctatcctaaggaatcagattcatcccccaaaccctagaccttggctagctctcataggaagcaagaaggaatggtgctatcactggactcgagaccctccgctccttgccctatggcagccagctggaacgttctttgataaattttgctaatagtagcacaaacatgagatgagccatggatgacacagcttaaacttcacattgtcttcaatgctcagggtcccacaaccacctggaatgtcccaagcacttccaaaaggacaagcccaagtaggccaggggcctgaaggaactgctgtgtcagaccaactactatatggtgggggctcatccagtaatcagaagtcagaaaggatgaagacacattcattactatttcccactagatctgaagcaactggacttaaggcagggaccctggaatacatttccattattctatccccaggcatcatccttcttttaatctcagtttctccatccaacaaggttagcacattgcactggtgaaaatcattctttcccttctcagtggtcaagtcttagagtgtttaagctggaagggatgtatagatggagtatgaacctgttcccttcttctttggttgactgagttcttaccaagttcctactcttggcgacctggccaaggtcccaagtgcaggcaaattttctggtatctgggcatggaagacctgctgctgtccacaggggaggcatggggtggagggatgaaagccagactagctgaagctttcttacattttctctttgctttttccatccagcttgccaactcccaattccaagctaagtatggtattctgcccactggtgctgctgcctagccttccccaggccctgtgactcctgccctccctgcaccctctcaacttgctcaaggtttaacttctaaagataagacatttctccacatgtcctcacatgcccacaccgcctggactaagcaacctgttctagaataaatgtgaaaagatgcagcccacggggctattgtgagggtgtaaagaatgaggtcacagatgtgggctacgtatttcctgaaaatggggaggaacatttgaatttggggctgaatgtagattgtaagatacgaatggaaattcttcaccgcgtcttttatggttccatgaaatagtagaattttataaccaaaaggggcatcttgagattgactgttctaatccaagtacttcttcgtgctgataggatttgacaattgcaaaatcatgactcaatagtagcagaaactgaagccaggcttcctgaatactagggaggatttgttccacaacaccttgttggaagttaaatgctcaaaaagtatttttaagtggaaaaaaaccaggatacaaaaaaagtcaatgtatcatactactaacaataactccccattatagagcactgtgccctatatgcattattgcattgaatcccacagcgttcatgaggtgggtgtcgtatctacatttatggataataaaactagggattggtacaatagaataacttactcaaggtcaaataacaagttagaagcagagctgggatttgaagtaaggttcatctgactcaagcctacactcggaactactattgcctttcctaaggaacacatacggaaaggaaatacttgtgtgccagaatgttaatggcatgaggggagagaaaagactaatattccactcatatctacagcttggggatgtcttactggactcaactttcctgggagagaattccaagatgctaacagagccctcaccaaaggacagagaccccccaagttcaggatgagcatttcaaggatgttgaaagcaatttcacaatatctctaaagatttcaaatgtgcataccctttaacccagctctccttcacttctgggagtttatcctatagatattcacaggcatgagtgaaaagatgtgtgtacaaggttacaaacgatgcttgtttgtaaaagcaaaaggctggaaaccactcaatctctatcaaaagaaggctgcttaaatgaattgtgattttctatacaacaaaaccccacagagctgtgagaatgaggaagctcactaggtagtgagatgggactaactcccatagcaatttgctgaaaaagcaaagtaggttgggtgcggtggctcacgcctgtaatcccagcactttgggaggctgaggcagatggatcgcttgagcccaggagttcgagaccagcctgggcaacatggtgaaatcctatctgtacaaaaatacaaaaattagctgggtgaggtggcgtgagcctgtggtgaggtgggaggatcgcttgaacctgggaggcggaggttgcaataagccgagatggcaccactgccctccagcctcggcgacagagtgagactctgtctcaaacaacaacaacaacaaacaaaccaaactaaaaaagcaaagtatatgacagtgagtataagaagttactttttgtgttaaaaggcaagaaaataagaatatatatatgtgtgtgtgtgtctgtatacacttatattttcataaagaaactttggaaggatacagataaaagccaataaaattgtttgtgttggtgatggttgtagtgtttaggaaaggatagacaggaataatggtggaaattagacttttcactgtgtatttcctaatattttttgaggtgattgtagcatatattctaaaaattcagataaaaaaggaaactgttaagaatgcagatgctgtgggggatgcctggcttgctgatgccagtgtgcatgcttgactgtatgtgtgtgtgtgtgcatgtgtgtgtgtgcgtgtgtacacgcatgcaccaacagctcagaggtaagggaggtggaggattcaggtgcagaagaaacaatgaattctgcgaaaggcttggctggaggtcatctgataatccccctgcctttgtacaaccccatagggaaagcaccactctttagtgagtgagaagtccaaagagtacaaacaagagtagaccaggggcatgtggagacacaggatgggactgaggaccagagagaggcttccatcctggatttcaagcccccagccaggggcccccttatctttcacagggaagtcaggaagctgccctgtccctcccctaaaccaccttcaggtgtgaatgccccaaatgaaaccaaggagcctagggatagctttggccctttcatggggagatgagggcgagaaagacaccagggtcctcaaagatctactggtttgttttggaaataagcacaaggctgcagctgggctggtgctcagaggctcagggccagcactgtgcacagaccttcggttctgtttggtcaggcctggctgtatggctggtgagcatcttacatatcacactcctgtctgcagtgctttccatcttggggcagaggtggctggggtagggcagtaggggagacacgtttgggggctccctgtggtgcccacgctgctggcagtgggccactcacatctccaggaccatgacgatgttggccttttcttcaaaggcatccacacactggaccagcttagggtggtggaggcagttcatgatgctaatctcctgccggatattctctttctcttttgctgaatatgccttgaagaacttccctgcccagacttttcgagttttcttttctacaagtcgaaagacctgtccaaatttcccactgcaaatgaaagggggaggagagaaaagccacatttagccaagctttccgctaacttggggttggcaaattatggcccatgggacagatctggcccacctccttttataagtaaggtgttactggagcacagccctgcctggctgtttgcatgttgtctatggcagcttttgtgctacagtggcagagctaaaggcatatcgcccataaaatctaagatatcagcctttatgaaaggcccagactcctgctctagagcaatgaggcacatttgttttttcttatctttaaacatttttttttttttagagatggggtctcgctatgttgcccaggctggtcttgaactcctggcctcaagcaatcctcccacctcggcctcccaaagtgctgagattacaagcgtgagccaccacacctggcctttgaagcacatttctaatgttgacaagcctactgtcaactttggctgatggcatctcttcccctccctgcagtggaacccatgaagatgggtggagacagcccttcccaaatgcagagtattactgagcagttgccttccttccttccactccctaccactgaccccctggtgatggcccaggcagggtcctgcttcctactgctgagagaggggagagtggggctcctctgtgatggcactgacttctttctgacactgttacccagtttgcatcactccttcatttcccagaaaccactggaaatacaagtggagtcccactcctttctctcccacctcttctattcctccagggacagcgtaagggcagatgaacagcttggctcagggttggggtctgagcccactctatcctccatgccctagggagaagccagagtaagcagtgcgagccaagttcatgagggagcttgatgactgctgcgcgtttaatggagcactaacgcaggcattgctttacagtgagcactgatcaggctacactgacttctgtggatcaaatggaaggggtgccaaagataatctgatccagtcctctcattttattttattttaaaaattattttattttattgtttttaagttccagggtacatgtgcaggatgtgtacgttacgtaggtaaacgtgtgccatggtggtttgctgcacctaacaccccaccatctaggtattaagctcagcatgcattagctcttctccctaatgttctgctccccgcaccccctgctctcccctgacaggccccagtgagtgttattcccctccctgtgtctcattttggtcctgggctctgaacagaggcacagaaaaggaaggacttgcccacagcctttgcagagttggggcagtgtaggaccgcatgggcaactctgcagagagtcctgggtgagtgagtgatgctttcgtgggtcagtcctttggatcctgcaggactctcagtctggggaggaggcaggccccagggagcaacaggaagctgaggcactgaatctaactgtgagacccgcaccaccctcaccctgggagcccagaggcaacttcccactccacttacgatcctaatctctcctcaatgtcgtagaagtcagatactttttgttcagtattgattgtcactgtccggtaatcaacctcgggctccttctcatctgtggggcacaggtcagggttggtgtgagtctcagatgcccccactcagccccctccaccccaagagcctgacccgaagacaggggctgcactcaccatcatctgacacctccacttcatccttcggctctggggggggcacaaggaaggacagagaggacacaggtgattagtactgaaggcccactgagagcaagatgtgctgggggccctgccaggcctcagcctccccaggcagacgactaccaggtccagagctctgggcatcccctggggctggtcagtccatatagcaaatagggcccagtgcagactggcaggtgccagcctcctccctccactcagctccacttctccaccaggtctcccctctgtcccatcctctctagcctcatggtccccagatatacccttctccacatctcatccaaccctttctgactttcagaacctacacacaactgtgacagtctctttctgccctggctcaaaagtcagcaacttataactgcttctagtgtcaaatccatgtagccattcattgaacattgttgacggcatcccagcactggaccaagcatcttgaatgccagttattgtgggcattcaaaacatattacacagaaggcatggtctctcctttcttatagcttataatttagttcaagaggcaaaaacatatatacttgaagtaacaatttacaaagtgtaccataatcacgcacatatcaccatggttcaaagtgaatacacaacagaggagggtgacacaaaatggtgcaattgtaagtgagagcaattattcttagaagaaatagcctttgagttgcgtcttacaggaaatgatggaatacaatgaaggcgtgagtgatgtcacacaaatgaaaccaataggtatttgtgaggcagggcagggagggacacagtcatgccagctgctcccatggccgtgtcaggagtgaacagggtccggggaacaggaggggttccccggaacaggggggcatccagcacagcacgcccacttcagagctccaggccttcctttgcctcgatacaggtttgtttgttgacaatcgagccactctggcttcctgaccttggctgattgcctttcccttcctgggccttggtttccccatctgtaagaggaagggttgcacctgatgtctctggccctggctagctctggatgccacgcttcgtcatgtgctgtgtgttcctcagccatcgtctgggctgcgtcctggctgacagctggacaatgaatgggaggtttcccaaggaagcaaaacaaagacaggagagaaagcatagagggaggaaaaggatttttaaagtgtgagtgtgtgtgtatgtgtgtgtgtgtgagagagagtgggcatatgagtgtgagtgcgggtgtaccggtgtgagtgtgagtgtgagtgtgtttagagttcttaaaatgctgctgacaaagcttagtttttttaaaaaaagactaaaactaaacatgaatgggattggaaagtatattttatcacagaaaggaagctgccatggaaaaataaaaaaggatgagatagacagggacacccagatagtctagctgaagtatcagaggtgggtttcacggttactgtcgggatgtgggcctaactggtcaatattcctaaatccacatgttggagagttaagagtggcattgtccaattcacaggtggaaaggatgacctgagagcaatgcaactagaagccaggaatggagttagtgttcaggagaatctgatcattctaccttttagggtggtgaaccctaaagtccatagttaatacccaagacagaaacagcagctcctcaatctactgcttgggctgtcagatgctgtcacagggcaaagtgtgcatgggccccaaacaggggtgagtactgggtagctgttgagagcgccctgggtgcctgccctggagctctggctgtcggcagtccaaaagccacaatggagctggaggtggcaagcaagaccactgaagggaagggctatgtcttaatcagaaaaggtgaggcctctgaggttgggaaagaagtctaaaatggacatgactttaaagagaatcacacaatcgccaaggatgagatgagagtttcagacttttcatcaactcatgactactgcatcttgggggaaccatttagtgttctacctcacgtaggaggaaggctggagggatatggaactcacacatgagaagtaccactagaataataagtatgttcaatagacatttaggttagttcagtgatgatattataaacagggttttaagagaagcaacaatattggagtcaatgagtgatgggacaccaggtggaccagtcactggactaggtcttcgacacagaatcatcctatttactgtcagggaggcccctgtcttgacctgtggtgctgctgcctgatatagtggttcaccagttgagtcatcctttatttcttgttcctgtgccacattttcccggcgtggcatggagaccagtgtattccaagcagcagagtgagagggaaaggagagggcagctttcctggcctggtgtcaggagaagcagtcttgccaatggcccggcagcaggaggctttccctgcgtgccttgaagggggcatccagtcctagagctggcccctgcctgtcactgtgagtccaggtagacagccacagggccagcctctggcctcactcatgagcccacatccatgcctcaccttcgcctctcaccccagaggtctgtggcagatctgattctcatgctaatgctctgggggaaggacctagatcattctcaaggaattccagcccctctttctagtgcactgtgttcctttatgctgcaggaaactcggatcaagagtccggactaagcagggagcagtggcaagtgcctgtagtcccagctattcgggaggctgaggcgggaggaatgcttgcgtctaggagttcaaatccagcctgtgcaacagagtgagacccgatctctttaaaaaagagaaagattccaggctgctacatccccttctgcttttcccttcttgtcctgcctctcttctatttgaccacaaggggaggagtgagagagaagtagaggaaagaccacagttcaattagcagagctcttggtgcataaagggttgttgagaaaggtgaactggtttccatctttccactagggaagggtcttccactgaacttaaaaaaaaaaaaaatctgttcagaatgagctatgagatccatgagctaagtggaaggctatttggaagatggttctgagatatttctgcaaacagatgagagtctcgttaccctggagtgtttgggagaggatcagctgagtgctcaggaccctcacatggcacaagtccagtcagtcccctggacagagaattgtcccttcctgcagccaaggactgttgcacacccagagaacactagagggcacccccgccccggagacggcctctgaggccagggcgtagctgcagcctgggatgggagcggtacaggctttatatctcgaactgtcctgggggttgcaaggaggctccagttctgcaagaagcctcagtcacagtagctgttttgctaacaattatacagactagaacaaattagggtaaggagcagggatggagtggatttgagtgacagcaggatttgaggaggagtacagttcaagacctggctgggctgggagggagcggggctgtggtaaggttctggctctgtgcacttgggtttgggagtacattgtcagttcagggaccctagtcttaggagtggctctggcatagagaagccactggagctccacggggaacccatgctttgtcccccagtgtatccccagtgcccatggcagtgcctagaacacaggaggggcacagaacacatggtgagtggatgtgggatgagggctagggtaccaacagggatgcaaatgaggcatgagaatgaagtagaagagcgagaggcaggagtggcagtggctgtggtggtagtggtgaaggtcagagccaacattagccgggcttcatggagtgtgggttaatcagcactgcctttttaatatgatcccaccccatctgctccacagaaatgacctacaatgacctgtcacttgatcccacctctctgccaacacacacacacacacgtgcgtgaacacacacgccacttccctgagagccatttccctcttcagcagagggatggcctatgaagctttataactaacaagcatctgagcagaccgtggaggacttttgcctggaatcccctcaaccagagtcctctgccctgaggcctaacacttgccaactgttctgccctcttcctcctcccccttggtaatccagccagcctcagctggggagtagcttcctgtctggaagccctgggtggactggactcctcctctggatttcaagtgatttcaacattgccctttgtctattcccagctgggaggggtggcagcaggggaggggagtctgaaggcccagagagggttcagcgggctgatggcagggaacaagggagaggccacttgccccagacaggcagtcacagctcttcctcctggcagagtctccacacagccctgggagcagctgtcctagacccctgggggccacaccttgtagctcccgtggcctctggtcctgctgcctggggttagtcggggattctccagtctctccctctttacaccatagcacagacctggatgatttcctttccagccaatgaacatcttcacactgcaatcttactccttttcctgtcacttttccaagtaacatcctaacaccacagactggaacttgattgcccccctgggacccacactctatgcagcccccactctgctcatttcagagggatgttgtgtgtgtgtgtgtgtgtgtgtgtgtgtgtgtgtgtgtgtgtaagaagacagtgatggcagttttgttactcagtgtcccctgacagacatttgggagtggctagtggttgggatccctgcgaaagctgtcccaggagcaggcatcacgtctccgtgacttgcaccatagctctcaaggagacctgctctatgcatattgacatggctcaacgggtaaaggccgcctgacacacagctgctagcataaaattgtaaagttggtatgtttcccattggtaccctaactttctttctttctggagcccttgtttaattgaaagtaaaattttaatacctattttgtacctaattttcaatttttttttcaaaactaaacagggtcattgaatcagatgacagtttccatactcacgatggctctagctccctggtgatgccaggcctgctcgctttctcgctttctgagctttgctcaggttcactatttgcctcacttgatttctaattccttgtaattagaagaagtcaaatacattctcacctactgatcagttttggttttcaagtgacattctgcatgtggagctcagtctcctttgatacttgagtcttctaccatctgcctcacaactctacattctcctgtctccaagagctctcttcccttgatgtccctccaccttctcctaacccccaactttttcttatcctatattctttaattctttttttttttttttttttttgagacggagtctcactgtgtcacccaggctggagttcagtggtgcaatcttggctcactacaacctctgcctcctgggttcaagcgatcctcctgcctcaacctcctgagtagctgggaccacaggcgcatgccaccatgcccagctaattttttgtacttttagtagagatggggttttgccatgttgcccaggctactcttgaactcctgagctcaggcgatccacccgcttcagcctcccaaattgctgggattacaggtgtgagccaccacgcccggcctcttatcctaaatttacaatgtccttttcctgttcttcacataaaacttcttgaaataatattccatgcttctggcctctctttcttccatttattccttaaccagggcaaccatcttttcactcagtggaaactctacagacttggatcacaaagatcactaccaaccaaaggactaaatccaaagaccctctgagtcctcatctccttcatttttatttagcattggatgcagtttatgaagccctctttgcaccttctccctcccctgtttctttgagactccagcctcctcttggttctctcccctctcagtcctttctcctggtactgcaagttccttctttatggtgttggtattgactttctctaccacactctctgtaaccttatcaatgcccatggttgcaattattaattaaatagtgaagacttccaagcctgccacactagcttaaacctttctcctgggctctagacccaacagtcttaggataccttccctcggctagcccttagatgcctcaactcagcagggctgaaaccgcagctcccctctcctcccagactgttatgtaacctccaagttactcaagtcaggaacctggaagacagcctgacctcttccctcagtctaaccaaaggagcacaagcttcaggccagacagctctgagttcaagcatcagttcaccaattacaagctctgtgactttgggcaagtagcttctcccctctaaatctcatttctcctatctgtaaaatgagggtaataacagtatctgcttcattgggctattgggattggatgaaatgatgcatataaagtgattaacacatcgtaagcttagagtaagtgctcaatacatgttagccatggtgaattataacaataaacctctagctggctcttgaatttgtgttcagttaccccagccaggaactgtaagtcatcttagaatcttccagttctcttcctcaactcactatgcaaaaagtcatcaagtatggtcacttctacctcctgaggcttgaagttcgtgccctttccatccctcccctggactgtcatcccagaggcccatctgatatggctgactgcagtctcatctcctctgacccacccaccactccagtgcttctcaaatgttcgtgtgcatctgaatccccaaggagtggatcattttcagtcaaggcccagaagggcctgggggagtctgcttgctaagaagctcccaggatgccaaggctgctggtccacaactgcactgtgaatagcaaatccctgctttttccctagttctctgaaaaccagctctaatcgtctcgatcccctgcctgagaatctttgatgaacttcacaactttacctaaaatgcccttttagtcttacttcctcctgttctgtctcacacaacatatgccttggccacacacgagcatctgaaaatgtcacacactgccatggctttgtaacctttgctcatgctgtttcctcttgtagagtgcctttccttatcttccctgccttttagaatcctatccctttttccaagactcagactaagtgtcaccttctccagaaagccttccttggtctccatggaaaaatgctccatgcattttgttatgtccccttggttctttttttacccagctataataggatgcatcccttctcattatagttagccatacacacctctcttcctctagattttaagctccatgtcttatctttgtgttccaagaatctgacaccaagtagacactcaaatatggatacaagaggagaagagaaggggtggagggtggaagaggaacatgaggccgcttgaactcctatgctcctgagtaacataccatcaccccctggtggcagcatgccaaaattgctggttcaatgttttttgaaatgtcctaagtattaatactttttttgaagaatggctcaacatcactgtcttggaaaccaagaccccaaaagaccctgccagtcatcattaatgtttcctcagttccttttcacccctttcagtacagtctttacatacacaaggtcagtcacgcacatttgtttcaagccactgatgaagtgatggcagcctaccttcaggtttctctcctaccgttgtgagttcagactcctggcttggctcactggttccatacacgttgattgcacgtacacggaacttatattcgtggtcaggcagcaggtcctggacgttgaaagaggtgctgcggcatgtggctagttccttccacgtcttgttggctgagtcccagatctcgatgctgtaggactgtacagcactgcccccatcatatgaggagccataccaggacagggtcagtgaggagctccgaatgtcagaggcacaaggtgtgccagctggggggtctggcttatctggggataaagaagcacaacatcacccacactttccagaattgcaggcaaaggaagtttttgaattacctgtgtcatggggggaaggcagcctagagaacccaatccaaagtccctggtcctgcgtctctttccctcatccgcacatcacagttagagctatgtacaaacccacctgtacggaaagccccatgtataattatttgctccaaaaaaggccccctcgcttttttttgctagttttccagtctacatgcaagtcacgatttcctgtactttgcccaagtcataaacatatttgtcagagtaaacagatctaggaagctgcccagaaggcgtggactatttcctatcgaaaacatgttttgagagagagagttcagcatgagtgtgtgtgtctgtccttcaggcccttggccaatgacctgtgacataactaggggtctgcctccactttctctgggtcttgagaaatgcctgccccaccaaggggtggtatagcacagtgtttgtgctctgaagtcagacagattcaagtttgaacacagatctgtccccacacagtagctgttaattgccctgagcctcagtttcctcatctgtaaaatgtgaataacaacagcacttgtatcacaggtggttgtaagaaattcttagaagagtggctggcttgactagtcattactatcaagattattgtaggagtttatttctaactttatatacttaaaaattactcctaccctacctcttttattctcagagggctgttgagatataaataatttcaaaagcaaaccacaatagcaaatcacagccatccctgactaatggacagaaaatgagctgaggacacaaataagaagtggcccttttggctggctgccttctcattcagatgacctggcctcagaactagcagtactgccaacttcaagtcaaatcatggtagccaatactttaatgaggctcttgagttttgctgattttattagttgcttatctgagcaaaactctcctatttttcagatttagtttttgcagatggttggttagttacagatatctgtgttgtgttcattaacccttcatctcccccaatgctgtttgatttcatgaagcctcacaaactagcaattgaaaccatgcttttaagctatgtcaaccccagcaaatttgaaactggtttgtttgcctggctttctcattcagagaatggtgctaatatgttcctacctcttagggtttttgcaagcatcaagtaagcaaacatagataaagtacttgaccgctactctcccacctccagcaaggcaggaaggccaaaggcaatggctgcaaatgaccctgtgtatatggagaagaaaaatctgcatgtatatacatgtgtatatgagtatatatactcatactcatattcattcttgtcccctctcccagccctgccgatccacattccagcccagaatgcactgcccagaaactgtctaccccaataaccaaagccctgggaatgattctgggattgtgacagagccacttcccagtgctggcagtcatgccagaggcctcctgtgatggaagcactttcactggctgtttaatatgttctcttagaaaaactgtttgttctgagagatatattggccttttttgaaacatttctggttttggctaagatgtttattactctaaactctcttaaagacaagtggttcaagtcctctcaagacccagctaaggaagtaaaaaaacctgaagagggatggaagacagacccactattcctcccagagaagactgcctggagaccatgtgattggccacagttggagttgtgtgggcttataaacgaatgcactctgccaactgatcttccttctgctttggtcaagaaaagaaaactgagaaatgggtgttgcagaagaggtgccatttgtaccctaccctgttacacatgtctcttggctgaaaatgagaacctatacatgacatatgtgatacgtaagacttgtcacacaagagaagatgcaaaatttggggcgagggactttaattccaagtaaaactccaacatttttaaggaatttgctaccaaattaaggagttcagaaaagacccaagtcagaagtcctaggagattggaggcctcccactcctccacctgcctttagagctgtgggctgcacctaatgctttctgttctttctaagctatgagccccatgcagtggctgaactagtaaagggatgaaaactctcagaaaagaacagatgtccttagaacagggagctcctgtgagcttgtcctccacggcgacacactcagactgggagggagaccctgggcatctctgggcaaaggagactccacatttcctctgaattctcccagggctccctggaggcttgactaacagaataggaaactcagctcagtctaagacaagagtctccagtggcaccagctccaggattttctcctcagcaaatgttctaatttccaggaaaatggaggatcctgtcctacagcttcccactagagtaactgctcttgaggtctcttggtcctcgcttatttgaagatgaccagtggctatgcctagccccacctggatgtcccttccctgggacttcagcagctgctggaagggcccccacatgtcatctacctggataatcctagcccttgggaaatgggtcctcagcagctaaggcattttgcttatcaagaaaacccagtagtcagtggcagagccaaaaggagattccaaaaagcctctggaccctcgctccagggctcaagactttccaggctatcaggcagaatgagctcaagaaggcatcttgcttaagcctgagctgagcattaagatgggaaatcatgcaagctccaaactcagttagtatttggggattattgggtatttggggttctctctactttgtttttctcctttaaagatatgaaaagagacctgcttttctcgtgctgggtgagtgaccttaaggaatccatctgggtatgctgctcactgtcccctcccttattccccacaggccaagaccaggggcgcatgtgcaggaagaggctctgagcattgcaaattcctgggctgccttttaaaatataataataataagtctccaaaatagctaaatatcactcatttaagctaacagagggaaaggctagtttttattattgtttgaaaaataggagccagagaggatctgaaaagaaagtggccctttaaagaatatacaataagagaagtttgctgctaacaaggaggagttgtattaaactggccttatttagctggtctgtaaatgcatgaaaactgtccggagcagaccaagtgattcctgttttacctcatgtacattttacatctgcttaataaaccctgatcagggaatacagagatgtccctgaagatgcacaggtaaatctgagcttcatccaggtttactttgaactaattctaagtgtacaggctctgaatgaatgtggctttgctgtatccatcaatgtgagtcctattttattgagcaattctattcttagttctttgagggggaggcagacagaaagcctcggttctcctccattccattcccctcccaggacggcatttaacatgctgctcctgccagctggcagacagccacgccaatggccctgtcagcactggctgcagagaataagaaactaaaccataaaaggccagaactgcagcccgcgtagtggtgatcggaggaggggagtgcgtggcactgcgcaggagctgggcatcgtgggggctggggggagggagagcttttctgtagaaaagcagttcaaagaagctgaccccaaagttgcttaaggaggagcagatgagagagaacatcaaagaaaagtttaaactgatgcttgctgataggacgggagtacagggccaaatcagtgcttcagaacagatctaaatgtaccagtaaagtggatcactagcaccaagcctccacaggttcctgactccttgggaggaaattattcaaataaacacctggagtcaccaaaaagagacagagtgagaaaagggttgttcttctcctttagaaatgaaaaacccattccctgacccctttgtacaccagtcttccccgatctgaaacttctaaccaaaagaaacaaaagaacagggtcagaggaaggaagacaaagggaaaagaggggacatgggacagggtgacggacactgagaaatggctgaaacagaacacagggtaaagaaacaaggccagggagaggaacagagcaagagagaaggtaaacagaaatatggacaactgggggtggggagtggatgctggagctcagtcctctgtgaattccctctcccgggtcccctgtgtccagggacaatcttccagggggctttgcagtacttcctctctggggagtcgggccagggtgtggaacctgtggtctgttctggtagctggcatgggcatagctcactggccacctcatttgtcttcccagctctgtattactttgacctttatcctcgtgtcttccttattcacctggttggacaaggacttcttcttccccagctgcttaggggctgaagggaagtgctacagggcttcctaaggctcagcatgagaaaaatggaggcacagacatcaacaactctctggcatgtggacagctccccaaaaggcttgcatgtctcccctcaagatgagttttgcagccagagtgttcctttaccttttgggacattctgtacctacttcacactcccatgagtggcactggaggacaagtgtttgaaagtttagagctagttcccacttagcctctgatgcactatgttactttgttcagattaggcctcagtttctcctgcataaggctggaaacatcagtcctgtccatcctagtcctaaggtgatgatacgagatgaagataggggagaaaaactgcttgagaactaagtcagggaatcacagaatgtcagagaacaaagtcaaggaatcacagaccaccagagaacagaggtgaggaaccatagaatgtcagagaatagagtcgaggaatcagaatgtcagagaatagagttggggaatcatagaatgtcagagctacaagagaccttaagagtcaatgtctacaacttctaacttcatatctagatacttccataagagagattccagtggaagacttctaaccacggtagccacacaagccctgttaccaacagatccttttgttctgtgtgcccacgtgtgtgtgcaccaggaacacacaggaaaggctagtttgcaggaagttaaggttgggatcagcacacacagctgagagttttgtgcactgcataaaaggggtctagtgggggcatctgggccaacctgtcctccccaaggccaggtcatgagttctggggtgaggctgggggtgctgtacccttttcactctgcccagcaaggcccctttttctaattttcacaaatgtaccctataagcttgaaagccaaggacaaatggaaaacccgctcgggtctcgtgcacatatcaataaatgccaggtcaaaggctttcacatgcacaacatatgaaggcccacaaatgcatgaggcatagagtctactctctctctctgtctgctcctctgcctgctcattcttctgctgtcccaagcacctgccacacggggaacaactggagcagaacatgacaacagcgggagactggttagaaaactctcttgatgctccaggagagagctgaccagggcacgaagacagtgttaagggaggagaggaaaagtgaacttgagaatcagtctggagacagaccccactcaatcctgggatgaaggaaatcctggtatgaaggtaaggaaaatcgagtggagtcaggattgggaggtcatggtgacctcagaagaacagtccctgcagactaatggggcgtgggggtgaggccataggcagctggagggtgctggggggtgaagaagcggaagtgcagtagagactcacccctgtcagagagagaaggtagggtggctagagtgagagagaacattgcaggagttattaatgcctgtgcatctggctaagatggcgacacttacgggctgctgggaggagccaggagagaggaagaggttgaagagagaagtagggatggtggagcccccaaggacctggggtccagagcacaggagaagggagcagcctttggtgggaccaaggtgggccatccccagagcctggagggtggagtcaggatggggacagatacagacacctgtggcgtaggggccaagaagttgaccaagtttatgcctcatgtctcttatttctcaaataagctagatgccaaggcctgagggcggggaactccaggaacagctatcacagagaggtgttgatagagacagggaaaaggatttctgcccagccttggcccctctgctgagcctggaggtcagcagggtctagcagggagtctgtgggttgccgtgatcttctttctgtggtgccttataaatcaggcacaggagtggtgagagataatgggtgatgaagtcctgaggcccacgtatcttgcctgggggctccctgccttccccttgccccaagctccatgccacccagccaccagactcacccacgacagtgaggttgacctgggcctgcctgctgcccagcttgttctccaccagcagtgtgtagcagccgcagtgctcctggcgcgcggccaggatggtgagcttgctgccattctcgctgttctccaccttcatgtgctcgctttcctggatctaggggcggaggatggagcaggtgctggagccttgggcccctgggctaggaaaggaagggggctcctccccattccctacttcctgaaggatgcagctggacaagctgtgggggggctcagtctggtctggactctgcccttctccctgaggccccttctctcctacatccagagtccagcttccctgagggtgccaggtctggggtgggcagggagggtgtggagcaggggcaggatggatggatgaactagctgagcactcactgctcccagaaatatcctggtctccctctacctctctggaatgggatgataggagaacacatctcagcaaagtcattcacaagatccactccagtgggttctagcctcttctgtgctgtccaatgctgtagccactagtcacatgtggctatttaaattttaattagttaagtggaaacaacccagatgtccatcaactgatgaacaaataaacaaaatatggtctatcctgacaatggaatatttattattaattcattgaaaggaatgaagtactgattcatgttacaataagaatgagccctgaaaagagtatgctaagtcaaaaaaagagaaagctacacagagagaatgacatactgtatgattccattgatatgaaatgtccagaatatgcaaatccataaatactgagagtagatgagtggttgtcagggcctgggggaaggagaggaatgtctgctaatgggtctggggtttcttactgggatgatgaaagtattctagaattagataatggtgatgcttgcacaaccttgtgaatctactgaaaaccactgaagtgtacacttcaagagggtgaattttatggcatatgaattatatcttaacaaagctgctataacaatttttaattaattaaaattaaatattcagttcctcagttgcactagccacatttcaagtgctcaatagccccatgtatatggctggtggctgccatattggatagcacagagataacactttcatcagggcagaaagttctgaaggacagagctgggacttggctaaatgtctctgaaaagtgatgagattccatcttatttcagacaacagtagtccagatgtcgctcagggcaaacatgctctgggatgctaaaggcaaacttctcatttccatcttttgagaccaaccctactttcctccctgttagtactaagtgttcatctctggggctaggagaatttgagtgattttaaaacagagtaacagagggctcagaataaatcttcacaacttcccactcctgtgccaacccatcattccagggtctctgctgatcatgcatacaggcacacactaccaccgtggattggtggagctgctgggctccccaagtcctttcaatgctggttgtctagaaattcaaacattgttccataggaaccattatgataaattgtagctagatttctgggtcagtcagacacaattctatttatcatacaattcttctatccaaatactcacatttgcttttgtcccttcagcatgtggcaagtttaagtggttataacagacaggaatcagtgggctggcacagaatcacagcaagctcatggagtctaagggtcatcttgggtcacaggctcgactttcctgactctgaataggattctagactgtgctatcaaaccagatgagggacatggatggtttctacttttcccctcacacttctattacacaaattgtctacaaaggcggggattattggtagattcagaagcaaaggttaacaagaactcaggtttggcaggtgagcgatgggtaggggagtggcctctcccatttctaaagctacgaagagtgaggccatctccagcacggcatttctcatccctttcggtccaaaggctgtacggattattcccagcacccccagtgcccaccccataccgtcactgacctgctttcggaacttcatccaggtacaggtgatgggctgagtgcctgtcactttgccaaacagctccactgactctcctgcgcgtaccttctggtcctcagggaactggatgatctgagggggcattgctgagggaggacagggagaaagtgagcgaggcagaagggtctcaggcattctgatcacattcgacgccattgtccacagtggtctgttggcttctctcttggcttccggaaccttcagggtaagactgaggggcagtgatcctgctgcaggacatccaagttcatggacctgctaggtttgttcacctcttctttctgattccctcagaagtgacccacactacttacatggcatgattctccatttatgggttgtactggaatttgtgacttaccctaattttttgaattgaggtcctaactcacttatgaattaagcatcaccttgccttctaaactccaggtcaccctggctggcaggcttgattcaagtcctcaagtgtcatccaatggaaaacagacaagggttccatataacaaggacacacagagctgggcacaaaaatagccccaagagggtcatgtacacaagggtagggcagaggatggacagcagggcagaattcgtagaaggggcaggcaggagagctgctagtcctgtatgatgctgtcaacatgggaggcagatggaaagacaaagctgtggaaggggaccaggagccaggctgtgcagaggctctccatgagcaaactcagcctgaaaaatgcagagctggaactgagggtgggggtggggttgcagtggggtgtctcctgggatcacatacccaggtgtcagtctagcaaggtaaaggcaaaacccccatggtagatgacttctttgaccccagatagtgccgtggccaattacctgccttcggaggtgtcttgggggcaggtttctttttcacagtcgcatcacctgaaacaaagaagttcacaagttatttcctgtagttctgtttttttcacaaagctcctgatcctaggaagatgcagtcttgtccactggcccctcatccagggaggactcttatttgaacatgtcttttcaggctgagcacggtggctcacacctgtaatctcagcactttgggaggccgaggcaggtggaccactagaggtcaggagtttgagaccagcctggccagcgtggtgaaaccccatctctactaaaaatacaaaaaaattagctgggcatggtggtgtgcacctgtaatcccagctacccaggaagctgaggcaggagaatcgctttaacctgggaggtggaggctgcagtgagcagagattgcaccactgcactccagcctgggtgacagagtgagactctgtctcaaaaaaaaaaaaagaaaaaagaaagtaaatgaatatgtcttttgagagatcactttgccctttcacacagacaacctcacagacaaaaaagaatatcagttctcagggacctatgaaagggtctctgaagcctccaatgagattaaaaactctctaaaatgctcgtgctcccatagcccttttcgaagacgataatgccacactcattaaccactctctcaccctaactttcaggaaactcagaaaggaaattatgtcatgtcagataaaccaactaaaattagcctttggtgtggatccaagggtcgcaagcttcctttgggtcacagactgttgactggtggctttcatttttttaaagtttgttggatggatgaatggatgaatgaataaatggtctcctcccttcttactcttacttcctccaaataactcaaatgagaaaaatgactcaaacagaacagtcatgcagcacaaacctattcacttggctaaatcacaatatagtgcacgtgcgaaaacatcttgagctgtcttcacggcttgtttcaaatcccttccaggtctttgctcaaaagccatctaacctatctatccaaataaaatgaaaacctacaggcacacaaatatctgtatgcgaatatttgcagtggccttattcataattgccaaaaactagaaggtatccaaatggatgaactgtggcactttgatgccaccaataaaaaggaagaaactactgatacacagaacatggatgaatctcaatgatttctctttttcttctgctcagagaagccaaattcaaaaggtcacatactgtatgattccatttatacgacattctagaaaaggcagaactataggaatggagaacagattaatgaatggttgccagaggtagggtgggggaggggtgggctgcaaaggggcacagggaaatgttctgtggtgacagaaccagatcttgaccatgctgggagtccatgatgacattaatttatcaagactcacggaactgtgcaccaaagagggtgaagttcactgcagggaaattataccttaacataaaaaatgaggaaaagccacttcaccagtgagatcttccctaaccaccccatacaaacagcagccctgcccccagcacccctcatccttctcatctcgctttatggtcctcccaccccatagcacttatcaccatgtgaaaaactatatcttcacttatttatttactgtctgcccttctcctcctcctaaactgtgagctttttgaggccagggacttttttggttcactgctgtatatcaatgggcctggcacacaataacgatttgttgaatgaatgagtgggctaatattaacaattattcatccagataacttcacctctgcagatgaaggggaagcggtgtcattggcttggatatgggttgccctgtgaccacaggcaaattagtaacttgtggaacttgtgcatttccacgacaggacacgtgctgctgcccagtgaatgccccaggaggactgcgtgaggcagtgatccctggcaggggcacactgagatcaccgagctgatggctgccggctgtgtggttaagcccaggatgagggcttccaccaggttccctctggctcattgtcatcattgatccatccgtccatctccaaaaagttactcagggcctactgtgtgccaggcaaatgctagtcagtacacacgactaacctgggtactgaggaggaaaccaaacaatgtaagaaatcaggcctcaaggtcttaaatatcaagacgtggtccacaggaaagaggaaaggcttttttttttttttcttttgccataaaggacatttataggataactggcaacatctgaataaggtcaataaattagaggatagtattggattagtgttaatttcatgttttgatcatcaaactgtggctttataagagattgttcttgtttttaggaaatacacactgaagtatttaggtgtagagggtatcctgtgtgcaactttcaaactgttcatggtatatacatatatatgtgtgtgtatatatacatgtatatatgtgtggagaagtagaaggaacagagaaatggaaaaagagagggagagaaagaatatatgaaaaagcaaggccaggtgcattggctcacacctgtaatcccagcactttgggaggctgaggcgggtggatcaccagaagtcggaagtttgagaccagcctgaccaacatggcaaaaccccatctctacgaaaaatagaaaaattagccaggtgtggtggtgtgcgcctgtaatcccagctactcaggcggctgaggcagaagaattgcatgaacccaggaggtagaggctgcaatgagctgagatcgtgccaccgcactccagcctgggtgacagagcgagactccatctcaaaaaaaaaaaaaaaaaaaaaagcaaacatagtaaaatgttaacctttgaggaatctagatgaagggtatatacaataatttttcatgctatttttacaattttttctgtgagtctcaaattatttcaagataaaagttaaatagaaagttataaaaaaagatgttattcagtcaacgtgatgtggctgtttgaatggaaaaggaacactgttggtggaggagatggttagttagaaggctaaaagacaggatgtaagatggacctgaaggctagggaaggtctgaactggagaaagaggagaacccacaggtcaggaatagacagtggctcagaggtgagaatcagggtgatgtttggtggaggctggcagagcacagggctgatattggacagcagtggtatgaggatagtgggcactctaaattaaataaaattaaggtgaggcatagtggctcagcctgtaatcccagcgctttgggaggcagaggtggcaagatcacttgaggccaggagttcgagactaacctgggcaacacggcaagaccctgtctctgtaaaaaataataaaaacagccaggtatggtggtgcctgtctgtagtctcagttacttgggagggattgcttgagcccaggagttcgaggttacagtagctatgattttgccactacactccagcctgggtgacagagagagaccttatctcagaaaaaaaagaaagaaaattaaaaatttgattccttggttgcactagtcacatttcaggttctcaatagccataggtggttagtagctatcacattgtgttgacgtaggacatttctttcatcacagagggttctgttagacagtgctggcctcaaatgctaagctcacgagctaaggctttgtcctgattgaacagcatgtcctcactcaaacagcagtcaggctgggctagaggtccctgataggtctttccagctcttgcgggacagatccaattaggaggctattgccataccttggaaggcactgatcaagatccatgcagaaaagaagatgcaaatgagaggcagaggaaagttaaaataatttaaggggctaaacaagaaggaggtacacagattactttgagatttcttgcatagatacacgtggaaagtcatattgaaggaatatagaattaggagtacaagattaatatttcagcttgaatctgtttgtaggttagaagcccaggatcagaattccagagggaagtttgtggagactggaagtgaaagattccagaattaaagaagccattagaatggaaaccttgaagatgggtcaattctttggggaaagagaatgcaatgaaagaggggcggaggccagggtttgatcccaggtgtgtccacagtaaagaagccgagacacaggagagggctgtggaaggaccctgagagcaggaggagtgtcgccacaagcaagggtagaggacagatgctgggaagagcaccaggtgtgcccagcatggagtgagagacggtgatgctggagaggccaggttccatgggacagcatggtccaaagtcaccccagaggagattcttgagcaaacagtggggagtaaaatagtcaaggatcctggaggtgaaaggacaaagagaagcaaggaaacaagagggaatatgaagctcaggtttcttctgaggtgagagaagagagaagatgacaaggtggaaggcaatggctagggcacagtggagagagagagcccaaagacactagagggaagagcacggggagccaaatcctttggtgggggagaccagatgggatatgggacgcctgtgactggctgagccacaaaggccctgcccctctttgtccaggactgttgggaagagagaagctctccagggaagaagagagggcttctaccggagcccagatatgatctctggagagaggaggccatctgttcagaggagctacgtggagggctgttgtcatgggctgaactgtgtctccccaaattcacatgttgaagctctaacccttggtacctcagaatgtgaccgtatttagaaatagggccttcaaagaggtaattaaattaaaacgaggccattagggtgggccatagtccaatttggtgtccttataagaagagattaggaagaagagagacaggggcagggggaggagagagagagagagagagagagaaaggagcgagagagaaagagggaggaagggagaaggagggaggagagcgagagagaccagacaaatgcacacacagagaaaagaacatgtgaggacacaggggaaagactgccattttcaagcagaaacctcgatcttggacttctagcctccagagctgtgagaatcaatttctgtggttaagctacccagtctgccgtactttgttaagtcagccctagaagactaatatagctgtggatgggcatcattagtggggtgggcaccagtggggtgggcaccaggtgtgagaaggaggctgacaatccctggggtgatgagctaggagcacagcatgaaatcaggggactccaaagtcctgccccatacttggtggctctgggtaaacccatttgactggaagagaagccctaactaatctttcagtgtcatggttaaataggattgaaggtcaaatttttatgtttgttctgtaaatttggagctaccattgtttgaattggttagcatttgaaactggcttggttcctatcagtaaaaacaatttaagcgttaacaatgttttatatcctattctatacatattttatatgaccatctgctgaaatccactaattgtgtgctgggcttataggggaaagcacctggttctaaaacccggtttctcagagggagcatttcacttggttctcatcccaatcaaacacagcagggagtatcataatgtttccattttatgaaaaaggagatggcatctcataaaagtctggtgacttgctaggttcataaaacctgatgttctggagctggaaatgggatctgagcctcctgccacccagggtatggaataaataaaatttgttgtaaagagttaagctacattgtaagggaagtatagcatatagtgcagcatgttctttttttcttttcttttttttttttttttttttgacacaaggccttgctgtgtcatccaagatgagtacagtggcatgatcacagctcactgtagcctcgacctgctgggctaaagtgatcctcatctcagcacccactcagctaattttttgtagagactcactatgttgcgcaggctggtctcaaactcctgagctcaagtgagctcccactttggcctcccaaagtgctgggattacagacgtgagccaccatgctcagcctcagtgcatgttctaacatcagcccctccccccactcccccgctctctgaaacaaacagatccccagaggacttctctgtcctttgggacaagtttggccctttcatctatgtggtaccctgttggtcagttcagccttacactaacctgagagctctcatgtggcacctgtgcttcttctccccagtccaggtcctcagaagaggggacattctgcaggtccagatgcccaaacaaactcacagtactccctggctcactaactagtttcctctcctctggagtcactcttattatcttattattcctgtcagccctgtgtctctcatcctcttctctgacaccctaaactttgtgtaccagccagtcagagaggaacatcctagaaggaaaataaaacccatccacctttgcaaactccatgatggctgctggccatgggacaggcagggagggcagagcacgccctactcaggctgctcctctgaagaggggctcagccacctcctttaggcagtcagcccaggcagcacatccttcctggtagagcactgccccggggtactgtgctcatcgctgccctttgagctcctctttctatcccctattctctttcctccatttcccctgaagccagacctctctcctgagcccataccaatacatccaactacctgaccatcatctcccagggagatgccaaacacgtactgccagccaaacgtgcaaaaccaaatccaagaccttttccccaaacctgctccctgtccccatttctcccaaggccccctccctgcccatatccactgacaaatgcctgttgtctacaccaactaagtacctcctcagtctgccaatttctaccttcccaccatcagcattgtagtcccaactgcatcacctcctaggcttctggtcccctgtcccccgtcacatttgtcactctgtggccaaagtgatctttctcaaatgcaaatatgatgtcacttcactgcctgaacctgttcagtggctgcccattgccactcaggatcaaattcaactcatcttacgaggtctttgagctctgtccctggctttcatccccaactttcttgcttgctttcccaagagggaacaactttcatcacaacctcaatactcaatatcagtggttctcaaaatttagcctacattatgattgcctggaagacttaataaaaacatagattcttggcttccaggtgctggtgctgctactgctgctggtccctgcaccttcctttgggaagtactgctctgtaatctacatggaatgtctttcagtttctgcaacaccaggctcttgccttcgctcctttgcacatgctgggccctcttctcttggatggctcttgcatattctttgggcaggtcgccccagctcatgcaccactaatgccccacggggttcatggccctctgaggtagctccatcacagcattcatcaggcaccgctatttcagaaacctgtccccaacatggacacaccacggcaagcttctggggacaaggatagggtctaccttctgtatctgcagtgcctagcatagtacctggcacatgcctgataaatggccattaaaggaatgagtgaaaccctcaaggatttctgttaacccgggaattcccaaggaacattctcccccagccctgggcactgatgctgagaaatatagccctggggcttgaatttttatataactttctatgaaaaggatcagtctctgctgtcccctctgggatcaaagctgccaggtgctgagccttccactctagataggagattgatattagaggaagtgaaatagcccaataaaaacatgaatcaaagcattggatctggaagcctcctgggaaacctggggcaggggtggggaggccagcctcctaattgttcaggtaatctgttccagctgacccaagccctaacctagtcctggggaaaaaaaaggaggtcagtaacccacagaagtttccagatgctcagtctgaaggcacctgaatgcctcgctctgaaacatggaaaatcagcagggcagagagaccagagtaaacatttgcaagataggtgcagagcctgaaggtgggtctcacggagtcaaaaggtctgagataatggaaagcaaaggagaattagggaactagccttaccagccttgggtacagggaggtccctggatgtctgcctctctggggacatttccctttttaggtaggtagttaaaaatagacatcaaatccttcaaaattcccaaaatcagcatgaactttctgccaaaggctcctgaaaaggactccagctgggttgagcatggagtgagcacccaccccatgaggctgtatcggagcaggaaggaggtgggggtacctgaggatggaaggctgagtcctaccacactggccctgggtgacctgacccactcccctactgtatacgctggtctcatccagtacatgcttacagatacgtggaggaatattggtcattttcccagaattaacatctctgggcaaatttcttgctcaccttcctcaaagcaagggctgtcacataaggagattgcaaagaaacactgctcctctgattacatccattcccaaacccccaggacacagagcatcaggatggttgtgaaagaggtgtgctgggccaggggtgccagcattgcttggtgggtaccttccaggtctcccctctggccagttcactggcttatgggagacactgggtgagttgggaggagtagtgggtggaagtcatagggtcacatgcctgtgggtgggagtgtgccaggtaggcactattcctcctcccagacccacattttggttgggagtaactgggagttggtgccagctttcagaaacattcatggaaatagcccagcctctctcccagggccccacatctttcactgtcaggcaagtcttgatgccaaatcccaacctctcttccagccttttgaatcccatcaggattgaacattcctcatgacctgaggaggaatgtttaaaaaaaagatttgatcctggggaaatcttgcatggaaaagggacagtttttaatatccagagatgctttcaaattgacacaactttccattttagaggcagacacatatgggaggtctaggcaaagatatctgagagtctcataatctgggatgttccaaagtgactgatgtcagaggtgaagctcaggccaaggccaggcatggactgcaaagggatgttccattggcatcatccccagtggcagaaccacagtggaggcagggacccttggagcatgggaacttatgaactggtttgaaaaatcaaatatttattataaacctactgagagaccagctaatgaagttttggagatggacaggacctggtttctgtcttcaaggtgtaaaagccccacatggatgtccgtttatatctcttctgaaagaccatcagcttatatagactgctaggaggaactcccagagtctggtatcaaactggcatcacctcatgtgcatttcctaaggccacttcttaagccccatcaatgcctcctttacacagccagcatgcttgtctcccctcacgcaaaattcccaagaactcccctggccatttgggccccctccagctgggactcccctaaacctgtatgcttaaggcctctttccctcaggacacttttgctgctgtgtgacctaaactatacttgctgtagctttggactccttcacacttcagatgatatgaaggagagttattaatctcaactgaactgtgtcactcaaaagctttccatccaacgggctgatgctgatgtcagagttgggaaaggcctgaggtcagctggagaaactccccatctgactggcaaggaagcccaagtccagaggaatgaagggctttgaccaaggccacatatttaactactgggagaaccaagaccttcgtctcctgctcattggctttcttgctgtgtcttgtgcctgagtgctgccccagaactgatcatagtaagttggcacctggagtccgacaggagtatttctgtctccccatgccctactcagcttaggtggaagagtgtggggtgtttctcccctgggcctgtgaacttctttcctgttccatctccaaagggaggagaggacccactctgggctggaggagtgcacgaagtgttttaggagtgttattattaaatattcatcaacaggagaaaaagatagccacaaagaacattattagaacaattgacaataaatgtagactatgaatcaattagacaacagtattggttcaatgtcaaatttactctttgattttgatttcaataattgcattgtagttatgttcttaggacaacagcatagttagaattcaagggcatgatatctccaatttggcctaaaatggtaggtacctatctctatctaaatgaataaataaatgaatatatatatatatatatatatatatatatatatacacacacacacacacagagtacatcctgagactgcagccaggccagggtgtagtggccagaatgcaggtcagggttggcaccacagttccacatcttactagctgtgagaccctggacagggcagtttagttctctgaggctctgttttgttcatccctaaaatgggaacagctatttatagcgcagttgagtgagactcggctgaagtgacatagatcgagctcctaaggtgctcccagtgcacaggcactcggtagactctgattttgttcagcctgcagctgtcctgagacaggtgccctcacaatcttcactccagcatctgtgtggctcctccctgtctgccttctccccaactgatgttatcattttctctccagccaaaccacataaaccacattcctctcctcctccataacctgaccccgttttcctcatcccgaaatcttcccaagctgctcccacctccctcctgcacttgtgagtcagtgtctggccggttaacttgtacttctgtccgctttctctcaccccgtccttgcttgggttggggtggatgcccttggcttttccctcatgcttgtcagtgctcagcagggaggggggtgtgcagaagagggaactggtcatgatctatttgatgaaaaaatcactcaggctcacctcaggaaagatggatttccctcttagactaggtacttctcagcccttgacacagaggaacacacacacaaacacacacacacacacagccagatcactcatggaatcagaggtgtctgggactggggatggcaaagctaagaaaaaaaggcaagttgcagaggtatacagactgtgcaattccatctctgtgggacaaaaatccaattgatgtacttgtgcctgtatataaaaatgcatagaaaaaagtcactgagtatttttggggcgtgagtagaattggggtgagatgaaagaggactttcatgttgtacatagtatatttctatattgtttaaaatggttaaataagaatgtgtgcatatataatgtatataatcaataaactaacaattatcctccaaagggagaaaagaatgggtgcaaatctaaaagacatcttcggccgggcgcggtggctcacgcctgtaatcccagcactttgggaggctgaggcgggcggatcacgaggtcaagagatcgagaccatcctggcccacatggcgaaaccccatctctactaaaaatacaaaaattagttgggcgtggtggtgcgcagctgtagtcccagctactaggcaggctgaggcaggagaatcgcttgaaaccaggaggcggaggttgtagtgagcggagatcgcgccactgcactccagcctggtgacagagcgagactctgtctcaaaaaaaaaaaaaaaaacaaaacaagacatctccttcacttcccatctctgggcagctgccttctcaggagcttctcaggaggctccagaaacaaatcccagggtatctctcaggcccccagggtacaggcttctgaaggacaagagtgcaggggtgcaagcaggtggagggcagctagagccagcctggcaccgctctcagtgttggggtagcaggtttggagtaacagagattggagggtgggccagcaaaagggtacaaagtggccatgactttggagtgtgtagagacacacactcccattctttcaggagcaagatgtctgaaattccaacatgggggctctgcacacagagtgaaatccaagtggggtctactggagttaatccagtcatgaatgtgtgttttctgtaaagatgaagcacttgctactagcctgctgctcccccactaactcagactgagcttcattccctgcttccagcttctccaccacaaggtgccttgttcggctctctgggcaacatgataccctaaggatgttgatgtgagggtccccgaggcagttccacacttaacagaggcagcaggggagacccccttctgcttctcaagacccacagtgtgggcaccaggtttctccctggaacagctggtttccagcttgactgcacatgacgtgacctggagcttgaacaaatactgaggcctggcacccacccctgagattctgatgtaattggtctgggggcaggggaagcctgtgcggcagtggtttaaatgctccccaggtgaatataacacacagccaggggtgcgagctgctgctccagactcggacagtgacagcttgcatggggtttccacagccttctgttctcagggcagagagcccagctcctgctctgctcatcatctcaagcttgttttcctcctccacagctcggctctgaccccatctcacctcctcaggggctcactggagtgggtgtgctggagctgagggctggaggctgcccaccagatcaatacctgccctgtagcttctgcacccaggagtcggggacagccatgccatagccccaattcacagcccctggtgcccttcctacattctctatctcttctgctcacggttttccataccaagtatagcacaggtccaaggaatatttttggaagataaaattattaacccattctcaccagatttttcttggtattatgtatgcatttccaacaacttattaaatgtccattcttgatattctcaggctatctaccttggttaagtatcaatgagaaattaattccaatttctctgccccaacatactgaaggctgagttcccccaacagcctggctggggtatgtttgaggaacccaagttcatcattaggaaggtaagaataaaataaagtcacaaaacactgcattgtaatggaaaaagattgtagtctgagttaacccggctcaattattttcccctatcagtacgggcaattaggagctcatcttgttttttgtttgtttgttttaaaacacagcatgtgctggggatgttcaagcaactctgcaccctctgttgaaattgtagttttcaaagggtagttctgctgtcaaagttagattaaaaattataagggaagccagggtgacattgtgacttctgaggcacttctgcctttatagccccctcctccaccaaaaaaaagtaaatagatttaattacatatcaagtattatatttgaattatgtaaactacacttttaactgcatgggtataaagatgaatatattcatgtcatgaattaaaaccttttctttgacttaagagttcccttttttcttctaattttataagatattacagcatttggcaggcctgtaaaagcactgtggaccctacgcatggtgcctaatggatgtgtgggctacggggaagctgagatccaaaaagagggaggtagctgcctatggtcacggagaggctcctttctctcttggctttttataccacactgcgatttgactctaagagaaactgggaagggccttccacgagcaaggcgcagcatgtgtcattctgaaaggtaattgcttgaacagaccctgtacaatggaggagggaggatgagacccagacacatctccgtgacattgggaaggaggtagtggaggagccaggtgctgacactgtgggagctgaggtgaggaagaactcagggatgagagacttttcagaggagtttggcagaaaggtgtcccatggagagaggtgccagagaaggcatgaaggaaggaacttgggggctgtgtagtgtgcagtgaagagctcagtttggcctgagtataaaatagaagtaaaggagctgggggcagcaccgggaaagacaggcggggggcaggccacatgtgggaccacgtgtgcacatgcgagctaggtatgtcctcggcactaacatgtggagctttgcttgtgggttttgcaggctctgggggccactgcatatttcaaccaggagtgatgagatcagagttacaatccagaaagagcccctgggagggcaggatcaactggggagaaattaggaggagctctcctagagtcttggtgggaagtgaaagggcatgaaggaggttgggcaggggaggtagataggagctcagatgagatgtgcaacaccacccaggctggagacaggctggagagagcactgggatggggtgagaaaaggccactggctctgttattgggagttcactgggcacttcagggtgtgggcagacatcagacttccagggattcaggcaagagtgagtgaccagaaagtgggggctctgaggctgccctcagtccccggggtgcctgcccctgcctctgcctctgcctggtgaagctgggcgagtactcactctcagttcctagcacgggaggaagagagctcttgggcctccgggatttcatctctggggccttggtgttctcactggctggagcatctggaatgaaacaggtaacaataaatgttagcagctgctgaggaaatgagcaaagggggtctctcagtcaaaatcccacctcagccaaactcctccccaactctgagggccctttgtgcccgctgggcagaacagcgcctgtgtccaggcaacctatttcactctccatgagagcatcaaagaaggaccgtccactaccctgggcctgattaatccagtggggacagcaccgtcaccttggcaagatgagcgcacaggctgcccagggagcttgggatgctcccccggaatgccattgctggcagagtcaccccttgctcaccttccctggctttctcctccatcaggccttgtctccctcatgctagaaatcttgggtctcctctccaacaggggcgggaggggacagggtccccgcccttgggatcatggactagaggtggcgcacagcttctgatttctctgactttcttctgcagaccaaactttgcagtgacaaaccaaacggaggcctctgagcacacagccagcatgcctcccacctctgagacggggtctaggccccactgtggggcttctgctagacctcccccaacaggcccagtgaagctgggcacagctgcctgctgggcggacctaaagatgctgggcggtgcctgccctcaggctctgttccacactccctctgccagaggaaacccttcctcatggagggcaagcagggcgacatcacttggctgggctgggctgggctgggtggaaaggccctcactggcccccaggacactatggggaaaccatccaggaactgggataaggaggagctggttgagtggctatcactgggccccagcactttcactggccttcctttccccacaaggagcactctttggggacggcgctgagagagtctcccccttgaagccccctccctgggcatccttttcctgctcctgaggagaggaagctaagtgggggtgggggtgggtggggggactttccagcagaggctccgccacattcctgaggcttggctggggaggaagtgccctctcatggtccgcctccaggactggcagtcagggctgatcttgcctagactgggctcctggggctctgaggggtgggcgcagggagcagaactgggggctgggaacatacttctcccagcaagtggactctgagctgcctctggatgcatttctccttctgggaggcatttaggcccctcgccttctccagaacatggatctgcctgcatgagtccctctgctcatcatcaccccgataggctttcttcccaacctagtgcctgcctcctctctgctatgggtaatccagggaggaggccctgtgcgggtgttgcaggctcatggcagctcagaagcagacaggcctccgggggctgtgggggcaatcccccaccaaagacagccgaaagccctgcatgcaccattgtgggccttaagtaggactacttagcagtatgtgacggggtgttggggggagcagacagccaaagcaaccctttcaagtagcacttgacaccaaaacgctcccttgcctccactccccactgcaagctgaactcctgccacctcccatacgggcaaaggagccccagatggcacatcaggggtccctgctatctggagtggacactcttaagctcctcaggaggctgcctgtaacccagcatgccagttccatgaggacacagagaagcagaaagccatggggcagggatgatttcattttcttacactggacattttccccaaggatcgtggtcattctcagctacagaaaaatcctctggacatagttatttgtcagcctcggtggatctcagcctcagctgtatgttagaagcacgtgtgccagggtatcacaccccacaggtcctggtttcattggtctgggttggggtctgggcacgatatgatccagaagctccatggatgactgatatttggccaacagaaaactcctcgtctctcctcaagcacagggagtgcgcagggagtggctccaggactattccaagaggcagaaaaacctagcagagcctccccttgatatctggggatgagggtgccataaaccaggggcatggagtcagtctaagcttcccttgtccgggcctctcccttcttcccttccttgaagaccagcatttctaacagtcaccaatgacaatgtaaagaaaggtgtacccagtaattgttttgtttggcccctttttttttttgaaatggaatctcactctgtcacccaggctggactgcagtgacatgatctcggctcactgcaacctctgcctcccaggttcaagtgattctcatgcctcagcctcctgagtagcctcctgagtacacgcctgactaatttttcgtattttcagtagagatggggtttcgccatgttggccaggctggtcttgaattcctggcctcaggtgatctgcctgcgtcagcctcccaaagtactgggattactggcgtgagccacggcacccggcccttcttaaggaagaggagtacagggcagactatgtatgcagttctgcactccttggcttcagcactcattctcctggtgagtcttggagcatagaggagggagaagaagaaggatcaggtttgcttttttaactgatgagtaagctgaggcacaagaaagcaaagtatgagaggcccagttttcctgggctcctgaaagaagggcagcaggtactgagactcctttcgtcctcatggggttgtgttgggctttacttccaagcatcaccacagtagaggccaagagagtacagctctagctttggctttgtcatcagcaaccttgggaacttgggcaaataatttaaactgtcccatctctgtttccacatctgtacaagggaatcacttattttctctacctcatggtgttttgacgcccaaaggagagaacacatgcaacggtgttttggaaagcaggaaatgatcatttatcagcccagcgtggtggctcacgcctgtaatcccaggactttgggaggccaaggcagttggatcacttggacccagaagttcaagaccagcgtgggcaacatggtgaaaccccgtctctacaaaatttacaaaaattagccaggcactgtggcatgtgcttgtagtcccagctgctttggaggctgaggtgggaggatcacctgagcccacagagcttgaggctgcaatgatcgtgccgctgcagtgatcatgccacttaactccagcatggatgacagagtgagaccctgtctccaaaaaatgaaaaaaaaaaaaaaaaaaagaaaatgaaaatgatcacttatgaattaattcctcttgatagccacattcccttacctccttctgaatcagctttaaaattttccaccttcagaaaacactccctgccctgccccatctgcctctgcctccgtcctcggccctagggtgctgggttttcactggacgtgtcagtacactaccctgtaatgtgctttgagtcttatttttagaagtttctgcagcactttatctttccatctggccatgaggaaaggggctgaagtccccctttcaaactaggcacaccccagactcggagccccagggggtggccgcgctccacttgaagtgtcagcacggtggggctgtgcatgcaccacggggccctgccagggatgcggagccagcagacctccatgcgaactgcagcaaggagtgggctcgaagggccatgtgcctaatcaaaaccagctttgtgctcacatggctgcccaggggataaaaataatagtaatataagtttaagagcagcttgtattttctattttaatcattttgtgatgaaattaaactccatttctagatctaggcccccaaggctgaagtcctttgcttgtgtccccaaagaagtgtgggggaggaagatggaggtgtgaggaagtggggggcctctacattgagaggaaaatgtgtccttatatagacaatgcctcacccctcccactcctgggctctggactcaagctctctgggcagcgtttttttttttttaatctcccccaagaggctggttccctgaactctgaccccacgcagggggcatgaggtcttgggaagcttctgggaggggtccagcttctaggggcccccagtggggcagggcagaggggctgggctccagcctctccctgggttggctcatccctccttgctggcctctctctctgactgagtgcaagcagtgtgctagcgtagtaaggaagagagatcaggatgcttgcgctttctggctctgctgcttaggagttgtgagtccctgggcaagttcctgaacttttctgagtctgagcttcctcacaaggaaaaccgaaataacatcacctcaatagaagagtgagggaggtgtggccaagtcgtaaggtgatggctgacatttactgggtattgactccatgtatgcacggtgctaagtactttgtatgctcagatcaggttgaactacaccattcgccagtattgaagtgtttttgacctacaaaaacagcaattttatttagtttcacataatacccgttagttgtctgtgatgatttaaagaataaatgtgggccaggcgcggtagctcacgcctgtaatcccagcactttgggaggctgaggcgggtggatcacctgaggtcaggagtttgagaccagactggccaacatggtgaaaccccttctctactaaaaatacaaaaattagctgggcgtgttggcgggtgcctgtaacctcagctacttgggaggctgaggcagcagaatggcttgaatccaggagacagaggttgcagtgagccgagatcatgccactgcactccagcctgggcaaaaagagtgaaactctgtctcaaaataaataaataaataaatgtgggggtgggagcagacttagtaatatggcagggctgaggccaagaaaggaggggtggatcaaaatcagctcagcaataatcagaagtgcccaggggccaagataacagtggatcacagtggttaggcaccaaggcttgggtttaacttcccactctgctagttagggtgaccttgagcaggtgactcagtctctgtttgcctgagatgaggctattgttactatcactcccctgaagccctcttgcaaggtcaccaatgacctcaatgttggcaaacccaatagccagtgctcaggctcatctttatttggcagcagcacctgacccttccttccttcctttcttccttccttccttccttcctaccttcattccttccttcctttccttccttccctccttccttccttccctttcttccttttcttcctttcttctttttttttgacagggtctccctctgtcccacaggctggagtaccgtggtacaatcttggctcactgtagcctcaacctcccatgctcaagctgtcctcctggctcatcctcctgagtagctgggactacaggcatgccccacagcatccaggcaacttttgtattttttgtagagacagggtttcaccatgtagcccaggctgatattgaactcctggctcaagcaattcacctgcttctcaaagtgttggtattacaggtgtgagccaccacacctggcctggcacactaatcttgatcattccttcctttttgaagttcttagcatttggtttctgggacacccccatctcctgggtttcttcccatctcactggagtacttccttcttagtcttcttcgcaggcccctgtcctgcccctgcctctctctctctccctcttcttatagccacctctgtactctccagggacctcattcaaccccagggcagtgaatggcctctgtgtgtggatggctccctgtatcccacctccaactctgacctccccctcaactccaggttcacctaaacacctgcctatgtgacaggaccgcttgagaggtcaaatagcaatcttaaacttcacatgcactaaactcttgatcgtgccccccagccccaccattggtcttcactcccccatgaaaactgagtcatctttaacttctctctctctccatacccagctcaccagcaactcatatcagctctacagccaaagaggttatgaatctgatcacttcctgtccctattgtggcaaccccccattgtgctccctgctttccctctgactcatcctgggtctggtcatcacatggacatgagtgatccttcataaatgtccagtgttggcccataacacttagaataaaatctcattttttttgtcctagccaacactgcctggatctggtccacggtcctcctcaacctcacttcctaccatcctgccccttgctcatggctccaccaccctggcctcctgcctcctgaaacgccttaagcacagtgtcctcagctcagggctatgctcttgttgtcaccttgtccctcttccttccctgcttccttcagtctctgttcaaatgttccttcctcagaggggcctcagtgaccaccccctccaaaaatggtattctctcccccattaccctgctttgctttcttcatagctggtgacattacctgaggatatgacacagctgttcacctgcattactgcctctttcccactagaaaagtcccaaaagctggaacttttcctacttcatttactgttttaaaaccagctcctatggcagtgcctggcacagagtgggcactcagatattagttgaatgactgagtgatggcatgagtacccactggagtgtcccttcccatcacaatcatgcatgaccctctgtggtcacaaagccctggtctcactggtaccaaaagctggatgccctggccagggtggctggggacaggaggcctgagttgagaatgactggatgagccagtgaggggctaaggtgttttttgagtcctctcatgggattctggcctaggaaggacttagtttcctcactgctcatctgggttggaatgagaggaaaggggttactgagtcccacgtgcagaaggacctccccacagggaggactgttactcagggaggtctggatcactctgggagcgggccccaccatggtaattcactgcccggggaggctgtgtcaggctgtggaaaggaacaggtttcagagccagaccactgagtcctgccaggatatttcatgttgtaattcactgtgcagggtggagccccaacaccagatctacacctactgtctgtggggcctggaaggcagctgacccttggtgagcctcagtttgctcactgagaaagacaccctgcccaactgttgcatagactgaaaatgcaaagtgcacaagagtctctggccaggacaggcattgaaggtcagcttgttctcctcctgggtgagttttcgggcaagtccacgtttactctaggttttagctcccttctatgtggcacaagttaacccttgtcttctgctgagttcagaaggaagggtgatatgaccataatcaagcaagttcataaacaccccttttcttaggaaaaagacccaaacacatgattaaaatagccagctgtgctgtgttataaaggttacatcccttatctttatgatatgagggaatcagtagtgtgggtaatgctattttagccccatttgcctcatttttatgagattttgaaagatatgttggcctcagatgtatggtctcgatggtgtttggcacaggatgagtgaatgatagcgactttcaggggccaggccagccctgctgagtggctggggaagccagtctgaagtcagcaccagctgtagtcccatcgcctagtggagatggacctcattgccccataagagggatgaaggcctggttctatgcagaggttgggtgggcagttgcagctggagacaggctggaagagcccacacaatggctgggcttgaaaattcagtcattgttgctgcttacggcaagtagttcttcaacgtattctgattcatgactccttttgagaatttgactaaaaactatggacccctctcttcagaaagatgctccaacccacataatgcaacattttgcctgtaatttcaggggaggcacaaacccactgggatccccaagtcaagtatgatgccttggggagtagggagagctgaggggatgaggggacagaatgagggcaggagatgtagcctagccagtggggtggagcaccagacgatagaaaggcgacaggggagctgtcaaagtgacaacagtcctttactactttcctagagaggctcttgatgaaaaaataaagctaaatgtgggcaaacaggatgctaatatatctgtaagtatagcaacagggaaagaaaagcagggggaagaggccacccttatcctttctgtcaacaaaaccaaacccaatggactgagagtcagtcctgttatctcagctgggctccctcctatcacttttctagctcttcttccaagacccagctcccaatttgcagctggaggcctaactctgcatttgaaggaattagggataaataatgatggtcatcaagattagtggagaggacaagggaatctgccagcagactctgggcaaacaaagccttttaagttgcagaatgaattccccaaaccttaaaaaaaaaatccccaagtgtattcagtaggggaaaaggaaatttcatcttgaaaacaaatctagaaaaggtgctgacattttacagatagggagaatgaattgctctcctgccttcagctagccatgtaaacaggacctaaagaggctccgaaagccgataacctccttcactagctcgggaaccagtgtgagtcccaaacgagcagaggggtgttagacgtgggcttcaaggatcatgttttcagaaacgctatactttacagtgcagcacctgtatagaaagaagcaggactgtgatctgggtgggtgacagcctgggtgaggagagactcccacacaggagtcatcagccacagcatccactgtgcagaacctcaaaatgtgtcccatgccccctctgaattgagcataaacttggacacatcaagtccgcttccttagactcagagcccctatagcacatatacgcacgatctccaaggagaagtacacagtattagatgagttcagcttacctttcggctattaacaattaattcgtgctgccattgtgtttttataaaaaagactttcttttccacctctctcccattcatcatgttccatagagctcagctctgtgatcaggaaaccaattgtaaagtccagaatgaggacacgggctctacatggtgtggaatggcagtgagacgggctaggacttcagaactcaactgatcacacacaggagggagaagaacaaccaagctgggcttcaagatgccttatttggacactagtttttgatgtgtctctgatggttattaaccagacatttcaagggcaagaaactatttccccaaaactaccttttgagacatttccaggtaagtgccaaatacaaagaaatgatcctgggttgtgagtcctgggatggggttctggccccagcttggccctaaatgggccagagagcccccctccaaaatgcatttcctctctggatgccctcagtttcttatctgtaaaatgagggtgttcatctaaatcatcacgaggttcatcctacttctcaggttccaattctatactccccaggaaggagagaaaaaagagtcatgaatgcacttcctgcatttccttaggacaaagcccagttcctcgcagcttggcactgcctcttcctaacacagaaactccgctaagacctggcaggcctgctttctccccgatgtgtcctcccacctccctctgcagtattattattactactaccattttgttttggcagaggctgccctgtcctctctgtccagagactcagccccgactcacctcctctaggaagtctcccacacggacctcgctctgctccctcctcctcacggctgaccctgctgggtcgtcctgccagctcggacacttgtttgttgtggcttttgtaaaatactctgtagtcattttcctgtgggtgtgtcttttctactgcccagtgccccagcttcccagctcagaaggttctgggtgtggggatcaggactgggagggggacaggacagccaggggaggggtgaagccatgtaggtgatcaagtagagctgccactttccttcctgtctctttttcttttggcaaaagatattcattcatccaaaatgaatgcctttgggtagggagggcagtgttggaggcagttctgtctgacaggcaaggtatggtaaggaagggaggggctgagaaatgggacccctgtgtatgggtggcggcgatgggtgggcacgacctaccatccacggtgacttggcaggagcactccgcctggccagcgtcattcttggctacacacttgtataagcctctgtcctcaggcagtgccttctcgatggagacggagcagagtgagcctggggaggaagaattgtggagtgaaccaggtgtggtcgtagtacctgccctggcatctggagcgcagcaggtgagtgttactcgcacgggcagcctctgggagcccagaagccagaggccttgtgggaaccaatcccccactcctcaccaaagccagggaactttctgcttataacccatgtccaaaataactgatccctaaatacgttccttcctgatacctcctcccccactccaaagagtcctcttgtggggacataatagaaagctgcaaaagaagggagagaaatagcctctgcctttggagaccatccaatacaatacaaggagatgcacacaggccctgccccctggacgtcaccaagagagaaaaggagtccgacacagggttacagacctgtgttaggaacagtgacaggtgaggaggtcccactttgtttacagcagtgatgctgtgactgcattctggaaaagggagctttgaagctttgagcaaagaagtgggtggaggaggctaggagcccttgtccaggaggggcaccggcctgtgggaagatctgttgggaggtggtgactacacccaggagctgactttttaggaaaggtgtctgagctggagaaccacggccaatgagggggactggacctgcagaggggccctctggggctgcctcccttcggagttgggtcttctggttgccccagagagaagtggggatggcctttcttctccatggactctcccctgggcctgccttcactcccagcaccatcttctggcctggtttggggaaggaggtgtcagctaggcacacacaggaatctagggtctcgtcctggcccctgccagctctctcatcccagaactggttacttctcctctgggccaccccttggggaggttccctcagggtgtggaaagaggcctgctgggccaggcagaagggcagcagttccttattcttgctttcagatgcacaaacaagtaaatagcagggcatcctgctcaaagctgcccctgttgtcagggaagcaaccgtcacacaggaggacagagccagggccacatgcactttgctgcctggagctcccatctcatgtcccacaagccactggcattgggagggaagagctgggtgcattctgagtggacaccaactactgtccctgccccccattacacaaatgcacagccttgaccagcaaatacaaggagattagaaagagtaaggatatcagttctgcccagaaaacctcactaaggctggaagaggaaggaagggtgtaatattcccctttactccttgccaccagggtactgttttaaacagagaaaccttcatcctataaaccacctggggcaagagggctgatctgcaccccactccccacttcctatacccttatacagaccccaaacctcgggaaggcttcactctgttctcttccctttgtagttaggagtcagaatttgtagaaactgtaatggagaggatttaggctggaattttaggaagtctgtcataagagtaagaatcgtgaggcacaggagtggggaatgaggataaccatgtcctggagagagaactttccattcatctgggtgggcgggaggatgccaagatgacctctggccccaactagaggggctcagaggcttagcagagaccaatcccatctggaaattttccctcaagtcagggtggggctaaggctttgggaacagatatcccacccccaacgcacatcctgttcaaatccttgattttctttcagtttcagtccctcagctgccttgagtcttaagtcaaaatgatacaagctgcaaagacagtacacagagagtagaggggcatgtggacccggcccctgcctcctctcccagggcaaggcatggggcaggcagcttttccaacctgcccagagcctggacccctggccatgtgcatgggcttggggaggcccccctagcaggcttgcaggcttggctaccccagatgaagaatctggtatttcctgtgggacagttcattcttgacctctagaagaaaagctgtttcccagaggtttttttttgagaagcctcagcctggtggggaattctgagagggagatgagggggatgggagaggtcagcatcactgcagagctccgcctgggagagcccctcagggctgtggtggagtaagcgctcctgggtctgaagctcccccagctctctccttttctgagttgggggcagaggggaggaaggggatgtggatggagggagggagcttcctggaggctctgctatagggctgcctcagtcagcctacccagcccacctggcaagcccagacagtaagactcatctccaggtcacccctgcaggcatggtgtcctccttgttccccctaatcccccaggcctaggcggacctcttctgtgctcccaactctgagctcacccatgtcaaagcacggctcacaaggccattgctgacctgcatgcctgtctcccacaccagctctcagagggcagtgaccctgtctaacaccactgtttttcctaagcctggaatgcagtcacagtaaaacatatttgtcattctgagaaggatgaaggcatatttctgtagcaggtgatctggtaggatctatgtaagaaaaggtcacaaacagttaaatataacttactattgaaaaagataatatatagtttctgaaaaaagaaaattcagagttctttgagtggattatgcacacaacaaagggcattagaataatgccttgctcatagtagatgctgcataaatccatttttcgtaggatgaacttacatgggtttttaaaaagcctttgcaaaattctaccctgaaggcaattaaaaatgaattacctattcacaacagcaacaaaaatgaatcctcattgttagactcggaaaagtgttttgccaggaggaggagcctggcctggagacaggaaacaaagcataaagataaagctcttctcaggccaccacagagctcccctcagctcacgggaccatcggcctcccaccacccctcagcagaggcaggtcccggaagggctaggaaaagacttgggggcagagggcaggcccagttggtggtaactctgaatcccatcagccctgcagctctaggggtacaggaagaggaaggacacctccacgtgtctgtgtcctgccacaaatcaactagtggtgaactctagcccatggctgtcaaacctcttctgctttcctcagcacgaaagggggtgaactaaatggggtgatgtaatcctgtttgggtgggggtctgtgggctatgagccctatctaagctacagacatcagagaagtcccctgaaacctataaacagcacgtccactagcagttggtgcacgcagatacacaggttgatggggaggggacagtgcaagagtctctcgtggccaaaggtgggtgacaacaggaaggcatcctggaggaagtgaatcttgtttgtagcagagctgacagggtggggatcagtgcagtggagcaaaaagggctccaagtcaggaagccgggggcagggccagtgctgagctgagtgtgaaggatgcaggacgggaggccagcggagccattccctcaccttcccctagaagcctcctccaaccaccggcttccttattcccactgacacgaccactgagaccccagccactcaggcacccacacttagtggtcttccattccttcatcttctttacctacccccacccccatcctgcccttccaagccaggcaacaggtgccattacttctatccttgcttcttgaactggtcattccctgactgtggttgtggctactacgctagtctaggcctcaccatcttcctctcgacctcttcagtaggctctgtatttgtcttttgggcacagagtccaccaaaacccctaaactgagcttcatgtacagtgttcttcatcccaaaatcttgcatgattccctactgcctttagactggaattccttggcagaatataggatgaaactggggccatgtcatcctctccagcccagaacaagctgttagcaggacgcctctgctgctgcggggcccccgcctggaagcccgtcccctctggcctgtcttcggggcttagatcaaagtccagcactcagctccctctcttcccacttccagcagctcctcccgacacactcatagcacttgtcagcacttggctgtaacaattttatcactgtgagtgtgtcttctccttccacatctattgagaaaagactccctccacctctcagaatgccctactgcctgaggagggacctgcttaaatggtgactgatagatgaagccttaagataagttttttccttaacaaaacactgggctcttgaagtcttggcgagtgaagggacagaaggtggggccgattttttgagacaacgcactctcctgtactgaagcaagacaggcccattgcaaggtctgcttccaccactgcagggaaaataccagaaacctggcaaggctaggggcaccatcagtgtttcaacctttggacaactcttaacaaaatcgaggagtaaatagtcattagtgttttctgttgatagacaaattctcagctgccaccagtaccctgataaaataataggaattaactaagaggtcatatagcacggtggtctaggcacgggaactcagccacctgagttcaaatcccagctctgttacccccagcaccttgcatttggcaaggtacttaacttctctgttaggtggacagtacagtcattgttgggaggattaaatgggtgaaaagtgtaagaggcctaagatagtgtctaacacatagtgttcaacatatgtcagctattctttaaacacaatttaaaaatatttagaagatgtcttacagtttgatttggggctctctctggaatccctttccacctctcctggtctctctctccccttcgtgtgcagccttccttggatcatttcttctgctgctgctctggatctgaactgttccctctgggacggtttccatgggaagggaggctggagtggctaggatctctaggctctttaccactaagggaccagcagggaaaacatactgcaggcactcagggcacgagaagacagtggctaatggctcagaagagtttctgagaccaggcctggggtctgccttacatcgcttagttgagtgaattgtttgtaagtggctgttgatggctctgggtttaaaccccatgcaagcccaagaacagctgcccccaactgacttaacctcagtttccctgaggctggagcagccacagacctcccaacgccaaacctgctgagaccctgaagcccatgggcagcgccaagcctgatgagaacctgaaatccactagcaaagaagaactcaagaaagatattaagaatgatgcgaactgcaagagaggccatgcagggaccacagataatgaaaagagatcagagagccaggggacagccccaaccttgtcctgaggatggtggatgccaccctgcatcctgcctggagagatcaccgtagggtgacctgggaaatgttcccagtcagggtttccaatcagttttaccaaggactttccaagtgggagagccccacaggggcggcaggacaggttgtggcgtctgctcctctgaagtctcaccccagcccaataatcccccatgcctcaggggaggggggctgagccagcagaggtgggggatggaggagacgacttctggaggaccctgccaatctgaggacatccacatggaaaagttactgcgtcaacacattagcagaaaataacatgtttctctctgccagccagtgtccccttcactctttcagcgctgagattcaatatactcagctgctccaggtgtgctgtcccagatgtagagggaagacagacccttaccgggggctgagagggattctgtgatcttcaaatgctccattctgcttgtgaggggaaggcaggcacgataaaaggtgagggagggagtggggagggtgctgccaggggccagggaggggagcagcccacaggaagagcactctgacacctcagctgactcagatttgacaggacctgtccactccggcttcttctgtggctgccctctgcccctcaagggtgaaatgtcacttcctgggagcttctttgtaccctaccctgtctggagccaccagcatcagctcaggcaggactctgttctgtgctggcaacctatccctccgctggctgccagaatggggtgtggaggtcggccggcctcagagctcccacccagacttgggatttacaaaagcacttcaaaccaaattgagggtccagagaaaatactcctgtgtcacccccatctcttctccaagtataaactggctcctctgaaaactccagaccccaaaagtccacacagatggaaggatttggggcccccctcctctccccaccatccaagaatgtgaaataccagcaaacaaaagtctcatccaaattaggaagcgagtagctctgtctgcccgtgagtgtgtgctgtaggggctgttttgggattttgggtttcccgacagatcccttcaaacccacagtgctatcaagactgaagttattgttgaccccaactcagagctccgtgccatctggtcactgcacaccgttccccaaacctaagatgcttctctaaacagctctttactcagagcttctccctggctccagcctctgtgtcccccacctccaagcctgtagacagagccctctccatgccggagcttggaattaactcaggctcaggtctcctctggggagccacaggtggcggtgccatgagagggctctgccagatgggtgccgagatgtgggcatgtgccacaaggaccaggatcccagcccttagccccagccttggtgcatgtacccaaggcccctgagccgggacctatccttgagttagcaggaaacagggacgcggccctcctacccagcaggccctcctacctgctaaaccaggttagcagcctacctatgggctgctaacaggggtcagcgagaccaacgctccatgagctaggagtggccctggtacagaggccccttcttccccaacccccatgctcatttaccttcctgggagaggatgatgaacttggtggtcttgagggtctttccgttcagcgtccagatgatggtggctggggggtcagaagacacctggcactggagcagcagcttcttgccctctgccacatgaacatcttgcagcttctgcttgaaggctggggctgtcccctggctctctgatctcttttcattatctgtggtccctgcatggcctctcttgcagttcacatcattcttaacgtctttcttgagttcttctttgctagcggatttcaggttctcatcaggcttggcattgcccatgggcttcagggtctcggcaggcttggcgttgcccattggcttcagggtctcagcaggcttggcgttgcccacgggtttcaagggccctgaaggctgtgcattgctcaggggcttggaactctccactgccttggcattcagggtctcggcactgctgctgccattctctgctggtaatttcttcttgccacccagcactgagcgaaaatccggggtggcaggttttggcggtggcaccttctcaggcacgggggtcttggaagtccccttcttggccaggacagagcgaaaatcgacctgctgggggctgtgcaccttcctctcttcctcagacacagtctttggcttcacttgccgctgcaggttggcacggaaatccatctgctcggctgggatctccttcaggtcgtcttccgatagggtctttgtactcaccttcttccccaggaggtctcggaagtccagctgctccacctcctgctggcggatcgcctcctcagtgtgctgcctcgtctccacgcgcctcttcagcacccctcgcacgtcctcgccgtcttcctcctctagccaaccctgccctcttgctggccagccaggcctcagggacccatagcggtcactaccaccaccatcagcaccaactcctccaccacagaggtcctcgcagctggcaggctccctccccctgcaaccagtgtagggaaaaaggaaagtagcaggaggaaaaggggctgggtaagaaagaaacttcaggggagagcaaatccctgagggtgggagggtagaggggagcgggaggggatgggggaggccggccaggctgtgtttatagatgggaacattggtgagaggcgctcgcttgcttagttggtttattacatcggtaatgacttcagtagccttataagggtgtgtgcaaaaaaaaaaaaaaaaaaaatcaccccctccttcccctgctctccctccctcattccccttccaggctctcccttctggctttggcagcctcagctgcaggacacaaacaatctagggctgctgggctggagctgccggggccaggaggaaggtggggatgggggcatggcctggaggggcagctcctgggggcactcaccgtggaagggctctggcagagctgttctgtagcatcagtgacacctggcaactgcattcgccaacccggttcctgaagaattccaaagatcaataaagatcaagaggccctctgggcaaagggcctgttcagtgtggacttgatcacaggctgctggccagcggggaagatggaagtcgccggcttgactgagacattcaccccagccttagatttagggcaggaccctctcactgtgtggtcaccctttattttctcagctcttatttaaaaagaagaagaaaaaaagaatgtctggacaacagctaaggcaggcatccagaaataggaacacttttctgtaagtatataatataatcattcaatcaatcactcactcactcaaccaataaaaggggaaggagaaaggctaaccctgctgggaactgtgatgtagcaggttggtctagacagataggccctggtggtgggcctgcccagtgaccttgactctgactccatgatcccttaacacagaagtagttcctttccctctcttgctcgggaatggaagcacccttaacccccactcattgataatgctctcagatcagaactttttgtgttaaaaacccaacaagtgttttcctacatgagtggccctttctcttcttccttcaggtggggagggctctggattcttcatgtccataaacctggtcagtctcctgctggtgcacagaggctcaggccctctgctcaggggaggggctgtaccctgtctggctacagtgcagtggatttgcagcagattgtccctccaaccccataaggctgccacctgctggcatttctgagctctgaccagacaagaaggttctgctcaggctaggggaaggggtgggggcaggtctgcgagccagaggtgactagtgatggttgtaacaactgcatttcatacagcaccctccagctttcatgacacccacacgcagttctttcttgatatccacagcatgccagagaggtatagagtactgccatgcccaatttaaagataaggaaagggggctctggggtgggaccctcagggtctctgacaacagtgctcccactcatgcccctggatgtggccgtctcactagcactcagacccaatagcagatgtgccaagctctgtgacagattctttacatgagccatctcatttaatcttagaacagctctgtgagattagagtcaccactgtttttataaggtaagaaatatgaggcttataaaggtaaagtagtccaggcgcagtggttcatgcctgtaatcccagcactttgggaggctgaagtgggaggattgcttgagctcgcacgtttgacaccagcttgggcaacatagcaagaccttacctctattaaaaaatataatactgaaggtcaaggttaagtaatttgcctaaacacacagagcttgctagtggagggaggggttgggacctgtgaccctatgacctttgcactctaccctactgtgcttatcagtacaaatctggtctgggacatgtgtgtgttcatgcacatatgtagttatcaaccatacacatgatgtacacatatactggtctagctggcaggcacctgcacctggaggtctgtgtttgggaatatgtgcacatatgagttacatccacctggacaggcatctgagcatgcgttcttgtgtattctgctggcgtgtgtgggtctccacctcactctgcctggcctccctcccagtggacagacactggtagcccatggcctggcccaggattctcaggggctctggggcgctgctcacccttgggtgctggcacccatttgaagcaaggagaagccaatcgttgctgtcctccagccctcctcccgcctgctgggctcctctcctttgtccttctctccagtgccctcgtgctgtcccaggctgtgctggtgcaggtgccttcctgactgccttagctctttcactcctctctcctccctggccatgtatcccatagcctgtcccctcccagccaccctcctcaatgctcagactgtcagagggcacagattcaaggtgcagggagtctcaagtctggagaattttgagttcaggttgttcctttgctcaacaaacagcaattagaaacctcatgggtgccaggccctgggagaacgaagaggtcctcagtgtgccccgagttctcaacacttaaaaaggcttatggactttgggtgagcttgtagaataactgtgtgaggtcaccctgcttctgccaggctgctggccagtgtcaggccactcttttcctacctttaagcacagccttgtggtgcctgggttgacatggagcaggaagatgagatgcccaagggctgtgtttgcctggcagccctttcagcatctcctcagcagagtttcctcctgtcaccagtagaacacagcccagatgcaaacatcaggagcagacactgcccagatggcggctttaccccagctggactcctctgaggctttggtggtggacagccctgtgccgcaagctggagtaagccgattctccccatgggggaagcaggtaagggcttctgtcactttccatgacctgtgctcaaggtggggagcacagactcagacaagcctctcaagggctcctgtccaatccagccccaggccttaccctgtggcccccagcagtctaaggggtcagagaaaggtggaggacttgggatacaaaggctgacgcattaagtggatcacctggtggcagggcaatagcagtaactattcctacagccatacccttaaatctctgctgggcctttaaagcaaaccatgggttcatttgcagcctataaagttcatagtggcctcctgcctgggacccacatgtcagatcacctaagctgctggaacagggtcttggggccatctttgacatctgcacataaccagttacaaaatcagggccggggctgaagatgaggccccatcccaggagctgccacagagcatatggggctatcatcctataaactgaacctttcacaaagagtccttttgccttggcttactaagctctgaataagagttccactctggttacaaagccttggatcctgtcccaccctgaatcatctacctcttggatgggttctatatggaaaaattactttaaagaactaatttcggccgggcatggtggctcacacctgtaatcccagcactttgggaggctgaggtgggcgaatcatgaggtcaggagattgagaccatcctggctaacacagtgaaaccccgtctctactaaaaatacaaaaaaaaaaaaaaaaaaaaaaattagccgggcgtggtggtaggcacctgtagtcccagctactcaggaggctgaggcaggagaatggcgtgaacccgggaggtggagcttgcagtgagccaagatcgtgccactgcactccagcctgggcgacagagtgagattctgtcaaaaaataaaaaataaataaaaaagaactaatttcctggcaagtgtcaagtgtttcaagtattccagctggaattttgagctgactttttgtcatttccccttttggtacagtagacaagagctaggaagggaagagaggcagaaactacccacccatacctgcctcacaatcctagcagggacaggcaggatctgcccacccctctaccccctgcacaccggacccccggcttcctcccagccatccagtcattcccctcgaaaggcaccctgctctacgtctaggttgctggaggagtgaggtctctggcaggcctgccacgtaccctcaggaaactctccactgacttgcttcttctcaggtggggaaaaagccaaggccagggcagtggcctccgaaaggaatgaagaggctggactttggggaagaaaaagaggcaaaggctgcaggctggaggctccagtgtggtttcccaggtccttccagttccctgtgcacttgggagaaactccccaagcagagccataaggaatggaagagcatctgatttaagtcaaaagatgagggcttgaacttgggctctgttacttgcctttggatggccacaagcaagtccacgaccctgagacctcagtgtcccccgttattaaatgacgatgaggctggataacttctgaagccccttcctgctgggacagtctaaattttatgactgtccccagctggccccagacagtctgcctgccgacctcctggtgcacgcctcctctctggcctggcaaacttcccacagccctttgcttggctctgcccccaccccaccctttcttgctcggcctactcaacagctaagccttatcacatttgccaagattcagccttccttttccatcaaaatccccaaacaagctcatctcctctaggatgtctggcttgagtaatgtaagtattatctcaaagtgctactccttctatactgacgagatcatcagcaggtatttttacacatcatcggtttccattctttgtactgacctagggggtaagcgtgtaccttctccccattttggaggcagagtggccttcctggtaataactagttcaagcataatgcaaaggcagttgatgcattctgagtgtaccgctaataatagtagggggaccagcagctcacaagcatcccatcacttgaccacaacagacatgtcattgagctcagctgagattagccttgcctaaatcagcagaactttataggagacccaaagactcctaagaaataatgaaactgctttaaaaataaacgagctatttttaatagttattaagtattggggtggttcgttatgcagcaaaagataactgattcaggtataaagcacatggtcacaaaggacctaaggggatggggtacatattgggttttgcagtagccttggcatttagctctagagcttatttgtagctcagagctgtgaacatgatgggctcagcatggggagatgataaagtacaggcgagaaagccccttgcaaagtggtcaggcacccgggccaggacaggtctaaccatcctcaggatgtggcacgacctcctatttgtaggttaggtgcaaacaaatgctcttcttcgatgcttacaccaaccccaggacccacagaaggcattctgtctccatcaatccagggctggcataggattttaagagacagggcattttcaaggtaaaagagcatttctgaatcacattcatctaataaatagctacccaatgtcgactatgggctctccactgttccaggcctggaaatgtagcagtgtgcctcatggaaatgtagcagtgtgcctcatggaaatgtagcagtgtgcctcatggaaatgtagcagtgtgcctcatggagctgaccttcccatgtaacctagcaagcccttgaaaaggagagaaaaaagtaatggggaaaggtagcctccctgtggtagttttaaaatgtctgcaaattcttctctccaagaggtggaactgaatttacctccccttgagtacgggctgtacttagtgactcacttctaacaaagtcggaagtgatggcgtgtggcttccaagggtaggtcttaaaagacactgcaagctctgacctgggctccctcttcgatcactagctctggggaagccagctgccatgctaaaaaagacactcaagcagccccacggagaggtccacaacgcaaggagctgagtcctcccaccaacagccagtgaggagccgaggcctcccacctacaaccagtgaggagctgaggcctcctgccacagtcacgggagtgagccttggaagcagatcctccagtgtccgtcaggccttcagaaactgcagcccctgctgacatcttgactgaaacttcaaaatcatccagctaagctgcttccaaattcccagctgggagatgataaatgtttcaagctgctaagtttcagggtaatttgttacacagcaacagataacaaatgcattccccctatccccctgcttttccaactttgatccattcctccttccttcatactcaccatacaccacataatgggggaacaaggatgtaacaagacaggattctggggaactgagctcaaaagggaaagttctaatgaacatttgctatactgaagtggaagaagcaaaagcttgtgagcagcactgagcccgcacttgctttacctggaagtccaagccccacatcagtttgtgcttcttctggctgcccagacccaggttaggggagctaggaatttggagggaagggttaagggaggctggctggacatgcagactcacttgagcaggatctcatactggccggcatgccagggctgcaccttctttagaaccagggtgaacacgtcctcattctgaagcacctcgaagtggccagtgtctttgcagagggctttgccatctctgagccagtgcacggtaggaaaggggtcaccagctatggcgcaggagatgaggacactctggcccagggaggctgtcactgagcgaggcttactgatgaaccagggctgggtgccatcgtgaggctctggaaattggcaaagggcagagctaaacagggatgtccctcagcaggcagtgtccactcaattctccatggaggtgaaggatgggaagatagcatgtcacccaagtaacagattgtccagaaatcactgtgattggatacacaaatgcagcacacccttctcattgcacatccatctcggatacattctcagaggataatattaacatgactgtatatccaatgtaaggggaggtagcccagaaggcacggggcaccgagccaggtgctaatgatctgtatccaatgcgtgtgattaagagttgtcactcactttatgtgtgcttaacttgcctctcctcttaaatatgttatctaatggcaaggaccctgttaagcctataactcacctcaaaatctatcgctgccaaattgttaagtgtattacagatttccctcttagtactctatgcaccttggcaccagtaacccagagagggcagggacttcagaaagctgggaaaggcagccccactcagtcagagcttgtgatgttggacagggagctggcctctggggctggggtgggactgagggacgagagggccctcagtgggaacaaagtagcctcatgtggtttccttgcctccaaatcacttttggaggggctgcagcagcatctccttcccactcgctctgagtgggtcagcctcaccttgtaccgtgagcacggcctgggtgcggacctctccagcgctgttccaggcctcgcaggtgtacgtgcccgtgtcctccgggaacacttcctggatacaaaggctgtgctgagttcctctctgttcaaagtggaagtcctctgactcttggatctcattcccattgtgcagccagatgacttcagggggtggattccctgaaccaggaggaggggaagggggattggttagggaggtcctccccggccatgcagcaactctgcgctgaatgcagtgatattggatgaaacactccaacaactctctatgctttcacttccccatcagtaaaataggaattcaaacaggatctacctcatgggtttgttgggaggaccttaaaatttgaatagtgcaactgagaacatcttctgagatttgggaagttctcacataatttttttttttttttttttttttgagacagagtctttgctctgtcgcccaggctgcagtgcagtggtgcgatctcggctcactgcaagctccacctcccaggttcacgccattctcctgcctcagcctcccgagtagctgggactacaggcaccggccaccacacccagctaattttttgtattttttagtagagacagggtttcaccgtgttagccaggatggtctcgatctcctgaccttgtgatctgctgcctcggcctcacaaagtgctgggattacaggcgtgagccaccgtgcccggcccataatctggttttgtaccagtcttcaaaaccttccagctacactggccacactatattttcaaattaatctttcactgctctagctctatggccatcttcttcctctggaccatttaatcatgaatccagaaaatcctacccagagaaggcagaaaagagaggacaagagtctccatttctttgggtccatcacctgatggtcccatctgattttctggtggatcaaggatctgagcgggtcctcggagagcaatacccattgcaaccaagaccattttcatgttaatccccaagagagagctgcagagacagacctgacacttggacagtcatagtgacctggcttccatccatgactttgagatcagagaggccctgcaggaagatgggtgcagtgggcttgctgggagccacaggcagaaggtactcactcttcctgctactcttcttttctgtgtggtagaaaacagaacgtggggtgaacattcatgcattcattcaacaaacacagactaaatgaccacttggtacatgactgtgttgatgctcagttcccaccagaaactggcagctaacagataaagagtgtttggagtttctagagatcattaggaacaagatgcctcccatttctctgcttggcaatgacgatgttcttgcctgatagccaggaatgaacaatgagttcttataagtttgtgagttttaaaaaatattttatttatttttcagataaatgatacactcacatggcacaaaattcaaaaggtaccaaagagtatggcaagtctccctcccaccccatcccccagccaccagtgatctctcctcagaggcaacgagttttcagtttcttgttcatcttgccagaaatgatctacgtgtgtaacatatagaagcaaacaggcatttattttcttcttaaaaaagtaaatgaaagcacgttacacaaaatgcttggcatccctttaacaatacatcttggtgtctctcataagacagaactgaagagcttctttgtcattttcgataattatatggtgctccattcccatcctaggaggttttaagcacctcacaaaagccaaagacactacactcattagaatggctaaaaataaaaagacatcacatcccaggaattggtcttgacaaggatgtggaaaaacttgcatctctcatacatggcaggtggtacagaaccttctgaaaacattttggcagtttcttaaaaagttaaacatatacttcccttaggatctagtcatgctactcctgggtatgtccctgagagaaacgcaagcacatatccatacaaagtcttgtacacaaacattcagagcagcttcattcacaatagctgcaaactagaaatgacccaaatgtccattaacaggtgagtaaaacaaattgtgatatatccacacaatggaatattactcagcaacacaaaagaatgaactactgagggtaccgcaacagggatgaatctcacaataattatgttgaatgaaagacaccaagctgtagtcccagctacttgggaggctgaggtgggaggatcacttgagcctgggaggttgaggctgcagtaagccatgatcacaccactgcactccagcctgggagacagagcaagattctgtctcaaaaaaaaaaaggaagatgccaaagagagagtgcatgttggatgactccatttatataaaattctagaaaatgcaaagtccagtgacagaaagcaggtcagtagtggtgtggggcaggggacggggggttggattataaaggggcatgaggaaacatttggggacaatgagaatttcacttttaaaaatcatggcaaaggtttcatgtgtgtgcatatgtcaaaacttatcaaactgaacaccttaagtctccatagtttattgtacatcaataatacctcaataaaaactgggagaaaaaatcaatttctctgagacagggagtgtgtcggcaagtcaaggaggagggtgagaggcctggcgcctcactcacattcagtttcttgtggaggtgggtgaacagcctttcctcatgcttagaatccctgcctcacaggagctgaaggggaggggactgcagagtggctggccctgccatccacgtctcacagggaacaatcctggtgcaggacaagccatggctgcccagcctctggtctctcccttggttctgtgagccaggcagcttgactttcagtaatgccattttagcaatttttgtttttgtttttggcaggttcaactgttgagaaagggagggttaggatatctctaacttaaaccctaagtttctggggaaagggccacaggcattttgggttcttctcaacacaggaccacaaatactagaccttcttcaggaagtggagccatggggaggtttccagggtatgtaatgtatctgggcaggtgtcacctccaaagttgccaccgaatttttatccactgccactgaaaatgaaagcaggcctactgtagaactctcctagcccagcctctgggaacctggatggggagaggctgggaaggtccaggaggctggaggaaaacttcccccaaagcaggtgcagttgaagggcatggagcctgagtgtgagagcaggtaaccccccacggtccccttggaagatggggctctcaggcccctgctgctctctggtgctgctgactcagcaccgcagccttcgatggagggccgccaggggccttggcagaagctctgggagtgggcttgggggcacaggattggaaatgcattgatctatctcgtttctctcactaggctgcagcagtcaggagagctggctgcctcgggagagttgaggaatttcctgtcttgcacagactgagaaggctcaaggacaaaatgtttttgtctttctatagcattccctgttcctgcctctctgcaatctcagcgagtccccagccttacagagcttcatgcagatgggctcaaattcctagatgctacgggaacgtcaccaactccagcgcactcccctttaagcctgtggcagtctcctcttcaaccccaccttctctgggttcttcccacagcccctgtttcctgggggtttggcaaagccaagtcaccctgtgggtctcagccattggggactaaaagcctatctgcctctccctcccctgggagctcagaagtatgcatgaaagggtggcctgggagctgcctcccacctggcagctcactggttccacctgcagctgtggaggggatcctggcctcaggcaagtctgcctccgtctgaagccccacttcctcatcggtctctacggggagtcgtggtatcatcacaggactttgggtagttttaaagagataataggtaaaaatactttgtacaaccattcattatcaatgagaacatttgtacgagcctagcatgagaactgactcacatctatccacttgggctcaattactcaatgggtttatcagcagtcaaagaaccaatggagtctgggcttcacccaaggattatggactcatttttataggacctgaggcaaatactattaggaatacaaatgcgttgcttaaaaatatcatgggatatatctcaaagtaaattgaggacaagctttcattgcaccccctccaggagatgagtgagtgaacttgggggaaaccggccgatcggcagacatttagttcggtgtcactcattgcccccggtcctgtgttttgttccccaaagccctacagcaagaaagaagggaagatggaaatgattgggagtgaatgttcagaacgagcctgttctcagaccggcaaggtgggacccagtcccaactcaccattccactgtactggtgtagagaccaggagagacttaactaacgggaagtgacttggctaacatcatggggccagtgtgggcagacccagagctcatgcccaggccttctgatgacaaggccgggatgttacgtaggcgtcccttcaaagggaaccagtctcctccaacggtgcccatggtgaccgctccaggacaaacacactgtcagctgacccacatcctagatccttgacaactgagaaaaactaaagcagaacagagacaagccaggtgaaaagagcaacacaatgtgtgtgtgtgtgtgtgtgtgtgtgtgtgtgtgtgtgtgtgtgtgtgtgtattgcaattcattccaaagccaaacaaattattctggctcatctctggcctctagcctctatcagtttctgctcactcttctgtggacttaagtaaaatacgaaaggacagatggaaactggcattcttaactcgtggccctggctgtgtgatctgaagcaaccttcccaaagcaagcctcggtgttctctcctccaaacttatggcaacataatactgagaagtatgatgtctgcatcatcagtctaatgcatggtaatattgcagggttttagatgattagaaagtaacatataaaacagctagaacaatacatggcacacaagcagtataaaaatcaatgttttctgactttcccaacccaactaactcctttggttgtggaaattcaacctgataataactccaatgagaaaaaccccccaaaccagaactttcatgtaacgatgattccttataaagcccagcgctccaggattccaaaagatgttcatagctaattcagtgttaccctcaacatctcggaagtattgggcagattgtgtctgttttacagtggagggagctgagactcagagaaagaagctcgcctgtcctaaggtcctggggctgcgatgccccatgaggagggagatgctgctggtggggtcctggtctgggtgctttcccttgactgtcctgggagcagaggcaggtctcaattctgtgaggagctttctgtcatcatccatattcatgtccagagctacccattaccctgggagtcactcctctctgcttgtccttggcctccttctagcatcatcctggtttaaggaccagggtctgaggcaagaggcccccagtgacaaggttgtctcagagagcccaagacttcttcgtcttgggaggacacccactggccatggcacacaaatagcaagggatgctttgctgagacccagtgacagacttgcccagctcaaatggggccaaactaaatataccccgggtttccccacagctgtgcttcctgctgctctgctgagactgagcccagagagggccttctttctggagtgcagaaagggctgagtctccttgctttccttgcctaggattaaggatctaaagtgcatttatctgttgctctgttacttggtattagccaattcactcctggactcagtcattaaactgccactgtcccattttgacagaatggaaaaggattgatcgggctgtcgtccaatgggaaagacaagcacaatgactaagaataagcccaagcagattgctgacaagtaaaaacgatgccatgtagacgaagctgttaataggacttaagaaagagcaagaatggagaaagggaagaacagagagaagagaaagaaaaagaggcaatgtgaggaagagagagggggaaaagggaagcaaaggaagggggagagaatgagagacagacagatatacgcactctcccctttatgattctactgacccatggagtttttccgtccttgccattttggctgtttttgactcactagaagttgtttttgaagccagttcctagtcatgaaactaaacatgaaatgatcgctctggtgaagcaaaagcatcaaacaaatgacctatcaggatccaagagcagccatgcagaaagcccatgggctgaagcaggtggtggcctggtgctgctgctgatcacctggactactgtgggcagctgacatcacctcctgagcatcactttcttcatctgtaaagtgaattcggaagtgtcaagtggagttgttgtgagaattaaataaaacaagccagcttttctagccaattagactttcctatcaaacaattccttcttaaaaacaaattgatagtggttttactttaaaaacctaatataaattgatacccaacatggcgttttggaaagcttttatttagaggaagagttaggagcagtttgctacctcttgcactaattcttcttataaaataaccagtaaagcctcttcttcaaacccagcaccaggagtgaggcctttacctcctctaggacctgacactaggaacccactgttgcctttgtcctggtggctgaccaggatctgccatctccttctgcactacaataattctcctgtcttcccttcacagcccttccttttctttccgttgttttagtaggaaaaacaactaaattctgaatttctccttataagtgtgtttttctacctgccaacatttgctggtcaacttgctactttctgaagccccaaggtcctggatccaaatttgcattcaacacatgtttgccttaatcttggatctaccaaatattttccttaggctttgaacatgagctgtattccttagttattacaatgcaaaatgccattccaacagcaattctgattcactccaaaccctgttatactatggaaattcaacagatcaccaattgagggggcaccatggaagcacagtgcccccatctttctttatttggagttcaaaatccagcatggtccagggatcaccaccagcctcctcctttccctaaattccaggattgttaactctggaggattcatcaaagaagagttacattctccctgctgacacgccacacagccccttcccatttccagggggtttgtgcaagctgtaaatccccggggcatctgaattccccttaaacaaaagtctgtctcctaaccaaacagaaccttcttgaagtcagcaaaatggctactttgtggcattaaaaggatttttcctcccatagccttgttttcttttggcctcccttcctcccagaacttaagaagcaaatgggaagagaagtgtgcgaggaaaagaatgaaaggaacaatgacgtataatatcccaaaaaagatctctgaccagtaatgatagggttgctagctgggaagcaaggatcactgaaaccacagcctttccactgtcttagaagctataatcacactctaaacataaaggtatggcatccaaaccacccactgttccctcccagtgcgggcctggaagccacactctcagttacactgtcatcacatgggtcacattttgccactaggagctcaatcctgcgattctggatagcattcttgatctgggtctctatgtaattatgactgactatgggctgtagaggtggagagttataaagctctataatggccctattagtaaaatgaggctcaaattctatggcatgggcacaaacgtacatgtatatgctcagaagtctttctgtaacacaaagaacccatgtggtacacaaacccaattctgtactcaacctacataaaatgaaaatattggttataaattttaacatgtaattaattgcttgccttcttacagtttaaaggcttgtggacagatgttttgaataaactaagcttcttaatatatataaaaaaggcaagttaaaactggtatttattcttcttcaatatatttttctgtagccaatgtaagtatttaagaagttgtcagtgtttttaagcttgaggaggtcaggatccatacgttatgttaactggatagattgtatagtgtccaaagtacctgtgcataaccagggaagacaaaggaggtggctccaggctgccccgcagagtgcctggtattaatctgaaaacaaactgtgcctctactcattgccaagcaaacgctgacttcactgatgcctgttgtcttcattagaagctctgcatcaaaacaaatactctaataaatatgcttgttatattttattatctattctagagatgatcttttcatctttttaacctacccacattttatgtccttagatgccttaaacaggcccactaggccttcagttaaataaacaaaccgttaggctgagaaactatgtcaaatgggcacaactggcaggctattaataaatctagacacttaagaattttagccttgatggagatactccagggggaaaaaattttaaatattctagcccaaggaagcccccagcaatgactcagtccaaacgctgtgaaatatatactgtatttcagatattcctgggctctgcaggaatttgaattaatcatcctggatcaggactcatcctgggtcaggaggaaagacattcattgcttggttaactattggggaattttttttccctagcctgtgttggggaaagaaggaatatttgttgagggactcttttttttttttttttttttttttttttttttttgagacagggtcttgctctgtcatccaggctggagtccagtggtgtgattacggctcactgcaactgcagtctcgacctcgcaggctcaagcaatcctcctgcctcagcctcctgagtagctgggactagaggcatgggccaccactcccggctaatttttgtgttttttgtggagacggtgtgttgccgtgttgcccaaggtggtctcgaactcctcggctcaagagatccacctgccttggcctcccaaagtgctgggattacaggcatgagacactgtgcctagccctgttgagggactcttgaaggtaatttgcagatttcctgcacaccctaatgggcactgagcccccagaaaagcgaggaattctagggaatgcctccctgcactgcaggggaggttcggcaacctctgtgctctcatccattcagggaatgcatgctcccatggcaggcctggctctacacacagtatgacgtgatccctccctgcagggagcttacagtgtggagaggaagataattaagcaagtagagtaaaatgaaagtgaattttcacggagtaaattgttttctcctctcctccagaggcctggaatggtgagcccccgcattctgaactcactttctatcacactgccccgtctactttgctgcagccacagaggctgctgtcttgctactcctcgaatgggtcaaccttgctcctgactcagggccttgcacttgctgtgctgcccacctagagctctctttccccaggccatggacacctctgaggcttcctcacagcactaaagatacaccctctcaccctcctcgattcacacaccccactcactggctttttctctttataattattcctttgtgacctgctcatgttcttaacagcacgtgccagcatttgaaatgaggccaggtgctgactgctgctggcatcctcatcagaacgtaagcaccctgcaggcagggccctcagctgtcctgtctactgcagtttccccagaacaatgcctggcactgatcaatataggcgcgcagtaaagacttgttgataagtaagtgtaatactagaagcacacggtgttcagggaacgcattctggggtgattagggtaggcttcccagagaaagtgacatttgtgggagtttccaggatttggagaagaagagagtcactgaggagggaaggcagagaaagcatgaagggctggctgcagaaatcgcgtctgagggctgcaccagcaatctcgatgattgcaaaatctcggcaaaaggcgagaggtgagaaagagcccctgcatctggcctttggcacggtatctgctgagctctcagaataagcttgcttgcagcagagctgcccctcaaccacccccgagagaagacaactggagggacacgcgttgctgcatggtgccaccttgtggccagagcccttggaagcaggcacgagtgttcatggcttgtgtctggctggacacctccctcctctgattctctgatggccaaacaaacacacaatactgtagcaaagtggatcctttgggaaaacccctcctcagtcttggcatttgtaaggattgtatcttgtttaaaggtgggctctgctggacaatcataatcacagcacatacctatggagggtgtgtgctatcctatgctctggggatactttgcacattcattcacttaatcctcacagtaccgcgactgtcagcatctccatttcacacaagaggaagctgaggtctggaatgctaaaacgccagggtgcagggctagtaagtggcagagcaggactcacacccaggccgctggctccacatccatgctccccaccgtggcctggtgccacactaagggcaagagagggctggacctggacagctaagggaggggtgaagcagccatcagtgcagtagggaacaaacacctccactgtgatcatctcccccagcccaggcttgtcccgaggatccagagccaacggggctgccaatcaagtcagaaaaactccacagcagaggacagcgcagggagcagccccgagcctcctgagtgtctcagggcaccgtgccagggggtgtcgctgtgccaggctcaccctgctccaatcctatgccaagagcccaaatgctgccgggcctgagcgtgcggctgcgtcttcagccttgttcaccatttatggtatctgagcctgtctggtctttatagcccagtacatcccccacactgggagggggttctgtcatgcaggcctcttctccgagcaaatccaaacttccttggcagagtttttgcctgggacctctctgtgctttttgttttcctttggatgggtggtgatccttcaggtcccagcccccacaggcccgggagtcaggaggatggccctaaagaattcttgatcctttgcctgggactcccacctccaggggactcttagctcagctgggtcactctaatccaatctaaacacaggcaagccaggacagacattggattagtccttggctgtggctgtggagggagtatcagaaaacagagggctgagccacggcggctctacgtgtagcattctgactcttgctgccccttacttgactctggggttggccacgctggcctccaagaagagcccccaggtgagtcctgcttcctggacctcagagacaaggttctcagcagttcaggtttcctctgaaatctcattatcacaatttcctgagctccccacctggctcccagggagtcatgaagttagaactatgaggataaatgagtaagtttgtaaaccagaatctggctgcaaattcccagaggccagagctgggctctgaacccagtgtggtgggtttcctggaaggaaggggtggaccagtttctcgtgctcactcccggcagagagcttcacagagccagcgtcagtcacattctccatcagtgccagttccttcatccctaagggactgacactgcccagcccacagtggccagtcttcccctttgagccaggggatgtgtcctctgaaaaaggtcagggcataggaatgagcacagacttgaaagtcacaggctgtgggctccagggtgcagctttgcagactaacgtgatgcgcttaggcaagttacattcaattcccgagacttccagagccttctgtctgaaatcaggacagcatccttgtcccctaggctactgaggtctcagtgagagaatacgggtgaggtgaaagtatttaacacagtaagccacaaatgtttcttcccctttccttttctgcgaaacttcctcctgcagcctcccagacagtggctactcatacaacacggagatgttcctgacaggcctgagccccggggaatggagagatgtatcctcctgcttgtctgatgggagaccagtcacgctgcactcagtgctagcaccagaggacccagtcatgcacaggagccgggggcataggctcagggtgatggtgggatcaggcttacctgaaagccctggacccaagaagcacttccacgggaactgtcaccaggcctgctgataccacagcccagacagatctgtcttgagtctgaggctccctgcagttcccggggactaagtgcttggctgatgaatggatgaccatgataatcagattactggagaccaggctgctgatgtgtaaaaacaagcctgggcccgtgagtagaaggggggcagaaaggggacaacctgtgaccctctggaagcctcagtgtgcacgctgtgacccagggtcccccagcatgtaaggggtcactgggaggccactgactgttcagggaatacgtgagtgctctcccaagtccttttgtagtgtgcgaggttttcttctgaccagacctggagcttctggagctaagggagccctatctctttcccccatacctttccatggccccagtggagtgagggggtgaggaaaaggccacctctgatgacacccttgtcgctgtgaactcctggaggtcatctccctcacttcctacctgcaggtgcagcactttttaaggaccctctcctctgtccctaagaggttgcagcagccactcctctgtcacggcacctgccgctgccagtggtgtggagtagtgccatgtgcacctctgctccctggatttgagctcatgataccattttctacaaatgtgcccttcctccaaagcagaagtgcctgcaggaaaggtgcttctacccaggtgcccagaggctcctaccatggacggtgacccaggcgctgcaggacacctgccccaaggcattctcagctaggcaggtgtaggtgccatggtcctccggcagggcatcctggatgtggagctcagccacgccggcctcgcaggtggagcgagcgtactggatgggctgccctgtggaggaagcacaggaaggctcaggccaggcagcactggcagtagggacgggagccctgtcctcagcagggctgctgctgtcatgacgctgagacttgtcatgcttgctcagatccactgagggctaatgatgtaccatgcacatctccagccagctggacagaggcttatgggctggagaaagagccaggggctaaggagatgaaggaaagggagtaattgtgtggtggaggaggaagacggggcctagagggatgggggagggagaatctggaggaattaaaaatgcaggagggaaagggacagagttttgggcattctgtgttaaacagtctccaaatccacatcctcaacttcacagaattctgagcctggagagacttttacacggtcatctggcccatagcccagcctcaggcaaaacggagctttcccaggctgaacatggggtgcccagctccacttagatgtctccagaaacaacgattcaattttccactgtagatatttatcaaaaagcaattctgcatcccccacccactgttgcagttaggtgcgtttcttctatgcaattaggtgtattttagggttcacagaaaagataaatatagggaactaaaaatgactcggctccttttttccagagtcccttacatgtgacatgttccaggtaacataaagtcctgcatggagacaggagtgcatgcaatgagcttcagtggtttccttaatgctctatgttcctgggagtttatcattctgggatgtgacttttcatttccaggaaaaaaaaaatctcattactgaagagtctgtcctcggagcaggaatgtgtccagctgccatataggaagcaactgtcagtttcttcccttgccaggccccagggtcctggtttgcacttcataaaattggggtcggccagtggggaagggagacagtacagaaagaagtcgtctccctgcaatgcagtgttttcttctgcacatagcaacacttcatgtctccatgacagtttggcaaagagaccagcaagcacatcataggactagaggggaagattcctctcaacctattgcatttcataaaagtggggccgagggctgggaaaggcaggggcctggatcctgccactgagagaagtgagcactgctctttgtttttactttttgtcacaatggtaccctccaaacctctcttccttgacaataccagtgtattccctgactgccgccaatgtgtctcttctgtccaaacatgtgctgacaagccttttgagagctctcctttaactggaacgtaactcactgtggccccacaaacatgggatgggatggaggccccagaaaggagctgttggctcagggcacatcagaattgggagacattaggctctcccagctcggaggctgggttaaactaaagttagcagccaaggaaacccaacttgagcatgatcgccctctagtggaatgggtgtggaaacgctaagagtcgctgagaaaacaccgtcttgagtgatgtataaactaggagacagcaagctatggctcctgggcagaatgctaattgcagcttgtttttgtagcgcctgcaagctaagaatagtttttacatattttaaatggccgaaaaatataaaggtaattaatatatctcatgatatgtaaaaattatgtgaaactcacatttcagtattcataaagttttactgcaacatagccacactcgttctttcacttattgtctatggcttatgtattgtctattcttttactttttgagacagggtctcactcttattacccaggttggagtgcagtggctaagttttgctaagcctggctaagttttgctttttttttttttttttttttttttgtagagacaggttcactgtgttggccaggctggtcttgaactcctgagctcaggcaatccacctgccttggcctcccagagtgctgggattacaggagtgggccactgcgcccagcctcctatggctgcttttataccacaacagcagagttgagagttgttaaagaggctgtatggcctgaaaagctgaaaatagctactacctggccctttatagaaaatgtttgttgatacttagtctagactccgttattagtccttaacgcccatattgcattccagccacaaggaggctgcctccttgaagtcaatcactggatccaataggacttctgtcctttgctaagggctgggagggaaggcagacctcaattctcacttacctacccaagaacactacatgtaggaagactagatggcacttcctcttactcactaaagacagcttctagcaaagcctgagcaaactacaccaacaaggaaggttcacaggcaatacatcaatgacgcagacacaaatggggactatttggtgcataagtgttggggaccactgctcgctcgcttgctcgctctttcatttatttatttatttatttattggagttttgctcttgtcacccaggctggagtgcaatggcgcaatctcggctcactgcaacctctggcttctgggttcaagcgattctcctgcctagcctccggagtagctgggattacaggcacctggcaccatgttcggctaagttttgtatttttagtagagatgggggtctcatcatgttggccaggctggtctcgaactcctgacctcaggtgatccacccacctcagcctcccaaagtgcggattacaggcatgagccaccacacctggcccactgctgtcttaaggagtgtattctattaggtatgagagtgagctgagatcccaaaccttcttttccaccctatcttctcatagataaagaagctggtaccccgaggggtgaagtgtccaaggtcacccgaccactcagtggtggagaaggacaagtgcctgtgtctcctgactctcagcaggggctctttcaccctccctggggatccccacagtagtccctgctccatcttatcagtttaatggacagttctcagtcttctaaagtcagagttctcccacactgttgaaattaaatggtcctttaaaaagaaaagggtgataatatacggcaaataattttttaaaggaccttacttgacaaaaaaaagagttggcgagtctctataggactatcagtttaaaaagaataactggtctgtgagtcccagaaccacctgccactaaataaaaggtaagatccctcatgcgactttgagagtggttcattagtttattcatttatttgttcatttattgactcaataaatattaattgagggcctactatgagtttggccataagaaaagaaatccaactgctcatgcccctatgtgtcaggcatctcattaaccactttatagaaataatctaatttaatttcacaaccaccaccctgcacataggcagcatgattcctgccatgtagatggagaactcaaggctcagacaggagtagtaacttgctcagccagtcgggagcaggatcccagtgcccgtgctctctttgtgccctgtgcttccttctcataccaccaggatgtccaaggcataaatggctcagagggataagtgagaattcaggcagcgccaaagggcccaggggatgggagcagagagctggggcagggggaactcaccattcagcagccaagtgatccggggcactggggtcccccgtacggagcactgcagcacaaaatcctggccctcaataacagcgcagtccttcaggacactggagaaggagggggccacctccatcacggcaagccctgtgagggaaaaggacaggtcagctcagatcacagcttgcccactctggtgatgcctgcagtcaccccagcctcccaggcacgcctcactgtcctggacacctgggtaccctcggcagcctgcctttggcttctctctcttcatgcttaagaaacaggcagcaccagtgatgtagggacatggagcctgaagcagagtcacccgcaggggctttttcacagtcacaaaacaccctagccctggggtgcttagaacctgggcctgccttctctcctctgtgactcaggtgcctcctgctttgccttggcttttgctgccctcgagcctctggagagctccttcctgcttgttggtcctactctattttctagtgtctcttatcttctttaatatgtcccatcagtgattacacaatcttgtgagtatctctttacttgtataagccacaggctcacaggtgaggacatttcaattttaaattattacaatgatttttttccaattccagaactgaatcataggactcacatgtgctccagttttctaagcacagcttgaaccccattctaggtcaagggctcagagctgccggggacctgggaatatgcagtaatgatgcccttgtgtggtttgaatgcacattctggttgagaactgctgagctgaactttccaaaagccttctacatcagtgaattaggggacattttctagtttggggaccttaattaagagcaatagggataatctcttctatgacaaccagaacatgctgtacatgtgtcaaggtggctgatagctgagaaaaggtggaactggatttggtgcttagaagatatatcactggtgcttttcaagagagcctattcaatacagaaatgagaagaaatgtcatattatactgcaggggtttatgggcaagaaagctaataagatgtgagggcctactatgtgccaggtacttttccagatgtgattacgacaatgttatgaggttgttctcttgagttcattttacagacaaggttactaatttcccatagttgaactcgatgctgaagccaagttttacagccagctctgactgtacagctgcactttctcctccagatcctaggggaggataggcgatgggagggcagcgacaagacagagtgatggtgtacctggacaggcctggcactgagggagggtcagacagaccacccagaaggtgtggggaggcaccctctccatccctccccttggccagtgttgaactccctcattagagaaatgcctttgggagttatcaaaaaaggatataggctttcatgccaggtcagtttgggttagaaatatgctctcttttacaaggcatgtgaacttggacaagtcatttaaccttactaaagatcagtattcttatctaggaaatgggtatgattttcttgtaagattgttgggataactaaatgaaacaattcaggtagagcatttagcacaaaacccagcatagcacatcctcagtgagtgttagctgttattatcaagtagaagctgtgcatagagactctacttgaggcaaatatagtctagggatgaaagagagtggagggatagagtaggagctgcaggggctctcaagtggaaggaagattttctttcctttttcagcatagggacaactacagcatgcttgtagggagaaaaaagaggtctctcaataagggaaggggaaagattgaagaagtggtgagagagtaaatcattgttagatcagatccttgtgaagatgggaagggacagaaagagaagtcttgggaagggaaacagacaggtattctgtagtataggaaaacagaaagagagaagtatgtaggaggagctaaaagaacacccatcagatgacctgcttcatggtaaactcatctgccaagaattagctaggatgtttaggaactggagaagttttagaaaagcgagtgtcttcatcaagaagataggatgtggaatggcaaagtaaagacctctgaagatctactcctccataaaagcaacaacaatactggcaaaaagagtcaaaagcaacggtttcagaatgccagaaattaaccacaggcttgcaacattctgaggagcattcaataaaaacaaacaaacatccaggagtggtggctcaagtctttaatctcagcactttggtaggccaaggcagaaggactgcttgagccagaagtttgaaaccagcctgggaaacatagcaagactcttgtctctaccaaaaaaaataaaattaaaatattagccaggcatgatggcatgtgcctgtagtctcacttagtaggctgaggcaggaggattgcttgagcccaagagtttgaggctgtagcaagctatgatcacgccattgcactccagtctgggtgacagagcgagactctgtctctaaaaagtaaaaacaataaacaacaacaaaaaaccccaaacaacaataccctgcccctccaccctcccaaacaacaaacaacaacaacaacaacaacaacaacaataaaacatagctgaatcttggtaagaacagcaagctatgtgctttttcactcttgtgccccttgccccagctctggggtaactctgaaaaccgacagtacctatggtacttgtgaaaatcagccacttagcaaggggcaggatgggttcagagctcctgaaaaaccccatgcgtaagagaatggtcactatttgccctgtctggcagctccttcaacgactccattttccgggttgtctttgtttaatccgactcaaagtttactctgtgtggatggccctgtctccaggatgtttgttaaaatcaatcagtagcaattgtttaacattatagctacttgagacagcaatatcattcggagctaacaagagcctgaccaaaaaacttcaaaggaaaaactggggaatgagatgtccaggactttgaaaagctctgacagattcctgagaactgaggagcccaaatggttgtgcagggctgtgagcctgcccaggaaagatgtaagaaggccctcctgtctcacctctggctgacttggagctttggtgcaagcagaaagtaaaggctaaagcagagctgtaaactgctggccggagcactgaagatgggcgtaacacacacacagagccccttggcaaaggctgggaaaagtattagttcaaggcatttaaggaactctccatccaatcaattaggtgatcactaaactaactaagcagggacttctgtggccgcacatgacaaataatccagcctttacagaatgggagaggattattgtaaatcatgtctggtaaatgacttgtatccagaatacataaagaactcttgcaactcaacaataaaaaagtaaatgatgcaattaaaacatgggtaaagtatttgaataggcatttctctgaaggagatatacaaatgtccaataagtatatgaaatgatgctcaaaatcactagtcatcagagaaatgcaaatcaaaattgcagtcaggctgggtgtggcagctcatgcctgtaaacccagcactttaggaggctaaagtgggaggactgtttgagcaaggagttcaagtccagcctgggcaacatagtaagaccttttatctacaaaaataaacaaaattagctgggtatagtggcatatgcctgtggtcccagctacccaggaggctgaggtgggaaggatcacttgaggctgggatgttgaggcagcaatgagctattatcacgccactgcactccagcctgggcaacagagtgagaccctgtttcaaaaaaaaaaaaaaaatcatagtcagatgattgtgaatggctataatgaaaaaatagaaaacaggctgagtgcagtggctcatgcttataatcccagtgctttgggaggttgaagtgggaggatcactcaagtctaggggtttgagaccagcctgggcaacatagtgagacctccatctctacaaataataaaaaaaattagccgagtgtggtggcaagcacctttagtcccacctactcaggaggcgaggcaggaggattgcttgagcccaggagttcaaggttacagtgagctattatcatgccactgcactctagccccattggcaaagcaagacctcattttttaaaaaaagcaagaaaccaagcaagcaagcaagaaaataacaagtattggtgagaatgtggaaaaactgcaacacttgtacattgctagaagaatgtaaaatggtgaaaaacagtttgttagttcctcagagggttaaatccagaattaccttatgacccaacaatatatgtggtctaaacatcaaaattgaaaacaggtattgaaaacaactcatacataaatgtgcatagcaacacttttcaccatagctaaaaagtagaaacaaccacatggaccttaagtgatgcgtggataaacaaaacactgtatgctatacccatacaatgcaatatgattcagccacatggatgaatgaagtactaacacctgctacaacacagatgaaccctgaaaacattaagctaagagaaagaagccagacacaaaaggccacatattgaatgattccatttaacatcaaatgttcagaagaggaaaacccatagagacaaaaagtatattagtggctatcaggggttgtggggatgggagaacagggagtgacagctaatgggtaggatttttttgggaggggtagtgaaaatgttctgaaatcagatgatggtgatggccacacaactctgtgaatatattaaaaaccactgaattgtgtactttaaaagggtgctttttatgttatgtgaattatatctcaataaagctgtcacacaaaacacaacaagatagggaatcaacctgagatgtattaccccatgacgcgaacaggctaaaaatagtcttctgtgagacttagatgaattcacagcagaagaagccacaggagaatctaggccctctggatacgccattaatctgtggtggacctgacaccatatttctgtcccctgcgcagggatagagacctggcctggatgatgaggcttgatctcctagacctgtgaactctgcctaccagcactcccacctgcaaatggcatggataatatttcttgtaaaggaattcacgaggatagtaaaaatcccagttaaacaacagttaaaatcccagtgaatcaacagtatacagtgaaaagtaagatgccccattccttcctgtgaacccctagtttccccttcctagagggacttttgtgctcttccagaaatgatttgtgcacacacaggcatcttttgcatgtgtgtacacagatcttttcttccatttacacatgagcctgtactttgctcctctcccttcctagtgcatcttgaacatgttttagcatcagtctacaggatgttgtctggcattctactatatggatacatcactaactctttttttcttttggaaatgtgcattttgaaaattttcaaacacacacaaaagtagacaaagcagtgtagtgaattcctatgtacccatctctcaactttcatttatatcaatattatttcattgatatccctgccagtgctccccaaacatgaattatttctaagtcaaatataaaaagccatatcatttcaccagtaaataactcaggatatatctctcaaacagatgaacttataaaaaaaaaagtaacaagaccaccatcacatcttaaaacaccacgaattcctttatattaaatcttatcagtgtccaaattctcttgatgttcccataaaaactttttaaagattatctcagtcaggattggcagaagattatcaaaaattattgtaattgttgatgttactatataccttctaatataagttttctataggttgtctttttttttttttttttgcttgcaatttgtatgtggaaaaaaaatgggtgaaagttatttgttccacagtttccagcagcctgcaatttgcagattctactcttgtggtatttgttaatgcatttctcaagggtatggcatgggcctggggcttacatatgcatttagagtaagggggaaattttatagagatagacaggtacaagaatatttatcataggtatgttataatagtgaaaaatggaaacaatttaattattcaacaaataacagcatacctaaattagatacagccatttcatgcaatattatatggctactaaaagtcatgctttccaagaattgtataaaaagatgttaatatcacatgagcaaattaggatagaaagcagtatacaaataccacaatggtaagtttgtataaaaaacattaaaatataatttatttctgagtcataaggttatatattgtttaaattccccacaatgaacatgcattacttttataaacagacagtacaataaacataaaagatgtgggatcccacatcatctcacattactctaaacctgtatatttaatgaacactcagttctctgtggttacaaacgtgagtcacggcactattcaaacagctgagggacctaggaaaggtagctgtcagttgggctgggtgtggggccatgcatgtttattttgaggtgattctgatgtgaactcctgattatgaatcactggcctagagcaacacacttggccttggcatgtgattgggggtgacatttctgtcgggctgtgcaccaaggcagggggctataggagatgaaccatctgcagaaggtgaagcaccccatgaatggttgtcccacagagaatgcggggtgacctggagaagtgtactcactttccacttggagggtccagctacaggacagctggccttgggcgttggaagcagtgcagctgtatgtcccactgtccctggtccgggctttcagcaggcagaggtaatgggagccagcatcttcataaacctcaatgctgccttcctgtctcctcacgggggtgccttccaggaaccaggccacttcaggctttggaatcccggaaactacagggccaggtaaagaacgtgagctccctatgccctggagagcaccctgtgattgtgaggtaggtggggaaggtgtgagctggaggaaagggctcagtttggtgtggagctgccctcccacctctgagtctgcttcctcaccctcaaccacactccacaagacgaaacctcttgagagagtcaggggccttgaggaggatgaatacagcgtgatgggcaaggtctccaggttggccaaagccaggcaaggggaagaaagggcggaggagaccatgaggtttgcttttcgatgttggcgataatgagggtgtttcttctagggtggtaagaactagggccagggccagtactctatccaagagcaaacaacaggctactgttaggggtctctccagaataaagggcatttctacaatgagtcactcctaaggggaaggcccttgtaaggtggttttctaggggagctagtccaagaagatgagtggatataggtgatgcagactagctgggtgctgaaggaagggagtggccaccaaggggctacattttggcaatcggtgaccctaattacctctactcaccttcacatctgaacttgacagtttgattttccttgacctcctggctttggggcttgctctcaaatttggggaatgctgaatccctctggccctccatggggattctcctgttagcagccttgctcacaacatcttggctccccaggccaggctgcctggtggggaaggtggctggacggggaggagctggcctcttcctctcttctccagaaggtgataggacccccaggcctggtgctcttggttccggctgaactcttgcggcctgcagggtgatggagctggaagtcttctgaaggaccggggtctgcggggccgttctgggcgagtccttgcatgactccagcttggactcccttgggggctgaggctggctgtttgcagcccagggtggggagccacctctctgggggctggagcagttcttgcttttggctgcagcctccagactgtccagcttcgactcctttgagattacattggtcacctctttcctgacatctgaattggtggcttttgtttctctcacaaatgacctgtgtggtggtgagggtgggggtagggtgggtgaggagaggggagaatagaatgatcatctggttactcacaaatattactcatcacaagcacggattccagggatcacaaaagcccacaagttaagggcaagtaagagcatctttctctgcagtttgcccagtttcccaagccacagcacaagcagccattcccgacacttgcctgtcccacaaccctgcccagagccctgctttccctacagttcccttctctactagtgcctccgtagttcaacctctgccaccggtgtcccgtgtccactctgccctctctaatctattttctatacagcgaccatagtcgatcttttaaaaacattaatcaaattatgtcatttcaagcccaaggattttccaacagcttttccactactttaagaatgaaactgagccccacaagagggcccacaggaatgccagctcctgatcgtacagacattggcctgccattcaccaggctgcggccacactggcgtccttctgggtccccatgggcccatctcttggttcacagcttgtacatgctatccctgctgtttggagcacactccctgagcttttcttcaccagctaacattcctttgcacaggtctgagctcaaataccaagttcccgaaatggcttccctgcccctctattctaatcagtgccttcctgttgtccttcctcacagacgcatcccagttggtaatgtgcgttcgtgtggtttaagccctcctctacgcccacccctgcacatccagcatctagcgccgagcctcacacacaggaaagaggctcctgctgggtctgggctggatgagtgaacagattccgccctggaatgaggaaggcggccttctcagagcagtgttcttcctcaggatgctaaccagagaagagactgtgtagatactgtgaaaggtggcaacactgagttttccagtctcaatactgacagcaacctgagatagaacccgtgtgtcatattacaataggagaacaagacaaaacacccaaaataaaacaacatcctccaaatggccaattcttctgccccataagatgattcagaaattcagggcatttctcggtaacatccttgcagggcatttcaagagggaaaacgtaaaagtcacaaagcctagacatacctattggcactgtccaaacctggaaaaagggggaagggtggaaagactgttagtagaatgctgtatacaccaaaatttccctccccaggcacttcctcatcaccgtggtcccaccctgctggctccttccagcttccctggtgctgaacgtctttggcctttgaactccccccagccctagagtacattgtcaaagcttcaggttctgtcctttgggcttcttaatagtggctggtgctaccataccctgagggcatggaatctgtttctgttcactaaacagaaggaaaaaaaaccaatccagggacaaacaaacatctactgaaaattccaaacccaaatgctgtaacttaccagtgtacagaaaagcatacttttaatgttatccagttcttcaaagaaaaaacataaaatacatatttttcctgctatattctttctcaaattttatcatggtaaacttaaaaatatacaatagtagaaagagataacaaaccctgaaagccatcaccacgattaaggagataccacattttgccagtcttatatatccatttttgttttctttcgtttatttgtttttgagtattttaaaacaaatatcaggcaacatattttgtcatgaagtccatcaggagggaatagtatttaactgaatgtcagggcaggcacacattgctctgggtgtctggtggcatctccttattcagcagtgagccaccaagtcaggtcctccggtcaggaccaggatttcttgttttagtgatgtcaagtgaaatagagaataccagcatgcactgtacacagtacggtcaggatggtttcctgaaacttgtttacctatgtatacatgttctgggttgcaatgtactgtgaaatatatttctttctgtagattgtgaaaaatacccaggccaaaaaaagtaacaagagcaaagatgaatcgtttctaagaagaaggagatgcagaacagaaaaatcagaagaaaagagagggacaaagaaggaggaaggactgaaagccacttcccttcctgacccccgagttcctgctccagtaaagtgacatgcagccccttccccatccctgcactccctcctcagcccggacttgaggaaccaaagaactgtaaggaggagacgtgttcaacaagacttacaaggaagaactgacagggctgacgactcaaggagaaagaggcaggggtcaaaaggatgctggaaagtccagtctgggtgtgaaggaacatgggaaccctggtagagggggtcaagtcgaaggatcgcctgacttgaaagacagagtaaattatcagtaaattctgggcaggttaaatttggggtgatggcaagacgttagcaacattcattcttccagttggcaaccacagatacaaaagggagtccgggtgagaagaaaggactgaagacatggtgggggagactatgggaacacaagggaaggtggcagccaagcacagggcatcttccctcgtggccaggtctgcgctgccctgttcaccctttcttcttgtcaaagacctgccccttgtggccgggcgtggtggctcacacctgtaatcccagcactttgggaggccaaggcaggcagatcacttgaggtcagcctggccaacatggtaaaaccctgtctctacaaaaaatacaaaaatcagccgggcgtggtggtgtgtgcctgtagtcccagccactcaggaggctgaggcaggagaatcgcttgaacctgggtggcggaggttgcagtgagctgaggtcatgtcactgcactccagcatgggcgacagagcaagactctgtctgaagagaaaaaaaaaaaaaagacctgcccctggggagtgcctgggtgtgtgagtgggccaggtgtatacacacacaggtgcgcagtgaacaagcagctcctctaggagggtgcggcaccaggcagggatcgttctgcactagccgtccactggtcgataccttggatggaaagttcagctgacatcgaggccttccccgacccgttcaccaccaggcacgtgtacactcccacgtcatcttggttgactccatggatttccagaacctgcatgccgttcttctcagacacagacacacgggcactcggctgcagtggaacatttccctgtggatggcaatggggtaacttggtcatacaaatctgctcaccttctggctgtgtcctcctgcctcctgccaatcctagtgggatagactccagggcctgggcagcagcgtcctctgctgtgggccctgtcaatgtgctcagagagccaactttaaacagttcaggggccctgacttgaggtctgtggatgtggtgtggtgctctgtcctgcttagagcagttgcctgaaaactgtttcaaaggagcctgagtttgaggtaggaaatcccatattcctcacttcagtttttccttacctccccattccttttattcttttcctaggggagttcaagagaattaggaagcaggtaaaaggtgtcaatacccacttttacccaggcattccaactctgaaaaacctattcccctggccatgactctacctgttcccctaggatcctcactgccctgtttaacagccatccccaaccccatgccactgcctccctgcccgcccacctctcccccttaagcttcacttcccccagccctgaatgatttataaatcccttctacatggaggctcctgacaatattttgaggtaggtggtattatttctatctcaccgataaggaaaccaggattccaagaagtcaaatgacttatccagcttcacaggctttataaaccagggagctgtggcttaacacctagaaccctaacttcacagtccactcttgagattgtcaggcttgtcttgactcagaagttttctgctattttgtgagtgtgagaattgtcagaacactgtggtctgagtaacagagggagagttgtaatagggacaggaacatgcatccctaacaaacatacagagaacccctgagaaccgcctgaaacaggaggaacagaatggaaagactcctactagttgaagggtctaaccctgaattttcagggtccctagggctatgatatggtttggctgtgtccccacccaaatctcatcttgaaatgtagctcccataattcccacgtgttgtgggagggacccagtgggaggtaactgaatcatagggtgggttttctcatgctattctcatgacagtgaataagtctcatgtgatctgatggttttataaagaggagttcccctgcacatgctctcttgcctgccgccatataaggcatgacttggctcctcattcaccttctgtcatgattgtgaggcctccccagccatgtggaacggtgagtccattaaacctctttccttcataaattacccagtctcgggtatgtctattagcagcatgagaacagactaatacaggctggatcagggtcagggcagacagaaacctcaccttgagccaggtgacctgcggttggggccggccagtgatcttgcaggagaatcgtcccatctgtccttctttgaccacaactcggcccagcttggtagcaaactttggtgggcactccccccagatgctaggacgggtctccactgctggagctgaaaatctatccctgtaaggaaattggcagagaatccagtcccagacaaggcagcaattcaaccatcctctctccacctcactcaaaggcactaagttaaggtcagaagccatcaaagtgtagccttcccaattttatgcctcagaaactttctcatgctctctctagaaaaatgtgtggcaccaaaacctatttcctctacctcttgggcatgcagctagacttcatttactagccttccttgcagttaggcatgcctgaattccactgagccctggctgaaagcctgggttttagccaggagaccatgagcagaagagctgtatgccacttccagggccgactcataagaacctcctgtgaggctctgcagtctctcgtccactctgctggtgagatgcagaaggcccagtgggggctcaagggcctaggagatgaaactataaaatggaagaagcctgggctcctggaagataatgtggaaggctctccccatgttccaggatatctgaactgaactttccctgagtaagaaacaaactttccctgggttgagccactgtgatttgaggcttgtctgttacagcagctactgttacccgcctcttctaggcttgcttatttcaatcttctgactattgccttgattgttagagtccactgcagactctggccacctctcccacttccttacatttagcagctgggccagtcaaaggagccaatcacagaggcagccaggtcaggaggtgctgtgtaaatgacacatctcattgtactaggctcccgccctttggttattataacctaggagagccaagacttactccccagacctatcctgctcaagtcagcaggaaagcaatccaacccttactctgtcttgaacatccaggacttaccctaaggttttggaaacaacaggctgaccaagctgcttcgcaaaacttcctgcaagaaaaagagttgatgagtcaggtctgagccaccaacttggagcaatgaaagtaaaaagattcaacagcaggggtgggtgggatagtgatggtgatcattaatcttgactgagcatgggctgtgtcactatggatactatggtaggtgtttacatacattatcatgtgaatttcttgcaataattttatgaagctgatactacattatcctattttttaaacagatgagagaaataagattcagagaagttaagtcatccatacaaggtcacaaagtcagtaacagtgcagaaattcacccaggtctgccagattctaaaactctcaaccaccctgctgagttgttagggtagtacgctctaccttccattttggggattatttgggggtgattcaggacctctccagaacattttctcagttaaagggagggagggaaaggcccatgcctatctcttaccacacctactcttgactgacacaatcaacactccattcttccacttaaggcctggcaagtagcagcaagctgaaagagagcaggacaggtcactgcagatgagctacagcggagccagcagctcctgcagaatctgcagtgctgccacactgaacactgccagtcctgggcaaggtgctgctatgctggacactgccagtcctgggcaaggcgctgctatgctggacactgccagtcctgggcaaggcgctgctatgctagacactgccagtcctgggcaaggcgctgctatgctgggcactgccagtcggtcctaggtgagatgatgaggccatagtaggcgctatcctactgggcgctgctgatcctgggtgagctgttgccgtgctaggcaggaggccattaaatagcaaagccagcaaggcagctggggttagctcctttcatccagctcctgcagctgggagggacaattcacaatgtcaccatgaaataactctaaagtagtgggagttttattttgaggggtggggtgggaggaagaggtcttttttgagatgatgatcaccctgaaagttgttcttcttttgccgcaagctggggatgtttataaaaccctatcccagggagggtagagtcatcctctgatatcagcagacagttgctgtggggaatttgcagggagtttactgcaaaagagtaaacttccttaactttgactctgatcacatttatatgactgtgtaagaacataggtgtggaggagaaaaatcatggctattttcatcagccacacccggtttaagattccaccagaactttagtgaaaagggattaataacaaacactggcatcacatttaagctgtggctccatataattggtgattacgatacaggcatttctgtttaacattacttagtgagctgtgtctagttttcattcctgaaagtgttttggtttttgtcattccattctctattcaaaagtaaaagaacttctaaattgataaaaggagagacttgttttgaaaggacccaactgacagtcaagatgctgggccctcagatgctgctggaggcagagccaactgtccagtcctcctggaaatacttgagtgaggaaaaatcataagctttaaagatgctctgctcttgggacagcacctccgtttctgtgactccattcaaaggaaacgacgctaaagttagaagagaaagtttacacagctattcacttttatcttatttgtaatagtgaaagttagaagcaacataaatgtcactcagtaggaagaaaataagtagtcaggtaaaatgtacaattagacatcttattctgccattaaattatgtttaagaatatctgaaacgtgcaggtacatgttaggatattatctcattcgttcctcagcacactccaaatgggctatgatcctctccgctccactgggctccatcccagccacaatcttgtcaaacccaatggttgacactctgtctccatctcactcagatgctcagtagtatctgacacaaggtcccactccccttcaaagcactttctcttctagactttcctgcttttaccaggttattcatcttctctcaacctccttctctgctcaacctttgcatgctggggcaccctagggctgagtcctgggcctctccccagctccatctaatttctcccaggaggtcttagtcccatagctttaaatatcatctatatgctaaagacccaacccatatccccactagaacttcttattcactcatcagatgtatccggaacaaatcccagcacattgtaggtatttaaatatttgttaaatacattttgtgcagcatacaaaattacctatttaatgtgatcataattaggtaaaactaaaatacccaaagacaggaaaatgacaagaaaaggtatcatgttattaatactgattattttgggggttgtggtactctgagtaattttattcagctgtattttctaaaacctataaatacaatggtaaagaagaaataaaacatgaaaaacataatctagttgcaaaaaaaggggcagggaggaagaaagtaaaatctggcatccaaatagaggatggatagggccttctaaacacgctccatacaacagcattatccagtctctaacatttcatcacaaaatatccgtgtaccatccattgtactacccacactactgtatcactcatttcatctgggaataaagattttataaaaattagactgattaactgatgaatggataaagaaaatgtggtgcatccatacaatgaagtattattcagctgtaaaaggaatgaagtactaacacgtggtacaacatggatggacattgaaaaagtgcattaagtgaaggagctcagacccaaaaggccatgtatgataggattccgttcatatgaaatgtccaggagaggcaaatccatagagaaagatggtggttagtagttgccaggagctgggggaggaggggatggggaattaatgctcaataggtatggggtttccatttggggtaataaacaagtcctggaatgagatagcagtgatggctgcacaacactgtgaatgtacttaatgacaattgtacactttaaaatggttaaaatggtaaattttatgttaggtatgtatattttaccacaataaaaaaaattagactgagcattttaaaaagtcttgggagctaaatatcttaatccaaaaggcttaaattcctttcttccttaaaaaataaataaaagcaaaaacatggcactttcccaaagaatagcaaaagaatgctggggagagatacttctatgtcagggtaagagggtatgatgaaaacatatcacataaagcagtcagctaaaaatggaattgatggatgcttattttaatatgagttaacagagagttcacatcaagacaaaaagaatttaggctaaaattactaacagggtctatttataggaaaaatttgaagttgcaaattgttagataaggcaaaattaattttgtaaaagtatgaaaatctggcagaacagtaaggttatgtagaaaaataagtggaaaggggattaaagtagaaatgcaaaaaatagaagaatgagttaagagaactggtgaggacagaagcaagttgctgagaaaaaggagaggccaagacactgacggtatttgatcttagatttttcaaagacaagtaaaagagaatgctggcaggtcttaggattggaaagttcagtggtggaagggataaggtagacctagctctgtttgtcaggtgatacagaaagactgaatcgggtcagaacatactgctcaaaaagtgaataatgtgatcaaaattgaaaggagccgaaatgcttctaaaaatgtgcggtgatataatttatcatccaaacagagactctcaacactgagagagatgcaattaataatcatgccaggatagcaggagaaagctaggactgttccaggaaaagtggggagcagtcaccctacttgtagccaacttcaaagtgttttttgaggattacttaaaatagtggttctccactctatcagaacaaatatccgctttttataacacgtattaactgatatccccatgcgaccctgatcaaaattcccttctaatcacacatacacgtatgtgataatttcaaaaagaaaataaatgtaaagccttaactaaagcattacggtgatatagagcgaaagtgaattataaaaatatggatttcaatatgcaactgttcaagcatgaccatttcaatttacataagtgctcaggcacattagatgacaatgaaatggcagattcttgcattaactcctaatgcatgtttagatttaaaagtgaatgatgaaaaatcatgctgtacaagtagcacagcaaagtgaaagagcacaggtctacagtggacactagaatattcaaataaaaagatgtattatataaaaaagaaagaagaaaataactttaaaagaagataacatagcaagacaagttacagaccactgaagtagagaacatttttagaaagatgattaatgtattaatgtggtgttaaaacaattctccgttttatgatacggggttgagtagtaagaaaattatcacagtaaaatttatcacaggacttcaaggtaaaatctcaccttaccttgaaatacacattcagtgaatggttttgacaaaggaacagtgataataacaagagactatagagaagacatgtgctaggatgaaaacagcagtcatctccaaaaaataatggaaatacataatttttttacaatatagatttattactgttccccaaagttttaaaaaatgtgagatggcaataaaactcaataagatgcctacattttatgcatctccattaacttaatactatttgcttctaatattaagagttttaagtctcctctgatccacattttcagagcaatagtgtagtaacagcactatctatatatacaattatatgaggtaattatatatagatagaaatgttatatttcatttagtagaaaatttgtgcagagtaaatttttcaaaaattttggaggatagcttcattccttttaatcttccctctaaatgatgaccatttcttcaattactgggctctttttttttgtattattgaagactaaggaaccaccgatttatatatttgtggtgtctgttctggtaggactgtgaggaactgggaaaagattcttgctgtgaagcccatcctgtacccctagtgcttgccccctaaatccagcaacactcccaatcactgggaaaccaaaagggcccccatgaatctcctaagtgccccctagagggtggtactgtctctgtttagggccagtggcttaagaaaacctctggagaagtgcctagaaccagaatttctggttgaatattaaacttggtattgaagaaaaaaggaatgaaaaaagtcaaaactaaaggtcactgaaattgctcaatgtgaataacatttttgccaaaattctcctctttgaagcactctttcttttaaggctcagatattattctagattttgttgtacatgttagtctacttgttgaagctctgaccagtgcttatatatactaggaacggaatccctttcttagtacaggggatgaagtaccaaaggcagctacagaggcagtcaacaaatatttactgagctctttctacaggccagacctatcatggctcaggccctgtgctaggttccttacactggggattcagtaactgataaaaagagacatgtcttgccttcatggagcttacagttctagtggagaagaaaaacatttaaaatacttatttataatttatttatttatttttattttttacgtatttttgagatggagtctcactctgtcgcccagggtggagtgcagtggtgcaatcttggctcactgcaacctcctcatgtcagactcaagtgattctcctgcctcagcctcctgagtagctgggattataggcacccaccaccacatatggctaatttttatgtttttagtagagacgggtttcaccatgttgtcaggctggtcttgaagtcctaacctcaagtgatctgcccactttggcctcccaaagtgctgggattacaggtgtgagccaccatgcccggctttatttacaatttaaagacaaataagttcaagtataaagaattgtgaagccaggcatggtggtacatgcctgtagccacagcttctcaggaggctgaggcaggaggattgcttgaggctaggagtttgagctttattgttctttatatcctagcacaaagttcaataaaatctgaggaatgaagaagaggctagaactaacagcaactgggaaaagcctaaatctaccaaaggccaggggtggagatgggagaaggaggtggaggaatacgagatggaaaaaggagggagcatcagtagcaaaaatctaagttaggccagcaagggcaacctgtgtgtattttggagggaaaaagaggcaaaggcaaagtggatggtgaagataaaggagggaagagattccagctaaaggaaatttggaagtcatccttcaagaacagaatgggaccaagtaactttccagctaactcttttgtatactaaatgagtaaggctgcttctgcaaaggcagtcttgaacacacaactattttacagcaaagagtctggtggggcaaaaagaataatttccctttctatcacatttgtattgttaactttaatgagacagaaaaggacaaaaactcagagcattttaagattctgcctagattttaaaaaatagggtatatacccctagaaaatgaagtcattggggagttttagaggttgaaaagcatttataaagaacataaatgggaaatataattataggtccttcagatgggtagaaaagttagataaaggaagacagtccaaaagaaataagagcaaaaagaaccaaaagaagaaccatgacaaacatccaggaggaacacagtaatttaaaactcagccagtataaatagacacggcctaaaaatgtataatgtcatcaatccaacccaacatgaagataaaaggagtctaagagatctgcccctgaaaaacggcagtggcaacaaaagatggcacaggagcatttcctacgaattcaaggtggcccgagaatcctggtgtcagtggcaccaccagagctgccttagtggtcaccagggctactcttctcccttaaatcttgtgacagggggtcattctcccttctgctgtcacagtctaggtgacctgctggctggccctctctctctcacatagtcagagcctcggtctgcactgcagtagtttcatgcgggtgtggatagcaggagctgcggcactgaggggtggctgggggtagggaggaggtgtgcttggaccatctgggaggggagagccaggcagacggctccagcccagtcagtgttttcagcagccctccgggtgattctgatgcatgctcaagtttgagaatcactgtactaggtggaatatatcacacatgtaattaaatccctccttgctactccaagagtggtctgtggaccagcagcatggcatcaactggcggctggaaatgcagactcccaggctctgctccagacctatggaatcagcatctgcatttcaaccagattcgccaggtgatttctgtgcacatgcatttgcactaaccaatcctgtaaggtgggtgatccatctgaggtctggatctcctctgggggctgccagtttggctttccctgggctcctgagcttatgtccttaaagttaaccctttattacctgaagtgactctctggtccttgaaaagtcaaaggccttctcagactgagaccactggggctggggcacacccaccgtttgggcactcactccacctcatgtccgatgctcactgtgtggatgtgtgatgacccaggactactcaccacctgttagtctgttctcgcattgttataaatacctgaggcttggtaatttacatggaaaagaggtttatttggcttgtggttctgcaggctgtacaagaagcatggcaccagtatctgctcttggtgagggcctcgggaagcttacaatcatggaggaaggtgaagcaggagcagaaatgtcagatgacgagagggagaaagagagagaagggagaggtcccagactcttttaaacaaccagatctcatgtgaactaactgagcaagaattcacacatcaccaaggggatggtattaagccattcatgagggatccatccccatgatctaatcacctcccaccaggccctacctccaaccttggaaatcacgtttcaacatgagacttggaaggaacaaacatccaaaccatatcaacacctgttcatccatgtggctttctctttttgttctgtgtaaaccttgtttattcctattcaggtggcagcttctagaactgcactgttcaaaagagtagctgttagccacttgtggctattgagcactcagcattatagctggtctgaagtgaggtgtgctgtaagtgtaaaatacatcccagatgttgaagaatgtaaaatatctcattaataatttttatatcgcttatacattgaaatggtaatattttggatataataggttaaataagtattttattaaaatgaattttacctgatatcttaaaatgtggctactggtaaacttaagattacacaagcctgggcaatacggtgaaaccccatctttaaaaaaataaatacataaggccgggcacggtggctcacacctgtaaccccagcattctgggaggctgaggtaggcggatcacaaggtcaggagttcaagaccagcttggccaacatggtgaggccccatctctactaaaagtacaaaaattagccgggcgtgatggcacacgcctgtaatcccagctacttgggaggctgaggcagaagaattgtttgaacccaggaggcagaggttgcagtgagccaagatcatgtcacagcactccagcctgggtgacacggcaagaccctgtctcagaaaaatacatacatacatacatacatacatacatacatacatacatacaaatacataaattagctcagtgtagtggtgcaggcctatagtcccagctacttgggaggctgaggtaggaggatcgcttgagcccaggaggtcgaggctgcagtgagctgtgattacaccactgcactctcgtctgagcaacagagcaagacctagcctcaaaaaaaaaaaaaaagattatatatgtggctcacattaaatctctacaggacaggtctgtggtcctccacgggagaggaagttctcagagggcaggtaccacgtctcttccttgctctgcaccaagcctcatgacctgacctctggaggtgggcaagtgtcagagctgtcttcagatagccttccaggggctcagaccaaggctgatttccatcatgtaaggccctgaataactgcatggccctcattaaggcactggttctcttgggggattctgaatgtttcttgggcctgatcactacattaaacgtcagatgaggaatctttctctcttgcagatttccctttttaagtagctctaaggatgctaatgccagttcaaacaatgatgaagctaccactttctgggtgctacttcctactagctgtgcttatccttgtaccacactgtggggcagccatgaactccaagtcacagaaaaggaagtaaggcttaggaaggttaatttctccatagttagaaattagtagagctaaaattcaatccaagaccatttgactttctttccattgcacaacactgcctcctaaacttgaccactaaaggattacaaaactccacatatgaattacactctgaattcctggacctctgctcactccaagtaagaagcatagcacagagagctggagggaaggcagttgggctgctaggtttcctttgtaaagggttgggctagcctggcacagccagcaactcatccatggcagaagggcccagagtggactctttcaggcctaggtctgtggggtggccccaaaccacacattagcttaaaatcggtcttgctgcagaagcagaatgtgcataggactcacacacatttaaagagctgcatcctttaggctgttctctatctcctagagttagaagacagaaagtatcttacattttatgtcttaattttattttaattaactgtattttaattttaatttgagggcctgagtctccccaaatgaaaaccaaaggggaggggtggggttgagagccttagcctgctctccttcctctacagccctcagcctgatttcctttcccctgccctgagtaccatgagctactaaaaattttcctgcttggtcatgacatcagatctcacttcctgaacagtagggattgaagaaaacgttttcatattatctaggttttatatgcctcccctgtattcctaacagactccagtcttcccttaatgtggatcatagaaaacaagggctagtccaggttgtagagaccaccaaagtcaaaccctttatcctgcagaaagacaggtgcagaggtttagagtcacacatctcattggcacaaactcataactcagtgctttctcaatttccccagctctaaacagaactcagaagagggaacagggtaatttttatttgtaggcatcaacacaaagttcaggcattgaaagggggttcatgtaggggaaagcacagcaccaggatggcagagctgaggtccatcctgaggttctgagcaggggccactttccatctggaatgccccagccaaaagcactcaaaggtcattagagtaagtgagtcactcagttaaagaatttaaggaaagcatccaaactatgcatgctccactctgtgaaacagcctgttggcccttctgtggtgtggggagacagggaaaacagggcaaagggcggccattggcccaggtgcacctcgcccccttctggaaccttccctgactaccttaattctccatctagtgtcccctgaaaaccagattgggaggacagtcttctgaaagaggagaagtgagtctgagccttggtttataaacttccagtcttagaaagaccgggaagggtcaagggaaccttgtgttacttctgaggggctgacagaccccatgtccttcctgatatcaaggctttaagtgtcagccagggacctgaactagagatactctttccagtggagtggcttcagcatggcagaaggacacactagtagcaaaaaatattttacttatggtccaatttttctcctagaagttttaaagttaacagaattttttaaagtacagagtggggaaaaagacaaaaatattaggttggtgcaaaagtcatgtggtttttgcaattacttttaactaatatgttaacacattgatgtgtttacttcctacatatttttctgagttacataatttttaataatgagcatgtattatttcataatgacgctaaagatgatgttaatgaggataaaaacattgttcattcattcctcaaatatttcagtatctaccatgtgccaggaagctttctagatgttggagataaggcaatgagcagagaaagtccatctcctcctaaatcttccatttagtggtgggggatggagaagacactgcaatgtgagatggtaatacgtcctaaaagaaaaacctcgagtggggtgagaagatggagagtcatagggctgggatggttgggaaagggcctctaaggagcagacatctgagaacagacttgaaggatgtgaaaggagcgtcaggtgagaggctgagggaagggctcttcttttacagaaggaacagcaagggtgaaggccctgtagccttgctcaaagaagggccagaggtgggtgtgaccacggtgggctgaacaggtgcagagtggcagaagatgggtctgagagctagggaggggccagattgggtggggctctgtaagaccatcctaaggagtctgatttcagctgcagtgtgaggggaagccatgggagggctcaagcaggagacaggtgatacctagtttgacaaacatcatctcctggatgcctcccttgttcgcagggaccacatctctcccattagattggaaggtccggggttcaaggatggggtgtgttttctcttgtcagttcctccatccttcaagagagggctaaggcaggagctgcaggccttggggtaactgagagctcagctccctcctggactcgggcctcctgggactcaccttctactgtcaactccactgtcacctggcgagcaccactgccattggtggcttcacaggtatactttcccctgtcctcctcatggacagcatgaatcacaaggctgaaagtcccccggatgccgcaatccagcaggaagcggcccccgctggtgatgggttgcccgtttctgtgccatgtcacctggggctctgggtaaccccggaccttcaagaaaaagaagaaagggtaagagcctgtatttcatgagtactctctctgtgtcaggtattgtttggagtgctttacatgtgttaactcatttaatcctcataacgcccccatttcatcctcattttacagataaggaaatcaaggtacagagagttttggcaatttcccaaggtctcaaaggtagaaggtggcaaagtcaggcatcctgggtccagaatccactatgcaaatgactctcaagcccggctgcattttagaatcatccaggggagctttaaaaaaacactagtgcccaggtcccaccttagaccaattagattagaatcccagggggccaggactgagtacggggattctagaccagtgcttctcactccaacatgctaataaatcacttggtgatcctgttaaaatgcatatcctgcttctacaggtccgggctggggcctgagattctgcagttgggacaagctcacagatgctactgatgctgctggtccctggaactcaccttgagtagcaaggttcaggacctgcactgcccagcacggtagccactggccacaggtagcgatggagcactcaaaatgtggccagtgagactgagttgcactgtaagtgtgcattacacactgggtttcgaagacaatacaaaaaagggcaaaatatctcaataattaaaaatatggattagatgttgaaaagtagtatttttgatatgttgaattaaatgtattcagattaatttcagttgtttctactttttaatgtggctactagaaaagttacaattacatccaggccttgtgacagtcctatggggtagtgctgctctagaccacttgcctttctctaactgtagttagcagctgacatttgctgagtgctaagggttcagcacttctctaagtacttggctcatctgagtttcctttttttttttttttttgagatggagtcttgctctgttgcccaggctggagtacagtggtgcaatcatctgagtttcatagcaacccagtcagagagaagacatctctcaaaagaggggaaaatgcagagataaattcaaagaaaagaattcactttgagttttaaagaaaggaagtcccccaagggccttcaaacacttgaaactcagtaggctcttcagaattaactcatctttggaggattagggttcagaatggctcactaatgcacagccaaggacccagaattggggattttagcactggaaagtagaaggcatcataggagcttcctgagaacaaagttgtttgcattacaaaacagtggtagcaatagttttatccatgtattcacttcaaggaaagagagaatggatacggatgaagcaaaatcaaaattcactgaatgacccccaaattgcatttacaaagaaaggcttcactgatctgtagcaataatcctactcacaccccctgcaaggtcacagagtgatgctatattggcgcatgtgcacacaggcctgggcatccaaatacagtctcttccctaagcatactaagcgaggaaagagctatgctaaaaagcgccggtcgttgtctttggactgtgctcagttttcttcccaggtgctcagcccctagcccacccttagaccagagtctctgtaaccaggatgcagatttcttcctaaggaaggaagccttgaataacagggaaaactcccaaagtgaacaatccctctttgattattccatatagtcacccctcagtgccagtttgtgaatctcacaagactgcctttctgtccccactaatttgtggtcaagcttcagtgaaaaagaaacaacaataaaactccaaatcaatatggtccatcttatttacaatgtctggaaacaaaaatatatccctttcctatcaaaatctaaactatactcatgacagagattgagtactttggaggaaatgctgagactctggagtggattccccaaaagccatgtgaacaatgcctgaagccattgtagcctcaccaaaacaagtgttccagaacttaggctgacagtgttgaaggagaccgcatccattgggatgcacagggtctcacagccactgtaatataaaatggtgtgttaacagctgttgtctctgggtggttaggattgtgagtctcctcctttctttttagttaactattagtttctgagagttctgcaatagtacacctggcctttgcaaaacagaaaaaagaattttacttaaaaaatgcatttcttttatattagtgtgctgtataatgaatgtatatagcacattcattaatttgttgagggcctcaaggaatttaaatctagtagcggaaataaaagagccatgcaaataaatgttatgcatgtttaaaggtgacagatgtcatgcgcccatataaaatcatgtcatcttgtggccctaaaggcagaaacgttcatgcatgggaacatcagacaacaattacactgttaaagtattcttctcgtgtgaaaccctttcctacagaaggtggcccctcaggactctgctcatacagtgaatctgcaaaccatcattgtcttctcctgcactccattaggcagggctggtctacccaggcttctatcagcttcagagaatgggagtgccaagcactgcaactaggaggaggtaaatcattaactgcgccaaaggcgtcctggcattccattagcaagcatactggccccctgcagcagggccagctctggtggctcactgggctctggggcatcaatgattaactggggacattgcaaacgttccagacctcagggacacaatccttctgtctctttctcttttcctctcactttctacacataccccaagcttacctctgaaatgccctcttaaaataaatatttagggatttgaaaatatgctgaaactggcatcacttaagaaagttgcagttcactatgatacttttatagcacattggacctgaagcaaaggcaggaatttttgtgaccttgttcagttccaaggtctgaatgatttgaaactttaatacttgccctcccaatatggaaaatcaatccgtttttactgtctgccactaccctggacctctgggtggtgaaggaataagcctgggttcacatccttgggatgcatgacaacagccctgccctcccaggttgccttatctgctgtcatcactggccttccaccaagaagtcatagctgggatttttacagtcaggatcttcatcaagagccagtaaaaactctttggtcctgtagttttcagagggctgccatgtatagactcttacttgactcttgcagctatgacggagatgtctttggtttggatacccagaagcagaacctcagatagggcttcagagaccccttcctgcaagtcctcaccaacactcacagcagctgggaatgggcctaatgaaggtatacgggtagggcaccaacaatgtccacaacagctcacaaagccagtcgttttactgggcccatgtagcctagaaaagaggcctggagaagtagatggtttgccatgatctcacatggcagcttaaatggcagattggagaccataattttggtttccaggttgagtggttgtctccatgcctcatcgtaaattcatgtttttggtgaggtaagttctgtagaaccaaaagtattcataagcgtctatctccaagagaccctaaatcccttataggttaaagcaatatctgctccccacttttggaaagtgtcaaatggttcaccaaggttataatcacaccataagcaagtcttgggctattcccttgttttcgtaataggacaggattggtgcctgccaggtgtgtacctaagacacccctaggagagtcagtgtggtacagagaggctagtatgcaagccaaggcctgcacactctgggcctggcttggtgtcctagctttcttgggttgtaattccttccttgtattaaggaggaaattgcttttggtatctaaggttcctcccatctctgaagtattatggttttaaatggtgacccacttagcttcttagggaagattctttcctttcccctgcattctcctctgggtccaacccacagccttagtaccctctaatcctccatatgagaaaaccaagtaaccacagaagaaatgctcacaaacatgaatagacagccctgagttttcaccacaatgagttttggaaatggcaccaaagagggtcactctaaggagagaatcgcattcttgacacagtaaccacatttaattggaggttgtattcttgaacaaaagcccggtatcaaataaatcaagggtataaccaacaacttgtcataaaaataaagatatagtcaccataacccctataataattttaaatagtaaaactgtgctccagcttcataaaatgtcctcaaaaacctttatggcctcaaaaggcctttaaaaggaatgagggctcattctgtgcttgctgaaggttgaggagaaagctgagctgcaggcaggcagtcgcttggccactgcattctacctgcctgtctcacttgagaggcagtttccagaacctggtgctgccttgagatttacttaatgactaaaagcaaaacatctgttagagcactaaacattttggtttttctctaacatatatcaagggctttcaacttatcctcagttgcttaggacgggctaccatagcctgtgctcagagcaggggcaaattctttgtccctataggtcctccaagactcaaagcaacatatccatcttctccaagcttggtgagtagcagaaagggggtgattgtgctgattctgcagatctgccgcatgtcttttttgtctggcagggcctggcgcaatgcacacactacaaacccacacagctgcagggcacagctgcggtggcccaaccgcagataggtcacatgagcaggaagaaggaactgaggctctgcccacatcagggatggaggaagaccaggaaggagagaaagcaggattgagctgaggccagggagaaaacagactgcccagcaggacactggggattgggaagatgcaccaagaagatatgagcagtgagctgaagaatctttagggctgggaacaacagacccgaggggttgccactgagtatttacttgattgttaagtaactgaagggatgctgggaaaggctgggcctggaggaggggacattaaggaattcttctagatggacatctcccctaagctgacaaagcctcattctgcaacactgtctatgtattcatgattgttgcctgcctgcctgtaacacattactgtgaacttcttaccctgttacaagtgttgtttctcctatgataaaagactagaagaggactggtgattaaaaactgaaaaatagtaggaaataaaaccaatggtgctgagggattagctgaagaagaatcaatcttcttctgccccatctccaagtataagctcactcagataataaatggacgtggttgcacaaaaaaaaaaaagaaggaaaacattaacaccccaaacaaatcagaccacagaaaatgtctataaaacttacctcatgggtatgttatgagggtgaagagtgaagggtgagccaggggcatggcatgaccaagcttcagagcctgcgtctgtgtcagcaactggcactcagccccataagcaggcaggcacttaattaaggctttgaataatcccattgccaacagtcaaaagccttaactgaacccacagaacccatcaggaagagaccataccaactaaaaacagcaattagtgagaggcttaaactgctggatgctccccacccccatgtccaacttgtaaaccaatgaggacaaaagtgcttccgtgtaaataaaaccagaatgcagagaattgttcctctcaatggctcagcaaatgccatgtgggtctccagggacagatgctcaaagtctctttctctgtgatcagccactctcacttcctatggcatgctttcttttcctatgacccgagacataggaatccctgcacctcgacatctgcaaggctgaggacttgtttctgtcactgaaaacacaaggcaagttatagctccgtagctgggggttacaattcaagcccttctggaccgcttaatcaaaaagatctatttccttttatctagaccaaccttatcaacacatgcaactttttgattcccttttaatgatataagcatctaaaaccctttggagcagccaaacaaagatacagatttttctttctttctttctttcttttttttctgagacacgttctcactctgttgcccaggctagagtgcagtggcacaatcagctcattttgcagcctcgaactcctgggctcaggtgattctcctactttaacctcccaagtagctgggactataggcatatgccactatgcccagctaattttttgtacttttgtagaaatggggtctttccatgttgcccaggctggtcttgaacttctggtctcaaaagatctgcctgccttggcttcccaaagtgctaggatcataagcatgagacactgtgcctggccaaagacatagaattttaagtgtgatgggcaacttctcacgttgataccttccttgttcccccaaatgcattgttttcatagcaaaacagatgtccttctggtttaactcccagcccttctgggatagttgtggggctccaggctttccagaacctctacacaaaactttggggttctggctgtactctcaccatgggtctccacggatactgtgtcttcagctggaggagcaagcccaggagatcactcttctgtggcagctctccagtttctgctaccaaatagagatgcactctcagacatattaagtattaatgagaggcatgtggcattgcagaggtttaacaaattaatgctgtggtttgacgtggttttgatttgctaggctctcctgcctgccagtgtaagcagcattcctctcctttggaggaagtgcctcctccctttccacccattatgtgttagacccggtggggatgccaattggtaaaatgcctcctggccaaagcacttggtctcaaacaataggcatatgttccaagccagccaatgagagatcttccctgcaactttatctttgaatattgagagaccaaagctgtctcttttcacagagacccaaaactgagaagatgtaagacttagcctatctgcagccgttctctcccaagccccattatctattttcttgcctcctcccagaaggaggaagccatctggagaataagagctgatatatacagtgaagagaagaaatggagacagagttgacagagctgtggtagactctggacccgctcaggtatatgagacaatacatatcttttgcttaacctagctggagtttctgtcacctgcaaaaaaaagtcccacctacttacttcaggaaggtatatggcctttggagtcagacagatctatgtgtggatgtgggctgcatcaatcatcagctgcctgacattgagcaagttacttatttggctctgagtttacgtaactgcaaagtgcagatgatatcagaatctacttccatggagaagtatgtatgtatgtatgtatgtatgtatttatgagacagagtcttgctcttgttgcccaggctggagtgcaatggtgtgatcttggctcaccgcaacctccgcctcccgggttcaagtgactctcctgcctcagcctcccgagtagctgggattacaggcatgcaccaccacgcccagctaattttgtatttttagttaagccaggatttctccatgttggtcaggctggtcttgaactcccgacctaaggtgatccatctgcctcggcctcccaaagtgctgggattacaggcatgagccaccacgcctggctgagaagtttataattaactgagatagcacatgtacaataccacattaatagattctaaaggttagacttttcctctcttcttttcttcaaagtcaacaattttttttttataatgaggtaccctaaactccatttcactcccagctctgttaatggcatgaaactacttctgccctaagaaatatcagaacatataaacttatgggcttggtatgcctcatcttacacaactttcattcttatagacaacttcaaggcatcacactcttaactaggtaaaaatctaaccctttaactgagaacattctgctctggttgaattggcttattatttttatttaaagaccgaaacccaatttgaaaagtgatccttgtttttatgtattattaaaaaacacattttaaaacaaatatccagtctgcagttttactgtgccattattccactcccaaaataccatttgagccttggagacagagaccatcccctggatttctgcctcactgactaatgcagccctggaatttcaagaaggatgggtgagtgtcaggaaataaatctggataataaatctggagtttttagccagtcatgattggacctggagagagggagagacatacttcactggcagtaggaatggagtggagggctgctccccaaacaacacagagactataacccctccatcagcagagcctgctgcccaagactcagacactggccacagattgttctgtcttattctctgacaatttctgtttaaaagcaagggtgggcaaaagtgacctgagggtctcaacaccctgagaacatcatgacttggcttccttggctttgtttcagaatttctgatctctgcagcctgtctctgtgacccaacacctgctccacgttgggtcagaatccaccacacaaagcatgcattctgctcactctcccaggtggcggctctgagggacggagtggagcaggtggggctatgaaagcaggatcttttatgccacctgtatccatgtggccaggagagcatctctttgactctgctggaaaatacctggcacaagtggcagacagcagcctcatgaaaatgtccctttatgcttgaatgtctgccccatgtcccaagctgcccaaaggcatcatgatttgcatagagaatcatgtcagagaaggaatcaaaagttgtttctcaagcaatgtcagtgtctgactggccattaggctaaaaaaacccagatctttattaaaatatttttattctcggccagacgcagtagctcacgcctgtaatcccagcattttgggaggccgaggcaggtggatcgcctgaggtcaggaatttgagactagcctggccaacatggtgaaacctcgtctctactaaaaatacaaaaaatcagctgggcatggtggcgggcacctgtaatcccagctactcgggagcctgaggcaggagaatcacttgaatccaggagatggaggttgcagtgagccgagatcatgccattgcacaccagcgtgggcaacaagagcgaaactccgcctcaaaaaatatatatatttttatcctcaccaaaacacccgtacctggttaaaatgtgaattggtactataagtcataagaaagcaggccgccctcccactcccatttccacttccttgagggcaatcaccttcaatgcttttagtcatttcttctgatatttcttccattattcctaaacaatagtcttacacaactaatattcttttttttttctttttttgagatggggtctcactttgttacctaggctgaagtgcagtggcagatcttggctcactgcaacctctacctcccatgctcaagcgatcctcccacccagagcctcccaagtagctgggaccacaggcacatgccaccatgcctggctaatttttcatatttttggtaaagatggggtttcaccatgttgcccaggctggtctcaatttcctgggctcaagcaatccacccaccttgacctcccaaagttgctgggattacaggtgtgagccactgcacctggcctactttattctttttaattttatgcattatctctgctatggtttgagtgtttttgtcccctctaaagttcatgttgaaacttaatcatcaatgctacagcattagaaggtgtggctcaggtgtggctcacgagggcagagccttcatgaaggggttaagtgcccttagaaaagggcttgacggaggtagtttgcccctttttgcccttcggccttccaccatgagatgacatagcattcatcccctttggaggatgcagcaacaaggtgctctcttggaaacagaaagactggccctcaccaagtggtgcattgatcttagacttctcagcttctagggctgtaagaaatgaattcctattgtttataaattactcggtctgtggtattttgttatagcagcacaaactttaaatggactaagacaatctcttaagttctctgtatggaatgtaaactttaagctctcaaatctgcccccacataaatccatcccttacccccacaaaatgacattacacatcgacatgacaaaaattgtggtcttcactacattctaactttgctcactgccatgccacatagtatattacaataaatatcttgaactttttatttttcctggagttaataactgctttactttgatatccttagttttttaaggactccaacttcttaagagaaccatacattcttctcagtaatggtcaaatgcatcagataactcatcagttgctgttatttttttctcctttagagataaccctcccggaacattttgtcatcctcctctaatctaaactggatgttttctgggcttgatgcatagtggtcctgggacattccctcaccatcctcttggaaatttctcattctatgccaccgttttgatagaataccattccaatagttttctaagaatgaatgcatggaaagttaaaatttttagatctggcatttccaaaagtatccacattctacctttatactcaattgacattttgtctggagatggaattttaagtggaaacctttttttttcttcagaactctgaagatactgcttcgtggcatttgaaggcaattctggcatccagtgttgctgtttgagaggcataatgccacacggactccctgatccatcatctgtgaactattatgtgtgtggggttgtgtgtgtgttttcctttcaaacttttagaatcttcttttcattctgatattctagaatttcatgatgacctgacttggtgtgggtctttgttcactgtccgtcagaccgttggtagatattttcattactggcaatgcatgtctttcagttttgaggaatgtttgtgttttgagaattctctctctactgttttcctcaatgttctcttcatggaactcccatgaactggacatgagccctattagactgacctacatttcttttcacactttttctacctcagtctttttattctctctgggagatttctttgactttattttccaactagtatattgaatttattattttggctatcattaacttcaaaaaaccctttttcagtttctcaaaattgttttgaattgtcttctcttcttgcttaatagacataacatcttatctctgaggtgagagaaacttctttgaagttctgtttcctgcagtcttctgtttctacttggttccttgttcggttctttatgtctgttccataacagaggattcccttggacatctgatgatcctttactgatttttcctgtatgtaagtgaggaaatacaaagttccaggtgcacagatgggacctgtcaatgtgtcagacctcatggtagagggattgaaattaaaacatcaacatcaatatctgcagatcttctcccttgagataatcagtttccataaaaaggcatcttcctagttgctgctttggtggtgtggggtggagggtgggtacagcaacgaagtctgtctaccagcatttagtacactgagtgagggaagaccatcgcagggtgggaaggtaagttggttattttccacatgctgactttcactcggcccctctcccttttgagtacaacgctttgccctgcctgcagctgtacctcatgtctaggacgtgacagctggtcagctttggcctctccacggaggagctttcagtctccttgggtgtacaggaggagaggggtctggggcatggactacagcggggaaccggggcctcactgctccttatcagatctttcatcttccagttttcagcttcacttcgcaacccaggctctggaagtatgtcatcttccaattgcttcatcattgcctactctcctaaccacaggcatagcgcgtcagaagactgaaacccaactcagccaaccatctattcacatgccatcatccacgagtttgttgacatctctcatttgctgttgtctctcctcattctttctgtcctcataggtttataagttttcattttctttctttaaaaactcattttaaggacaccattatttttaaaaaaagcaatagaaaataacaagtatgggcaaagacgtggagaaattggaaccgtcgcacactgctggtggaaatgtaaaatggcagagttcttcaaaaaattaaagttccattatcatatgatccagcaattccacttctgagcatatacttaaaataattgaaagcagggacttgaaaagaaatttgtacacccaggttgggtgtcgtggctcacacctgtaatccagcactttgggaggctgaggcaggtggatcacctgaggtcaggggttcgagaccagcctggccaacatggtgaaaccccgtctctactaaaaattcaaaaattagccgggggtggtggcgcatgcctgtaatcccagctacttgggaggcagaggcaggagaattgtttgaatccaggagacagagattgcaatgagccgagattgcgccattgcactctagcctgggtaacagagtgagattccacctcaaaaaaaaaaaaagaaaggaaaaaaaacaaaagaaaaaaggaatttgtacacccacattcatgacagcattattcacaacatccagatagtggaagcaacccaaatgtgcatcaacagataaatggacaagcaaaatatgatatatgtgtacaatgggatattattcagccttaaaaaggaaggttctgtggtttggcattacatagggaaaaatttaaaaaggaaggaaatgctgacatatgctacactggtgaaccttgaagacattatgctaagtaaagtaagacggtcacaaatacattataattccacttatgtgaggtacctagagtagtaaaattcatagagacagaaagtagaatggtggttgccaggggctagagggaaaggaagtaagaagttattgtttaatgggtgggaactttcagttttacaaggtgaaaaggttccagagataaatggtggtgatggttgtgcaacaatgtgaatgtacttagtgccgctgaactgtccacttaaaaatggttaaagtggtaaatttcatttcatgtgtatttaccacaataaaaaagtcaatgagccaatatataaaaatctatttcagaactctctgttctgtttcaattagctatatgtttatccctttgccaaatgttacactgccttataataaataaatcagaccaaagccactctctgttttgaaaatttccaatgagttctcattgtgctatgaataagacctggcctgcctatttctctccaccctcattcccccttctctgcctcgtgaccacacaggctccaggccgcccagaagtggctcgcagcctcgaggcccacagcacatgcagtcagggctgtgtaagaggtgtgtgctgaggaccatgggagcacggaggagggtgagggctccacagaggtgttgctgtgagttgagcaagaagggaggaccacctcttaatatagcatctgccccaggggagcagcagtaggggtgacttacagggctggggctggcgcccaagggtttgtagggaaagggtgaacccagtttgcactagaagcgagatagctcccaacagccctgcccgccttaggaggggtcctcggagaccccaggttgtgagccgaggcagattccaggtcgtgccagcacataaacagctcttgctgaaccagagtagctctcctcagccacttccgcctgatctattggctcttgccaacttagttccacagggcacagccctctcacaagctattgctcaggaattttagggcaatggcccaggggttgcagaaaagaaaagaaacacataccaacaaccctccaatcaggacccattgtgagcaaaccttgcctgcggttgttctctgggtatttgttggtggcctgtttgggggctggggagcaccaaaggggtcagagtcctggttcaaaacacacatttaaagcagaattagacttcccagtccatgccactgaaatctcttttctaaagaagcatctggaaaaatggagggaaaagctgcccagttacgtagtaaaaaacaaaactcaaactttcctttcctcctcccgccagtgtccctttcaagtctgtgatcctcggggaggaagaattggcgggggctggggcccagctgagccactgttagacaaaagcagtgggttgagaagcctgcaggtagggcttggtctcagtacagacaactgctcagaccacccagctcagagaatttcaggcgcagcgcaactcattcttcgtctgttaaaaacaaatgcatgaggctgggtgtggtggctcatgcctgtaattccagcactttgggaggccgaggttggcagatcacctgagatcaggagttcgagaccagcctgtccaaaatgaagaaaccccgcctgtactaaaaattcaaaaattagccaagcatggtggcttgcacctgtaatcccagatactcaggtggctgaggcacgagaatcacttgaacctgggaggtggaggttgcagtgagccaagattgcgccactgcactccagcctgggtgacagggtgagactctgtctcaaaacaaaaacaaaaacaaaaacaaatgcatggctggtgccagagctgccctaaggcctttgctgcactaagcacgttagccatagtgacctccaggtctgaggagtggggaagaagtaaggatgggtgggtgtcagtcccatgggggtgtcaggaagtgacaggaagtacttgctaaggatgaatgatgcctgtgggtgtcttcaggggagtgggctgctgagagaggcctggtggcccttgagaagatgactttattttgtgttgttaaaagggccagcttcgggttaggaattggaagggtctgtaaacttgttacactctagagagtcctcttcagcctaagggagcctggactcctaccatcaccacttggcttctgaaggagcccctaggctctgggaatgctgaccgaactcctggcctctcagcagcagcttctcacagtgaccactcggctgacactgctgtccaggagggctgttgccctagaagctgaggggaaccaggacaacctgcagcccaaaagaagcaggcatgcctggagagccctttgcccccagctgcaggacgcaagcatgagagcagtgcttattccaaagccgttttctgtcttaagagctttacaactgggtccagggtcagggtcccctttccaagcttggtgtttttcccttccttttgctggtcagggggaaatgaaaaaagcaatgtttccctggccctcagctgtttcttctgcccctgggaaggactgccaccaaatgcaggtgaggacagagtcagaattctcagcactgactgctcagctatgtcacctgaagggaagacccattcagtaaggacagccctgacctgaatgacccacccagcccctctctaaggcaaagacccctaacaccatgcagggctcaggccactgctgctcctggcccttggccacagtgggcctagttctctaaatacacctagagattaggtactggggacccagatccacctctaagtaggtagtatttgtttgtaaggctgaaaaataatattctaaagccagggctaaatgctgatacaatcaattttcacttacctccttgtcgcaaaaggggataatcatagttctatttctatttgtctatgggatgtgtcacacatcagatttttcctcctaattgtgtcctttcgaaacatcttcaccatacactgtctggtgaacaggataggggccttagaaatatgcactgctggcagagccaagcgaggagcaattccaaaaggccacgcaagtgcactctccccctctctgcctgcttctccaggaccacttgctctgcctctagagagcctcccgttactctggctgcctctgatcttgccctgcttcctccttgcagcatctacactattatctacagtggtcacattttaaaaacgagtgcatgttgatctgatcacagttcagactacttaaaatcaggcctgtcccagacaatctgagacaactaatcaccatgacatcaccttccacatttctctctgccctacacgaagcacaggaccatattttccattaaaaaaatcaggatacattatctgatgagagatttacgagcagcctccaggtgcaagaaggagttggtgctataaaagtttcaacatcaaaatactggaactccaagcatatttggataactttactggaaaaatgagaatattttaaaccagaatggctcatgacaatctgaggtgacagcccttatgccagtaacacgggttatgtttctattcattccaggtatatttggcacaacttactgcaagactgtgacttactcatgagagggaaacaggcattacacctattctgaacttgtctccacactcagcatggccacttccttttggcagcactgagtagctagctgactgatgtctctcctctccaatctttatatcccagcctgggtgtcacttcagagacacctttgttgatttcccaaactaagtcatgctgttatgctctcactgcaccctgggttttccttcagtgggcctcatcacggcttataattcatctgtgtgcacagtcactcctgcctgtctaatcgcactagactgtaactgtctgtggaaagagctacaaagctttggctcactggtgaattaccaattcccagcacaatgactggcacatagtaggtgatcaataagtatttttaaattaatgtcatggtctctctggtaggtcccaggacttcctcttttgtttttgttgaacatttttattccgttgaatttattattatttattatgaatttattacttgaatggactgcaaggctgctcacgagtactaaagctggcattaatcctgggagtatacatattggctgatagaatcaatgttctaaaagaacaaagtcaggccgggtgcagtggctcatgcctgtaatcccagcacttttggaggccgaagcaggtggatcacctgaggtcaggagttcgagacgaggctgaccaacatggtgaaaccctgtctctactaaaaatacaaaaaaaaaaaaaaaaaattagctgggcgtggtggcgggcacctgtaatcccagatacttgggaggctgatgcaggagaatcacttgaacctcagaggcagaggttgcagtgagctgagatcatgccattatattccagcctgggcaataagagcaaaatgctttctcaaaataaaataaaacaaaggtccgaatcaagatatattaggagagaataagtcttgtgaaggttctaaatcatcaactagacaaaattagtgtggaagggcagctaacattgaaaggagccgagcatgagtcttttaaacattatttaaccttaagccatattaacagagcatggtgtccacacagggagtgggcagtcccattccacatgggcatcactgacagactgcgtccaggtacaagtgccacgtgttaataggatattgaggaagcggctcaaggtgtgtgagggggtgatgcccagtgcccggctggcacctggtaggtgctcaacagatgtttattgaaggaacataaagtatagttgatggaagttggtctatttagcctggagtaaaacacaccaaaaggagggcatatctgtcttcaaatgtatgatgagctcttgtataaaagtctacatgctatgtagtgccagaggacagaccaaggataaatcggtccataattctccagaggcagatttaggttcatataagtaagaccagcaatgcctcaacaaccaaatggaccaactgtgacacggtagatccccgtccccagaatgttcataagaagactggagaaccatctggctgggatgttgtcaaaagaagccttcctaccctctaagatgccttacaaccccaatcctagttttccaagaatttcacagaactgaatgtataaaggtgagagagactatgaaagaaatattccatttcatactgtaaataacctttgtgctacaaatacagagcttggaatgatctactccttgaaggttttaatgaactcatctataaaactatgtggatccagaactttctcaggatatatttcttcaactgtttcagtttcttccactgaacttttcaggttttcaactttttttaagttaattttcttagaaaagcatctacttctttcaagatcttcaaatcggagtttaccctgaaaatctcatttttatcaactacagatcagtggttagagtcccatttccaaatgttaggtatattttctgtccttctttgaatggcctagtagggtttgcctatgtcttatttctaagaccagtccttaagtttattcctaaatattgtttttctctttgtaatacaatcatttctccttttatataaatgttttgcttctgctttccttcggcttgttctagtctttgattttgcgagttgaatgattggctcactaatttttagtaatttttgttcaatgataaaagcattaaaggctatgcatatacagatgctccttaatttatgatgggttacatcccaataagctcatcctaagttgaaaattttctaaattgaaaatgcatttaacatagtgactccatcaaacatcatagcttagcctagcctcccttaaacatgctcagaacacttacattagcttacagttggcaaattcatctaacacaaggcctattatataatacaacattgaatatctcatgtaatttattgagcactgaaagtgaaaaacaatagttgtgggggtacttgaagtgtggtttctaatgagtgggtatcatttttgcataaagttgaaaatgtaaagctgaactatcataatttgggaaccgtctacacctctgatattggctttagccagttataacctactcaaaagttaaaactgtttccatatctagtagctattacgattaggaaaggtatgcacatgcacttcacctaggaacaaatttaagaaatgtgaagatcctatataattaaagtttcaaaactttctaaacaacatacgagaagtcttggatatataaagagaaatactttgtccttgtattaaaagtaaccagtaggattatatgattagatatggaatgttaaaaagcaacaattattaaaaccattttggttcacatattgactaatgaaatagtccagaaaaatgctaaaacaaactctatacataagactttagtatacagtaaaggtggcctcaaactaatgggaaaagaatagattattcagtaagtgtggataacttgaaaaaaatcctattcaagatcccttcctcacattacacacagaaacatccattttgattaaaatgttaaaagtaaaaaaaggtagaagaaatgtggatataatcttagagattccaggcatgacactaatagtggaaagcataaagatatgtgaacactaaaatttaaaatttctgtacaaaagtaaacttaggataaaaattaaaaggtaaacaaattaaaaatatttcaaatatatgtgtaaaaaaggtgaactttttaagatataaaaagtttgcatgactaaataaaaagaacacagaaggaaaaaagtaaaggacatgaacaagaagtttctgaagtagccaaacatataaaaatgtttaaaattaatcaaacaaacgtaaaataaaatgtgatatgtttcatttaaaaaacgtgttaataggtaaagtgataactagtgcttatgagtgtgagaaaattaaattcttaaacattgctgaaggaagggtagtaatttaaacttcatttttctttcctataaaattggcatagtaatgttgaccttataaggctatttttaacaatttggaaatagctatccaaagacttaaaaagattcaataattctatttctaatatctcttaggaattatcaaagatgtccatgaagatgtttatgtttatttaaaagattaaatattagaaatcaacatatcaaaaacatagtctatttgaaataataagaccaaaatactatacaactattaagatttatcttgaagaattttaaagaatatgagaaagcattaactaaaaaggcagcatataaaaccagttacttaatatccataatgtaacttttaacgatttactttctccttgttacaatagaaaaaaaagaaataaaaaggaaatctactaatgtgtaaatagctgtcatcactggatggtgggattgttttctatactttctgtatgtcaaaacttttaaagtaaggaacacgttttactttcatgaacagtaaaaaaatttaaaaattttacttactgaaattcaaattatgcaaatttagtaggagcacatttttagaaagtaaataaaacaagagactggcagtgactaaatgtccctttgaaatgaaagaataagggagtggcatgccatatttgtcttcaagaaaattcagctgaaatcgacatggttggtgagtagttgggataaaaccaaatgggcttcagctgtagcaaagctagcagccttccgatagaaaagcctctgtagcagaggagggtgaggcttctgaatggacatatgggagggctgtgctttgaacagtatcctcattctctagctggtgcccagcaggacagctgggaggacttcaaaggacaacacagcccatccatcacacatccagtaggcagcccacacccctgccacgaaaacgttgcactggttaactcatcctgcaagaactcaagtcagtggctaatttcaagacctggaagaaatactgactggtggcctggcaaactcctggcttaactggttttgatctttgagatggagccccaagctgggcagagccactgcctgtctccagctgaggctgccagagcccttggcagggtcctggggctgagctcagtccactgagtgagacagctctggggcatggaaaagcaaggagaggctgggcgccaaccttctccccagctgttttcaataaggctccacttctgaggttgctggcagacctctggaaagatctgaaccaacctcacataatgttttccatcaaacccacaattaagtaatattctcttaactcataaactgcatacaaaacctttttcctgtcacttctcagctctcctcctaagcaacctacaagcaggtcaggcagaggttacaatacttttgcagggtcagtggagactgcatcacagtcctccggaggcagttactcctccccctgctgtacaagcatggacggggttgggcgttcattctcgggaagtacaggctacattatgcaaatcatttcagttaatcctcccaataccgctgtaaggtcagtgttaccatactaattttataggtaagaaaaaaaaatctcaaagaagataagtaatttacacaaggtccccagattcaggcttgttcctccatagctcactacttttcaggggagtcaaacagaatcacgggcaagaaagttccaagtatcaaaaagttatggcaaggcttcctagtcttttggcaagatatttcaccagtgtccccttaggagtattcttcaagagcactgttaaacaccacacccttattttgtaattgaataaattaatgactcctagaaaggcctagaatgaaaccggccttcttcatgaggtcttctgaatgcttctttcctatattttttgttgcacattttattgtattaatataccgaccatagagcatagggtcttgttcactactagtgtttgtttatgcgctggataaaggctcgttgagcacccttcaccgttactgtgctagacactggggatgcaaagaaggttaaggatctagtctcctcccacaatgagtgcctactctaatagggaagatggaaaagacagattcaacatggtaaatttttttttttttaattttagagatggggttttgctctgtcacccaggttggagtgtaatcatagctcactgcagccttgaactcccgggctcaagtgatcctcccaccttagcctctcagtagctgggactacagttgcataccaccatgcccagctaattttttttatttctattttttgtagagactgggtcttgctttgctgcccaggctggtggtctcgaactgctggcttcaagcaatcctcccccaacagcctcctgaagtgctgggattataggcatggggtacctcacctggctctcagcatcggcagatctcacaaaacaaatgtaagttcaggaaagtgtgtgcatgcacatacattttagtacttcaatcaggctgcattaatgcttagtgagcaagaactgagtcttagcatttcatgcctcttagaacccagctctgtatttgttgtgcacctattttagagtcagtacagtagatgtggcacctgccttaggatgctcactctctattaggggagacagtatccaacccaaaggctcctagtctggagcccagtgaagacaaattgacaaatatactctaaataagaatatgagttcaatggaatgattaaaattaatgactatgtgggccaggaccatgatatgcagagaagaaaagagaaaaaggggaatgacaagtaccaagtagttcaacattcgaccctgtgtggctggaagagtctcttagcttgaaatttaatgaggtcctctatcagtgaaagtcagtgaacctctgggaagaagatggttctccttaaactcacggctctctcactgcccagcctttggttttcacttcttaatcacctactgtgtgtcaggcatcatggtaggcactgaggtctcctgagccctaggctgtcttgatctttctgacgactaggatgaacaggcctgatctctgagtctgcttgctgttctcgctccctctgccaccccagcagacgccattaccggtctcagctctcactggactctctggcttcctgcctcccaccctcctgaccgcttggtacctgcaggccctgctggtccccgtgtggcagcaggacaagaggccaagctgcagggcagatacagactgaggtctactgaaggattcttggtttggagggaaccaagctacgagctggggcaggaaggagttggtggagggaggtgccccagatgtgacaaggcaagtttgaatctcacagatcagggagcaggtgggccatgaaaactggtgctatgtcttcttccttactgataacagtgcaagctgaagaagacaagcctcttggaaagtacttgtgcttaaagatgcccgaatccttgtcccattcacctctcttctgccaactaatcaatcccaaggaaataatattaaatatggaattaaaaacttcatgtataaagatgttgatgaaaatttaatttataaaaggaaacgttggaaaccatcaagataactgccaacagaggaatgattcagtaaatggtagcatatcagatttaatggaatattcaccattaaaattatggtgacagagtgatttgaaaaatgctatgttggctgaaaaaagcaggatacaaaacactatgaataattttagttatgactaaaagttactgagcacttatattacatatgcagcaaagatatttcacttaagtaatgccatattataggtagtattatccccattttatagataggagcatgacctggagagttggcaaattactcatgatcacagttggtaaaggatgggattgaattaaaaatcaagtctgacccatggcctgtgatgcttccacaagccactatgcccctgtagatcctgtagttatccctatgctgaaaacaaaagaaacccccagcttagaaaataactataggacagaacgattaaacaaaacaataataaagaccgagagcaaagcagaaccataggtaattttagccttctttctacctttgcttatctgctttcttaagtagaatattgcatttttactttaaaacattctcaaagtaagccatttagagtggtgctgtggacagatcagtgatcctgactgtattactatagtactatgatgcccattgttttattaggcaactgctatgtgcttgcgcacatctgccattgcatcaaccctccaactatgctgggaagtaggaattattattcccatctcagctatggggcctagagaatgtaagcagaacaaattcaaactcagatatcctggctacgaaatctgtgctttctattctttccatggccccacaacacagagtttcttgatttcctgtcctgatgttttttgatcatttgagctctggcaagcccatgtttataagcacggggctggccactgctccctgaagaagaggtcaaggtgaactggtccaccctgaggtatatacccacactctgccacagctcgagtcttgcgctcaccctctcttcccctgtgaaactttggggaggttcaggaagcatgaccaagtgtagaacagagacctgagggccacaaggcagatgaggcgaagagcagtgagaaggggcctgagccagcttgggaactgggctgagggtgtggagcagacgatagtggtgatctgagttcagggtaggaggggagatagaacacagaacaatgacagagccaggggtctccagtctactgcccaaaaagcatctcctgccacctctagcatccagacagctccttgtttatgcacagggacatgtgtatatacccacacgtgatctccagagttcccactagttaggcctttgactgcatctcctgagcaaatgggcttattttttacagacaaaatgatttccagaaagctaatagtcatatttgcagcccatctctaacaactataatacaagactgtacagtgcttatttctgtatgctattcttaccccaggtttattatttcctacccatattttcccttctctattctgactccacacctctactccagaagaagattctaagcattataaaatttaatctatatgatgatgcattctcaagggggtaatatcatccctaagggggggcgataattggttctcaggagtaaggggcaaaaagtcttactctttttacatatacacacagatatactccagtacacatatatggtatagagtataactgtggtattaaatttgcactaggggattcctcgggagggtgataatggggagataatggtgataataagaatcatcaatccccatctctactaaacaaaatacaaaaaattagccgagcgtggtggcaggcgcctgtagtcccagctactcaggaggctgaggcaggagaatggcgtgaacccgggaggtggagcttgcagtgagccaagattgcgccactgtaccccagcctgggcaacagagtgagactctgcctcaaaaaaaaaaaaaaaaaaaaatcaccaatctataagtcagcaatatgctcgagcagcccatcaacagacagccccttcccagggcctgagattgtcagacccgccaccctcagaagtaaaatcaggcaagacgcagaagcccagtcaccccttcctccactgcccagccacttcccatgtgctcgcccaggggcggctgaaacctgcaggtgtgacctttgtttccatctctggagactaacagctgccccttgagtggctcatagaagaacctgtttagggacagtgtgttcaagggcagattccttggtctcacctcagtgggtctgggtaggaccctgcaggcacccagtggcttctgcaggatcccaccttgagaaaccactctcgacaaagtgcctccacgaatgattccagcactaaggtgtccagaatttcacttcaaaccccaaatagctatgtcctggcagctaaaaatgaagagtgggggtggggttgggtatgacttgagtttatgacaaaagagctttgtctcagataattcattaattcagtaccagtgttcactgtgcatgtgggggactgactggcgccagtctgctccagaaacagtctttccccactcctttcgggactgagccacagcagctctcctgtcctctagctcaacagagtatggcatttgatggggttgtgcctgcgcctgagcagactggctgggggatggtggcctgggaaccagtctccctgggcccaacgtccccttgcacacggatgaggcaggcccagcatgacaggctgtggaaagtatgttcaggtgcctggctcccctcagcctaatgccttttaagtcaggatccagatttgatttgattttccttgccttcctggctccaactcttccaggctcatttttcactcccctgtcaggcttcccagcatttggtggccgggttgagccaagttcttcacactccacagacaacctccctcccaggcttgggactctgtgctcaccatctaaactccagctctcaacaggctctgcctgcccccacctcgtcctgccgtaatccctgctggagttttctgagtggctgagagggacctgcaattcttagaggagttgctcagggactcagcgtgccaccacatgagagaagaacaagtgagtctattgctcatcctcaccatcactatcaggacataagtctcttctcaccatcaccatctcccacccgcctttatttcagagttcttcagcagaggcaggggacagggattaatttgaaggagacatcaggtccaatgtgtgacatcagaacacacttcctcattcccacacgacatgccagcactcaaggttgatgtgcatgtagagggtgtgggaagtgcagatttagagcctcagcaagttgaggatgtcaaacctttgaatacagggacagtgtcttggttttctctgtcatctgtttattgcatgagtacaaacatcctgcataccattagtgtttactgaacgaacctgcaaactagtcacttaagtcagcctgtcacgtagcagtggggtcaactggtaagcatgctcataaaaccaccaggtccctactccaaaatcttgtttaaaatttatttttatggttgggcgcggtggctcatgcctgtaatcccagcacttcgggcggcctaggtgggtggatcacctgacgtcaggagtttgagaccagcctgaccaatgtggtgaaaccccatctctactaaaaatacaaaaattagcccggcatggtggcacgtgcctgtaatcccagctacttgggagggtgagacaggagaattgcttgaacccagggggcagaggttgcagtgagccgagattgcgccactgtcctccagcctgggcaacagagcgagattctgtctcaaaaaataaaataaaatagaaataaatgtatttttatgaaaccatgttatgttggaacaggaaggggcatcacagtcatctggttcaactctctcattttataggatgaggaaactacagcccagagggcagactgaattaaagacaaagacccaagcacatgataccagaactgccctccttccagatcacactgttggtcttaagagaggcagctccttaagatagccgacaagctgcccagtaaacacgtttgcaaatgacagcactttggcatcacgggctgactgcagtgccctagagtatttaaatccatccctgctcagccatcacctaaccaagtctgactgaatatctaccacgggccgggcactgtcctaggtgctatagagaacacaaagatgaataagagattgtctagaggctcacattctagagacaagtacttaaataaccagaacataaagccaaagatacacagtacaggaaagccccagggtgattcagcaggaaagagaccacaactggcaaggaaaagtgggatgggctccctggaagaggtgacatttggaagaagcagggtagcactatgacagattaggggtccgggctccagttagaaaggatgatggaagtccaagaggcaaatcccgggacctgctcagggaatgtagggcctggcaactgggaagagtgctggtctggggaactagccccacatcgtggagaaaggcaaatgccaggccaggagtctgcagtcagaacaactggaggcttctggccagagaggaagtgctccaagccaattgttgggaagaccctcacagtagatgaagcctggaagggactgagggaggagctctgggagcactgggccaccaagtctccagtaactctgccctccagtggctggacaaatggaatcctgagggggtcactagaggcctggcctcatccttcagtcgagctctcctggagggtgctgtgctcttagaggcactggccctccatgcacatacttccctccatttcattctgcatatctttccccaagtgctgacaaatgggagagggggtaactagcactctctaccctctaacaaaactagaaggggttctgtaaaatgccacacaaacctatggcatactattaaaaatcagatgtgatcagaacaaaccacaaagaaaactccaacaccaactccaatacaaataggcactgaataaaataataaaatgttgaagatgggagcaacggtcaagatgatttggtccaactctcagcctgatgtgtgtagatctcaacaccacagtcctcacaaatgatggccagccctccccaagcacctcctcaaaccacaaacagcctacacagtagccagctcatggtaaagtgcttcataaacattacttgaatgaatcaaatctaaacactcaaaatctttcttaaataaaaacagaacattaaggagacaagagattaatatttagaaaacttacagactgaataaataatctctttttactgggcatctaccaggagctggcaccgaggtgtgttttataaaaactaggcatgtaaaacagagaacacacactacaacagacacatcacagaatttcagatgttgaagcgtcttagggatcatctgaatcgtgattttataagaaggaatgtgagactcgggaaggtttagtggtttgtagaaagtttaaggcaactatgtgggaactagaaccccagtccagggctctttccacaacacactacgttaattatctaattaaaatctaaattgtagagtgcagaatacaaccctcttggaatatggaaatggaaagaaatgcaatgaggtagaagagctagaaaaggcttcatagaggaaggaaagtttaattttctgttttgatattgagaattcattagttgcaagatcactgaagacagcaatcatgttttatttttctttgtatctccagagtctggagcacagaggaggctcaactcacattggtcattatttatgaaagtagtgtcttacttattaactttacttagagttggaaggaagatagatattagaaggaatctgaacatcctgggctctccagaaattgtatctatgtgaacaaatgaaccagacctcagtgctatcgctcatgcctgtgtagatcccctacaccactttgagtatacagttaagaggaagaaaaccccaatctggtctctttatctctcatcggtcattttgccactcagctttgtttccatttcaaggcagacagtcgagataattggaaacacgttaaaacaataggagcctaaggccttattagtagagagacagacatatctagacagggccagccatctagtaagtaaaccatcactgagaaattttaaaaacacagacacttaaagaacttacaacaaaaaataattctattcatacagttccaaatcctcttctaattttaggtagtgaacacattgatggattttctatggttgtgatcagagtgtgcacagtgtttgttctacttttcttcctactttgttattcacacgcattttcatttatggatatagctaccacaatgacaaataggtgattatgtaatatttgccacattgatgtgtttgtataataatctatctccttttgagtacaaactagttccttttttgttattaaaaatagtgctttggacatctttgtagcaactacattttttcttctcctttaagagttaagttatagtgtcaaaagcagaattcttggcaaggcacatcaacagttttattgcccttgtaacattctgccaatctaagccccaaggaggctgaaccaataatcagtacttccaacaaaggaaaacctcacctgtttcctcacagccccagcagtgggctcttggtatcttattttgctagttttttaggtgcataaatacttttaaggtattttgatttccatttgtttaaatgccagcagagttgtgtaattttttaaatgcagtgttatatattttccatgcccggactttgtctacacttctttcactgtaaactgtgtattcatctttgaccatctgtcaaatagaatctggacattgaactcagacagctgtactgagtcttcttgcaggcatttttattgtgcttttaaaaaatatacagaagtaattcctgtctactgtttacaaaaaattcaagcaataagaatgtgtacaaagtaaaaggtgaaagttgagggtataaaatggctaaaggtttctttccttctttatctttcccctccgtgcaacagtattacttctcagctataacccttgacataatctttttttcttttaattatttttattttgctctgtgtctatttcttgatttaagaatttagacagcacttagtggagtcccacaggagtgatgagaaatttctctggcttacggtgcctccctcttcctggccttgacttgatttttagatcttttattggacatttatagcataatcactaactccaatgcctacagaggctgggcaggaaacacatgtagggaatgtgggctgggacaagaaatgtcacgaggcccttcctgtccatttcctgctttcccattatgaatatagacttggctaggagaaaagcaaggtcctcactggcaacaggcacttgtccttagtgttgggagatgccttggaatggtggggactataacgacctggaaactaatgtcagacacagtgacggcaccctctgggccagtgtggccatgtggaaacattgccagctctcatttgtaaagaaaagccacttatacacgaatcatatatgtacattttccatttgcaaatctttgctcaaactttttgagaacaccactggccaaacacaaaaggtctgtgtgccaaatacggctcatgggttgactttctttttttttttttttttttttttttttacctctgtcattatggttttaagtcacatacttaaacctgttatttgatccatccattttaggtggaatctctttacttcccactgtgtaagatggggacattagtgtcactatatttttctcttcctctgtttttctgtctctaccttaccattcaccatccctctactttcggcttgccaaaacttacaggatttactttctgtactgtaactataatgaacacttttgacttttgtctatggattgatttttaaaaacaacaattttcttatagcaatattatattgtataaatgttgttttcagacatctggtgtccatgaattaactgttaaccatcagtggctgaagaactagtttccaaatgcaggtggcttctgtggattttctacctcttgggagtagtcctatctccctgaatgagggggcggactgcaagccccacatggggaatgtctattagcaggcttcacatagaggacttggtcatagtcacaggcttggtcatggagcaagtgggcagatgatggcacatccaacacacttccatcctgtttcttataaactaacatctacagcaggagcttcaattctctccatatacatgtttagtaaataggctttcctttaatcaccccgacttctgccctacatccactcctaatctccaaatcctttaatctcaaatatatggctgaagcctcaccccttaactgttctgcaggcagagctaatatgtccttcaatgcaatgccaagaaaatctctcatccactaatgtccctctcacgtttttagcgcagctatgaatgcattctctttggactgcttcatgtttatttcgatgtcatatttgtcaggaagggaagttaagacatctgttcagtccaccattttgaacccaaagtgaccaccagctgttgactatggtaaattttcagtaatacttgccctgccacttctcatactgctgctttccctttgagtactttggaaactctgtgacacctgggctaccagccacgtggaatagacacctgtggaaaatttgggagcacattcaagcttgctgggatatcaaggttagcattctacaatgaagatgaaggacaaagattctctcatcaacagatcacatttttctttgaatgaatcttgagaattcacttaattctcaagaatgtaatgccttcattttattgtgaatgggacaactatttccagtctatcttctagctgtgggttagtgatatacagtatgggaagttgaattatgtgtgagaaggctctcaatcagccctgtccgaaaggacattctatgataatggaaatgttcaagaatctgtgctgtccaatatggtagccattagccccatgtgactattcagcacttaaatagtgctgatgcggctgatgcggctgaggaactgaattttcaattttatttaatttaaattcatgttaatttaagtttaagtagccacatgtgactagtgggtaggtatcctattggacaatgcaattctgtatcttgaacagctcactctcattgaagaagcaaaagataaacaataatggatcaaattataaattgattaaaaaactgataaagagtaggccgggcacagtggctcacgcctgtaatcccagcactttgggaggccgaggtgggcggatcacctgaggtcaggagttcgagaccagcctagccaacatggtgaaaccctgtctctactaaaaatacaaaaattagccgggtgtggtggcacgcgcctgtagtcccagctactcaggaggctgaggcaggagtgtcgctcgaacctgggaggcggaggttgcagtgaaccgcgattgtgtcactgcactccagcttggggcaacagagtaagactccatctcaaaaaaaaaaaattgataaagagtaaaaatgagtctcatatatatataaaagtattataggcgttcagagaagggaacaattgagggttagaaagttcagaattagagctgtgaagtggatctgtgtgctagtgtgaaaacaaaaacaccgaaagacattcagtaaaaagagcaagttgcagatggttaccagaggctgggaagggtagtgggagggtgggggtgggggaggagggggggatggctaatgggtacaaaaaaaaaagaaaaaataagacctactattcgatagcacaacagggtacctatagtcaataataattgtatttttcaaaataaagagtgtaattgacttgtttgtaactcaaaggataaatgcttgaggggatggataccccattctctacaatgtgtttatttcacattgcgtgccttatcaaaatatctcatgtaccccataaatatatatttcctactatgaactcacaaaaaaatagaaagagcaaattgtaggttactatgtatacatggcccatttgtgtatatacaaggatattcagatatatgctaatatttgtataaatcatttctgaaaggatactcaacattattaatggtggccacctatatagagtagaagtgagggctaaggcaaataacttttaactttgtctgaatttttgttttaaaaatagtttagcatttaaatcatgcttttctttgtaacatagttataggcacagagattattagtgaataatacctttttaaaaggccaaagtagtcaactctttcctgtggctattagtcaagaatgatcttatatgattattgtgaattttccacatcctataaccatggctcttctgtactctaatgaaatgctttaaaaggaagcattaggaaagtagcctgaaggaggtagaatttaaatcagatcctgaggctgcgtagaatggaaagaaggaagggcattcttgatataggcacaggctgtggaggagcaggaagcaggtgcacaggggtgtggctggtgcggaatgagggctctgaagccaggcagggagtgctgatggggtaacagagacacaggaccctagaagaagtacacggccaaatccttatgggcttgaatggcaagacaccgggagtcttagacacttcaccaccgtggttctcctcaggggcaccaaacactgcttgagcattcatcatatggcaggcattcatcttattcaaagatggacaagaaacggtcatcgcgttcaaggaaccagatgagacatgtgaaggggcagtgtcatgcggcaggaagaacatgagacttaggtctattaaaactggctccatcacttactggtgtaaatgttataatcccttggagcccccaggttcttaccctacaaaaaatcaggataaaagctgccttgccaggaggataaaatgattaagattgtaagcctagcaccaataagccattaacaaatatgttagtcccctttctatcatatctaccccattcctaaccccaaaccaatagggagataaaatatgcttcttgtttaccctttctccacaaagttggggctagagcaaaggatttgcactgtgcctgtgtgggccaagggagcaggaccatcaccaaaatacagcagatggaagaagggagggaaaggagacaaggctggagggtgaggagctggtcatcaacggccttttaagcagtgctgcagaatttcatgcaaggggaaccatccaaggttccagcgtataaagcaggaggtggcaccgtcagatccacgtggtaggaagatcacttaagtagcagaaggaaggatgaactggaagggcagaaatcagagcaggaaaccagtcttcaagccactcccagcctcatcttaatctctcaattcctatagtagaaactatttcttgaagaaattcaagcacctaattatacactgtcatatcttgctcttctatatgcacattcttctccagaaccacatcattaagactcctgaggacagaaagcaaaccagacatttctttcaaatttctctttttttttttgatttgttatttctttttttttttaattatactttaagttctagggtacatgtgcacaatgtgcaggttagttacatatgtatacatgtgccatgctggtgtgctgcacccatttaattcatttagcattaggtatatctcctaatgctatccctctcccctccccccaccccacaacagtccccagagtgtgatgttccccttcctgtgtccatgtgttctcattgttaaagtgctaaacatggtggctgactgcttctgagctggaagtgaactgagttgaaagttattgggagacagatacactattgtataaagtggaaactgaggaattattcatgcttccatggttcagtattctcatgttcccttcctccaccttccacagcttagacagaaacatgccttgacagggccagggctggctctttatcacaaagcccacctcagcaaacgctaaggccagcagtgtgagccgaaacctcatttgggctgtacttctcaagagacactaaagtattagctcatctgagtcacagcacagccagggcttgtcaccatgtttgctttttttttctgataagaataaattccagggtagaagggaagaaatctccagtaatttcagcatttttcccaccattgctcttttcatacttgactctgctggggaaaacagcccatcaacacttcagctaccagcatgggcaacagagcagctaggggtgtttccaccagcccctggcattcgtggagccctggctgtctgtacatggaagcccccagccacccctgaggcccagcagtgaacaccagacagtggcgcagtcctgtgcacttctcgccccaccctacttacatcctgttctactaggcacgtgagcagaacacagagcgcgcgtctgaattttcatctacctcactgtcctcccaagcaaacagctgccctttgaccccgcccccccaggcctagcaacatcttttcatgggaggaggcctacacaggtgttagaagtgtgctcagggccatttggtaaaaaattcctgggtcctgggtgcccagcacatgggggaggtttggctccggtgggcgtatcccttgggcagacaggtctcctgctctgctgctctatggagagagaacagctggataaaggaacaggggcttctaggttgtgggcacgggaagagggatctggttgcctgggtctaaaggtggaaatgagataaagttgtattaattcctgaaaatatagtctcctcaagctttgggctggcaaagcaaaaaaaaaaaaaaaaaaagaaggaacggaagggaagagatgggaaggagaggggagaggagggaaggggcttaggtcaaatcagtagatgctaatcaaatagtagttgttgacttcctctcataaaccctaggccctgctggttcaagcctaatggccacagccagggagtgaatgaattcttcgagaatgatttcactgcaggaccacaatcaactcagaataaggaacccccatccctgtgcaatgtcttctctcctattcattcccttcatttaaggagacactatctccacatgcatctcgcgagctatttatcagttaggaatactttcggtaacatttcctgtgtgaatcactgcaaagattgtatctgggacaggctttgagctttaggatttgtgtctcttagctgctggttcttttcactctctccactgctgtccccctgcccccaaacaatccttagcgtgcaggcttgttgcctcatggttttaatctggctgcccaagcaccaggcattacacctgtattcaaggcaggaagcaacggaagggtgaaatatgagagcaccagtgatgtctttttatcttcctttaatcagaaaagcaagggcttttccagaagctccctatctgacttcagcccaaatgtgtcactgggctacccttagctgcaacggaagcctctacagtggaccccatcatggaacagggcaaaggcaaaggggcctggtcatgggttatgtgttggctacccaatgtatctcccacaaggtggaaaagccctaaaggctgtgagggactgagcccacagagatgagcatctcgtcgtttggagctccttggaaagaggcttgaacccccagggggtgcctgttatcccatcttaatgtcacccaagtcactagatagaaagaggagctttattgaaggaagtggttcattaagtcctttgtctaaaaacaggcataaaaaggaaatggggcagagtaggcaacagttcttaacgtcttacgagaataaaaaccaaaagcacacatttgaagaacttctgattggcagctccaaaggcagtaggaaataaatctttagaactttctcacatctgtggtgtccactttgcttctcagtgatgggacggtccctgaacctctttcagaagaagctgggaagtcctaggtccctccactgcctccaccgtgggcgcaacttcacggaggaaagcaggcagaggtgctgtgggcagaggccaggaagaagattcctgtcagctgtgacagggaccagcctgggtccaagaagttgcttgaaggcatactttttaagttagtcactcataagaggttctgcaagagctcagttaccagagaaatgtgctcctgaggccatcctgagagtgataccaggactggttccgtgacgattgagcacctagaacaggacctggagggaggggtgtgtcccaggacctggagggaggggtcagctgcaggcaaggtcaagtggccccaacagtgaaggctgacatgcattggaaggcagatcaccactgactatgcccaatagggaactgcaagttttgagtgtttggagcttattataaccagcaactcctgctcaaaacccatgccacctcaggctaacaccacctaacttttcacttctttgaggtcaccaggtcagaaacaccccctgtttaacttcgtctttggtatcagaacaaccagctctcttcttctgggatcatgtgatgtggcccttccctgatgcaaaagtctctgtgttgtttcctacactaacaatacacacttgcagcatgctagcttccagggcattttcttctacagtctctccctctgcatttgtctctgcaagacagctggatgctttcgacgtctctctggaatagtctttcttctgtatacaccagtgtgctgccaaggcattgttctgggttaattcaagtcaggtggtaagtggtcaagtagcgctgcagtctgactcataaggaacacatgcattttgacatatagtccacatgtaatatacaaggtcaactatttcatccatataagaaaaataaaattttcacatagaaaaagctacattttaagaatactgcagtcaacactgaattaaatgactaaattgttcacattaaaatggttaaatttatgttatgtaaatttcaactccttaagaaaaatactgtcttaccaaagtatactttctaacttcatgaagtacttttactatctatcaacttttcttcttccacccctgtgggccagaaatacagaaacagccagttgtcttttctcagagaaggaaaccttagccacatagaaggcatggcttgccaaccagaggacactgagcaacaaagaactccagtgtgttggctcctggccagtgctcagcagatgcaagttccaaatcgagtcactcaaggcatggttctttcatgacaccaaggtcagcaaaggaagcaaaagcatcatcacatgacatagaggccgccatctcttcctctccatatttgtttgacttgaggaaggagtttatgtctcagaagcagtatggtaggagactgtgtgtgcagttaagatccattttgctgtctgatccgtttctcaaatgtttttactttttagttttctaagtgtataattcagtattttataattactgtatattgaaaagttgtacaaccaccagtactaatttcagaacattttcatcagccccaaataaatcctgtgcctatcagcagccactccccatctctcttccccccagcccctggtgaccacctttctactttctgtctctatagatattcctattctggacatttcatataaatagaatcctataatcagtggctttttgtgtctggcttctttcgcttagcataatgtgtcaaggttcatccgtgttatagcatgagtcagtacttcattcctttttatagtcatctaagtcatttatgagcccccagcgattcttcctgttgcttctctcctgttagctatgaggataagaggacagagggaaccagagtcagggcaacagaagacagccctcatcctggtagtgcccagagagaaacagactcctcaggaacatcactaacatccccaacaatcttctggtaagagatatgaaaggactagtaggtcagaatcattagcaaacagtcttgactacacaggtccatgcacagcatgcaattcagtacagccccaggccattttcaaggcagcaacccctgcaaactctccagacaaccacgtagccagacctgccacttacacaaaggtaaggtccggcatcatgcaaaaagaatcatccacctgaccccctcctacaagctttcaggagctccctcttagactgctgagtcatagtacaactattcttcagtgttctcttctcctttgagtacaaggtagacaaggaatgatcatgcctatttgtagaagaagaagtggagtcccagtaacggcaagtgaccagtattcatttatgacaggtgacagaagtgaaatgagaggtcctatcactgctccgggtataccaaatggatgtacaagaaggtcggctaactaaactctccttccacggaaaaagcaagagaaaaattacagtcaattctcaactgtccagatttgaggacatatataaacccaagctgtattcttcctgccaccggaccgcgtcttctttttctgtaattatatagcatgtacccagaacacaacctacattaacagcaaaacatcacaggatggtcaacttgcagcgtcctccccacccccaagttctccagcacagaccaaagcccatcacaaacaaaagaaagagaaaagtggcacaggttcgttttacatgaaggtccaaaagaaaattgagccttctattagatccagccggcccaggaaaaggcttgacaaggagcagcggcccctgcccatccttccccacagcctccccatccagccacacttcttacccgcccttcgaacttggcggtggctccttctttgatgcagaggttccgagggggcaaaatgaaagcaggggcctctgtcaggggcatggagtcaactcttgagggatccacactgagggaggttttggaaatgtgtgacgaggcaaccagcttcacatcccccatggtctgcaaaaaggaaggaagaggacaaggtcagatcagacaaagcacagccctgtcttcccttcaggcatcaggtgtgtccagtctggaggtgtggcttttacgtggagcagatccccagttaggtcagtgtccacccacagctcctctgtgaagatgagaggctctgtcttttatacacaaagtgccaggacaaggcagagcccatcccagacaaacactccggttcccagggcgatgccctgcctcctcaaaaccctgtggggaactttccatcttttcactgaccccttcttctaggaaaggggaagctggggacaagaatggagaaatagttcttataatagatatctataatctgtatttaatagtcactaactcttcaggaccaacatctacattaagcacttctggcagaaagtagaaactgctttagcctgaactgcaagagctcacaggctatagaaaaatgggatccatactccaagagaggaaggtagtttggggttaatatggcaaggaccctgggtgaggtaaagggagagtcttggctgaatgaagggaaggaggtaggcatggggggacatcccacctctgaggaccagattgtgaacaaggctccaagatcacagatcatcagagaaggggggtgttttcagattacccaggctaatgcctctgcttataactgaagcccagagagggtaagtcacttgccccaggagacagagcaaaatgatggtatcactgacaagaacaccttaagccctgactcctggtccagggcctgctggggactagataagatgtgactggggctggcaagggtagcagaacaaggggctgacatgagaagtaacagacgactactcattagagcgatcgtcaactcttttgtgatattttattattcttaattttaaatacatttcatcataaaacttgaaaattaccaatatgtaaaaataataagttatcatttattgagaatacattctgttccaggcactgtatcaagcactttttatattatctcatttgttttaatcctcagaacaaccccatgaagtatgtatagtcatcatttcgcaaataaagaagctgaggtcagacaggtggaataacttgcccattacacagctattgagtggcagaagtggaagttaaacccaggcaggctccagagctcttttaaaatgtgaaaatgtgaacctgaaataaaagttttttaagtgaaaatatccataattctattatacagaatggtggtacatttccctccaattttgtttttatcaatatagaaaaacacatatcttacatggttgaaagcatactatgtaaacaatgttttctattttttccctacaacttttcttaaaataagggggaaaagttgcttttaagaaatttgattttcaaatatccatcatattgatgtatgacttacataactatctccctactgctggccatttggatagtttctaaatcttttatgatgcccggtgatgagtctatgtgtactgaaatctatgcccgaattcctaaagatttccttacaaatgactccaaaagtggaattattataagtacatatctgagttcttgattgaaagcaagagaagctaaatctggctcttgtaaacagagaaaggatttgttggaaagatggtggagtttcagggggagtttccaaaatccatagaaaaatctgaagaaccaggctgggaaaacgttgcagttgagaagagctaggtggtcggactccagtcaaggccattggacaacaactgccaccacctggaatacacccaaagtgtccctgtcccaggttccaagtgcaggtggggacagatccaggctgacgatcatttcttaccacaaaatccctgatgactggcccagacgtggggcacacatctgctgaactgaagagaagccatattcctagatttgcttttctgttcattttctttggctgtctggtcacatacttaagtcctatgctgtgagtcaggtaaactgacacaaatgaacaatgctctctgggacatgtaattagtttgtttaaatttaataatctctaacaaaaataaaatggggatatctcttttgaagttcaagtgaaagcagcaaagggactaggctcatttgtaatagggcacatcccctgcttgataaacccagctttctctttcactgataagatattagctttgcaaacaaaattccttgttgaatggtaagactcacaggttccctgcagtaggtagcaataaaagcaaacacttgtgtagcacttactagatgtggggaactcttccaagccctttataaataataaatataaataataaatagctcatttgctccttacaacaacactatgagacagataatcttggtatccccattttgtggattagacacctgaggcacagtgagattgagaaatttgtccaagttcatgcatttagtagggggcagaacaggcatttgaacccaagcacctggcgccagagctgctattcttaaccactaggccctcttgcctcctgtaagcagtcaaattggctgatgggaaaggaaaagtaaaagttgggataacaaggggaaaagttgagagccgctaccacatatgtataaaattaaaatattctgtaatactatcaacaacattagaagatgggtgataacctggaataaaatgtttgcaccaaacaaaggtctttacatatcagaagaaagcagcccaacagatcaatggacggatgatatgacctgaacaatgcacagaggatgtaccactgaacactcttggctccgacaataatccaagagtgcaaattaagaataagctgttactttttaaaaatgaaccaaaacatttcatttaaatgacatttaaaaagaaacataacatatactgctggtgagaccatgatgagatgggcatgctcataccctctgtggggaataaaaactggtgtagtctttctggaaagcaatttggtaaaaagattctaaaaaatacttccatgtcttttcccaataatcctacatttagaaatatattattgggaaagaatcagagatacagcccaaaatttatttataagaacactatttgcattatttaggacagaagatagactatattttaaaaaatccaacagtgagaactggtcaaatacagtggaataccaggtggttttatgggtacatatttacagggaaaataatgataagaatttgatgatatagaaattttaaatttaaaaaattattacgggaaatttcaaacatacagaacagtagaattgaatgataaaatgagcaccccaaatacctatcacctagatttaacaattaacattttgccatatttatagcatctatagcatttatagcatatagtatatgtttgtagaaccatttaaaagcagtcatactacaattttaatggcgagcatcaagatatattcattcactcaattaaaatatatttactaaatatctaccatgggccaagctagagacttggtatacagcagcagttacatgagtggggcatgtgtgttgttgtttgtgtggcgaccgtagaaacacagggctgcggaaggaatgggcatcatctgatatcccacatagctacccaggaccacaccccagtaagaacactgctccctgtgccctcctcctctgccacagaggtgaagtgatgatacactgtgcagccaggaccgggtagagacttgggatgaaggtggggacaggtatcatgaggatcagacttttgtgaccctgccacaaacccggggacacggccactttccagctgtgagctgggcaaggtgctccaaccctcttggcttcagtctctttctctgtcaaatggaatgatcatatcagcctcataaagttgaagggaaggtttgaacgagagtgtatgtaacacccataatatagcataaaaggcattcaatagcagtggctgtcaacatcattatcatccagttcccaaagggatgcccgtctctccaccctgaatatagatatagaccctttcaccaaagacagcaagaagccccagatatcttcaggcaagggtctatgagtgagatgactggaaaacagtagcaggaagcagatggcagaattccctgggaaggtggggaggagggcctgaggcccatgggcagcttcccgcagcacctttgtgtctgtactagcagcaccatttaataagcaaggtgtacgtgctgacatcatgctgggcacccatctcaatcagaaagagcagttctaatgatcaccccttcacaaatgaagacatagaggcttagaaagccaactactcttgtctaaggtcacacagctaaaaagtgaaaaccaaatcaaggtctgattacaaagtcaaaatctgctggcttctcggaggcccccacatctcaaatgaggtatttcttgccatccccagtaatgagagatgcaataggcagagggttgggagttgtacagaggaagaggggcagagcatgtgcctcccccttctgctgtcaggcctggctttgaagacacaagactcttctctacctttgctttcaggggagctggaagctaggagtggtgagatcctcctggaaggtaggagtggctcaggaccctctgtgcaagtcctcttgatctaaaatcagaggcccatggaaatctcctgaaggccccagatgttctcatcaaaaggcacctgcttgatctcaacagcacattagacaggagtcatccatccctaggagaggtctggcttcaggttagaaaaggaacacgcaaatcaatacagcaagggaacatctagtcccttgcaaagtgcttttgtgggggagagttactcaactaccatgcggacaggaccagagcccagccacaccaaacagctctgctcaccctcagcccatcgccccacccactgccatcatcagcataaacagatctctgccacacaattaatggttactgacatatgtggaatgctctatcagaaaaaaaattaataataaagtaaattagaccaaacctcgttcctctctaatcccttgtcaagcctgtggactatattccaatcaagaaaaccagagaggttgggtgatttctacaataatttctctaatgcagagcaatgctcagtggctagaatcaaacacacccagctagggggtcttattcaatacaagctaaacacagatcaaaggggaaacacagagaagtaagaagaaaaaacaggggagagggtcaaaaagagcagtggttcaagagctggaaactcccccttaccccccttacccctcacccctcaccccctgatgcttgggccaacgcccacctctaaatgaggctttcacaagtaacataatttattaactatttgaagcagcattgagttaactggactttaatttgatcaaaagcactttaaattgtctcttgaacccagaaaggaacactttcaactacagcgaaaagagattgtaactataaggcaaatgactcagaaaaaaagtttaaaaaatcagggctcaagtaataccacagaacaagtttagagaaaccagttatccccttccctacccaaagtgtatacattttaaatgatcattgtcttgaagcacctggtcagtttgccgggcatcttggaaatatcataccttccctagagggaggggctcccaagcaggctccgcagtctaccgtgaaccctacctccaacaacagcacacatcagaggcagcaaaaccacccacgtgcaaatgccccaggcactgacagctccctctcccaccttaatcctctctgcaatgcactcaaatcctgacaagttctctaatcactcctaattccggagtgcgctgctcctcggctgtgccaggctgacttgctatgacctaccggagcaaagctgggcaggaccacacaccagtgaacgggacacaccttaccgcagcttcttcctcggcagctctcacatgagtcaggatgcgaggcagccacacttcaccaccaccgtactgcagaggttcctgtccaaggtccagccaagaatggagaccgaaggagtgccgggcgccacagagcccagggccagaccgaaaaagttaaggggcttttgttctgactctgctcgcagatggtgcaatttgccttccgctgagcagccaacttcacccggtccgggagatctgttgttctaatccgcccagctggggtgacctttgaaacctctggctgccactgcagaggctctcaatggagtcctgggggagccaggggtggaagctcacaggtttttatttttacttgttcagagctgcagattctaatctgagtgtggagcaaagggaggaccctgtcaagcagagagctgagtcctcggaggggctgggcactctcccaattccacatctggcctggaacaccactccaaccccttggcacatctggcctgggattaccacccagggatcataagatatttcctcctgagacccagctctttcttccctaagctgaagaagccctgtttatgatccctagagcaggatgcaagcccagcaagcagatggatggagaactcctgtgctgtgtttctcataaggaactgcactgatgaggcccagactccacagactgtgttcatgttgagcacgactttgcctcgttggtccagagccctggagagcttcaggaatgatccttggagcactcctctaaaatgaggcagcaaggtgatgccctgtccagaccttttcctccagcaagagaaggtattttcatagttccaaaggaacatcctatgcaactcacaccttggggcagactgtggacatccgaatcggcaatgacatgaatttaagttttcccttgattcatatctgattcttgaagagctggtattcttttaacacctaggagaccccctacctgctttcccagtagttctcaaacatttttgtctcagggtgggccccattatgcttctaaaaattattgagggcccccagagagcttttgtttgtgagttactgctgtcaatatttacagtattggaaattaaaactgggaaatattaattcattttaaaacatcaataagcccattataggctaacataaataacattttaagagaaaaatatattttctaagacaaaaaagaatttaatgagaagagttgctcctttttgcaaattaatgtctggctagtagaaaacagctaaattttcatatctgcttttgcatccaatctattgtgacatcacagctactagaaaactccactgtacgcttgaaagagaatgagagtgaaataaagtaaatgatgttttcttacaaaaataacttggacctcaagggaccctggaagagtctcagggacatccagggcacattttgagaaccaccacattagcctatctccctactctctctgttaccatctactctcatttctgtccttcttaaaatacacaaggagaaagggaaaagtggtcttctttattttttaacttttactttattttccctttaaaaaaaacttttattctagagtaagggagtacatgtgcaggtttattacaaaggtagattacatgatactgaggcttggggtatgattaaacccatcacccaggtagggagcatagtacccaacagatagtttttcagcccttgctcccctcccttttccctcctctagcaatccctagagtgtctattgttctgtttttatgttcatgtatacctcatgtttagcttccacttacaagtgagaacatgtggtatttgtttttctgtttctgtgttagtttgcttaggataatggcctccagctatacccatgttgctgcaaaggacatgatttcattcttttttatggctgcataatagtctatggtgtatatgtgccacattttctttatctgctccaccattgataggcacctagtttgattccatgtctttgctattgggaatagcactgtgaagaacatacagatgtatgtgtccttatgatagaatgatttatctttctttgactatatacccagtaatgagattgctgggtctaacggtagttcaactcctagttctttgaggaatctccaaactgccccagtggctggactaatttacactctcaccatgtaataatgtataagtgtctttctttttttctccacagccttgccaacatttgttattttggacttttaaacaaaagccattctgactgatgtcagatggtacctcatgatagttctgatttgcatcctttctactctttgtttctcagtcttcccagctgtgaaatgggcacaatcacagcctgcccggggtacaatctcagggtttcctgctggcatccttgagtgacttggatccaggtccctgggttcccacatgaaagcaggcaaagccagcccactcttgtcccaacagctgagttcttccctgagccaccaggcagcctctccctccccatggcttcctgggcctttcctcttggaagacacattaaaggaggggctgagcttctgcaggcagacaagctgcccacatcagctgggccacatcagcagagcagcagaccacgggtgggaggagcatttctgctcagcaacacaaccctggtgcccacatctttggcagaaagttatttttaaattttcttaaaaggggacaacgacaacaacaacacacacacagacacaggcacacagatctaatcaaatccacacacctaacctcacgcacagtgtgaaggagcaaggcctggtctcctggagttgttttcttcctgctggaattcttgctttatttgggatttgatgggaacaggctgagagaagttttctgcgatacaagtcatatgcaaaagtaattaaagccagaaccagagccctgcttataactaaattagcggaatgcacactccagctataatcctaaagttcactcacttcattcttaggtttcaccccctcaggattaagtttggggtatcaagtatacttattgaactcctaccaccactgtctccttctcaaataccatgccccccactccattctgccaagcagaactgtgccttgtgttttaaaccctatgagatgaggtgtgagtactcaggtaggggcagcctcacaacccttagcccactgaagcccaggaaatcgactcagggaacaagaaccgagctcatggcttccaatccctaggagggtggcttgaggcaattgacaatctctcaaaatcttagttgattcagctgtacaatgcggctactgctaatagcctcgtagctgcaagattgttacgagggtcagcaacgtgcataaaaagcgacctcagcctagtctctcacacagaataggagctgaatctatgatgactgctatcgttaatggtgttactgcttttatgattttaaagtttctgtcagaggctcagagaataaaagcaaccttgctcaaagtaggtgcacaggagaaatccggatggcactggagggtgagatagcacagaagagtcagtgactctcatgcttattgtggtgctgccacccaaaccagctgtgtgatctcaggaaagccaccttccttctctggtcctctctacacggcctgaagggtctctctgggcatttcctgtcctagtgcacctttctctaagactgccaccagctctccacaagacatgtgcgcaagtaggaaaggttccagcagggggatccaagcccaggcagggatgagctgctgcaggaccccaggagaggaggcaaagcttatatccaaccaaaaagacttctgttggggctccctgcccagggctgcccgccaagcaggcaaatcaggcaggcacacctggtcctcgagacacacctgtgagacagcggcacaggctaggaagactctgagggctgggtcagtcccgacccacacctgtgcagtgattctagctcctctgcttctggccagctcccaggtggagccctctgattggatgaggtctgtccagagaagagctggggctggaagagctaagggaaaatcccaggggaaaaaggagaaaaagagagaactaataatagttgccatgtatttagcacttactgtcaggcattagactaagtacttaaggtgacttagaactcatttaatcccttagcagaatggcagatattaacagcaaaattaatggggcaggatgttggggagtatcatttgctcataaggtaaatggaatatactccctgtctttcaatcacttcattcttcctctccctcccactccctcaattctgccagcatttggtaatttgagttattttgaaacagaaatcttgcagggggcagggagggaagccagggagagggctagcaagtgggtttgggcagcccatggcagtagggtgtgctattggtgctgtagggtcacaggactgagaggagacccagaaaggagagggagtaaaaagggtcacctctctgtggcaggagtctgtcctgccctcccctcctctccaacagtggtctgtgagaagcctaggaaagcccacttgagaaaagaaggtgcaggaaggaaatgcacctcatgattctgcagatcacacactcccctggagcaggctgtgagcaggttctctacctgcagactgtagatcccatgccttctgtctaaaatggcctgaaatacacactgcctctctgctttctgcagggagctggttctgtggggatgatcttaagggacaagcccagaggatactttgctaggaagacccctcaattctgagggcatgggcacaagtgaactgtgagagaagctgcccaggcctggcttctaaatgtggcccctggtcctctctatgcagtttaggggaggcaccaggtcccatggcctgtttcccctgagaaaacattagctctgtgactcaactaacacctgactgattggaggagagggaagaaggaaggcgcttctgtgtgtgtcctcctttccatgtgagcctaagccattcagctggaacaggtcttccgcttggaagagggagcaggaagcactgctgacaggaggggctgcggtgacatggttgccagtaggatcccagactcttatcaagtgaagactgtcaccagccccagctgtccacagctcctgctggacccctggggccaaaggcagttgccatcactcgtttggctctggtgcatccatggttgactcgagcttccattactgaaaggcctggggatacttctattccaaatccttccccgtgtgacacagcaaaggagaatgagacatgagccaacctggtttatcaactcctttaggacctgggatttgagaagcaggtttgcagttttctaattacatccatcaacacaatctgcctcccgtggctgaagcccaaagcctggcaaacggtattaaggatttctagttttacttccatccttggttagcactgacaggagaaggcaggtgcacacggagggaagtgaggagggagccgagactgggtttctccaacacgccagaggagggaaggtgctaaatctaggtggaggtttttcccataaaaatctagggtttttttcccatacaattctcaggctggctgcctcaactaaagagagagagggccaattcctaattcagggtcaagtccagagctgtatcataaacacagctggggtaaccaccagtcctaggagagtagtaacaacagatttacaacctaagaggaagcacagtggtgactgcaagacagaggacttgggtggagccatcacgtcacaggctttgttgttacacacacctagacttgaaccctgctactgccacacagtggctggatgaccgtgggtgatttacttaacttctctaaacctcaatttccccatctgtacatctgcagggtagtatgattagcagcagctttaagcagctatcagaaagtagatactcaaaatactcaatacattgtaactgtaataagtaatttctaaccatgtctggcatgtagcaagcactcaaaaaatggtaacaatttgataatagtcagttatgatgaagactcaggtttcacatttcacttaaatgttttagttcatttaaatattgctacaaacattgccctatatatcacaaggaatagattattaattcatgcttttatttttattttattttttaattcatgcttttaaagtgcttttttaaatcaattacttataattgttggacaatatgcattgctctcatcttctcagattctaggttactgtttgcacactgaaaaatggctggattgcagaatgtcagcgatgaaagagaacctaaatcatgtagtccgctcccttattttatggatgaggaaactagggtccagagtggaccactgtatcttcaaagactgagttgagatctctgaagctggcaaagcacagagaacaggccatggtaatctaagcaggtgagccgtctgtatagagctgatctagggagatggtggtgcctgtatataagagcaaggaaactcatctggtaaagagatgggtcaagagaaatgttgaaaaatagtcattacattgattgagactagcttgtggagggcctagaggatggtgatacttagctaatgttaccaaaagggtttttacttaaaatgaacatttagctacttatttaacaactgatgaaatactttcctaatcaatatcccatttcaacttcacaacatactaagatattatttatttatttatttattttttgagatggagtcttgctcttgtcacccaggctgaagtacaatggcgtgatctcggctcaatgcaacctccgcatcctgggttcaagtgattctcctgctttagcctcctgagtagctgggattacaggtgcgcatcactacacctggctaatttttttgtatttttagtagagatggggtttcagcatgttggccaggctggtctcgaactcctgacctcaggtgatccacccacctcggcctcccaaagtgctgggattacaggcgtgaaccaccgtgcctggccaacatactgagatattttatagcaccactttatggatggaacacccgaagctcaaagaccaggtgagtcttgcctaaggtcatatagttcataaagcagtactggaatccagtccttctgaacttcaaatccaacttggcaacatgcttagaaagggtttatcaagatatgttaaatcttatggctgggcatggtggctcacacctgtaatcccagcactttgagaagccaaggcgggggcatgacctgaggtcaggagttcaagaccaccctggccaacatggtgaaacctcctctctatcaaaaatacaaaagtcagctgggtgtggtggcaggcgcctgtaatcccagctactctggaggctgaggcaggagaatctcttgaacccgggaggcagaggttgcagtgggctgagacagtgccactgcactccagcctgggcaatggagtgaaactccatccccccaccaaaaaaaaaaaagctatgttaaatcttattataacaaataccttacacaacaggaaatttccagtgtaacgaatgtattgatatccccttagatttttattgtcatgacatctgctgagtatgaatttgactaagtcatcaatcccttgcccagggaaaacccttacatttgccctaaacaaacggggtgacttcatttgaatccctcatgcctgaggaagagaccatgcatactggcaaatttgtgcaaggctgacaccaccatcagcagatagtctttccccatgcacagagaggttcccagaatgtagttagagattgttcccattcaaaggccagaaatctctgtgttctctccaaaaccttgctgcccttctccagactccctcaactctcctcccactggctgggcacaagcccagaccccagccttaggtgctgcatcagaatggccaggaggccttggcagtgtgacaagctctatgtttccacatgcagttcaccccctgccctcactgccctcctgagatatgagggctcctccccagacagcctccagctgtggatgagaaacaatggcttagtgcttcctggaaattacctggggagatggagagctgccaagccaaacctgccagggtcatcagctcaaggccgacagtcaggcccagacacagcccggctcttcctccagcctccttcacccttcactgcagagggctgtctctctccctgtttctgctagttccacttccacacagccctgtccattctcaccaggggcagggcacagggatcccgcttctcaggttcctttagaattctttggtaccaaccttaggtcctttgaggatgagactcacttactctaggtgcctggaatttcacagctggaagggacctttgaaactactttcaatcccacctccagcccagaggggtgtggctgtatgccctttgggatatttgaggctacctcaccctagaacatcaactttactcaaagatttgggtgaagcatttttatattacaaccaaaaaattcagatcattgtataggataccaactgtaagtagattttacaaataaataggagttcaaagaaatgccaggctttctgcaagctgctacaggctacaccccaagcccctaaccctagaatacatgctctttctctactgtcctcagggatggctaagtcagagaagcactggtccaattacagaaaggaaacctaaggtccagacaagtgcagtgactgaaccacatatcgattgtcactaatacaaacaacccatttattgaatgcttattgaggactaggtactgtactgagggctttatataagtttactgtaattttcaaagtaattctataagatacatactgtattactttcattttaaagataaaggaagcactcagaagttgagtaatagtagccaaagttctcaaagctaataagtaacggctacttattatcaactggatttgaactgaggtctctgattccaggcttcagacccttggtgacaaggtcacattgttagagatgccacacggaagagctgggagtggactggagttcaaaggtcctggtgtcctgtcctggctctgctgctagattgcacataatcacagaactcagagagcccctggctcaccttctcagtctatagataagaaaaccaaggcctacagagaagaaactgacttaaggccacaacatttcagggacagggtctgctaacagtgaggccctgagggagtgtcctgacctctctggggttagaagacctctaagcaggccaggcgtggtggctcacgcctgtaatcccagcactttgggaggccaaggtgggcagatcacttgaggtcaggagttcgagacaagcctggccaacatggtgaaacagcatctctactaaaaatacaaaaaggtagccaggtgtggtggcaggcacctgtaatcccagctacttgggaggctgaggcaggagaatcgcttgaacccaggaggcggaagttgtggtgagccaagattgcaccactgcactccagcctgggcaacaagagtgaaacttcgtctaaaaaacaaaaacaaacaaacaaaaagaagacctctaaacatataatcttaggtgcacatcctggcagtctctctgtgagctccagcacctgcagagccactcgcacactctgctctgcagacagcagctcagacacactatcctaaacctctcaccagtaagcaggatggagcatactaaggaaacctatttgacaatcccagttgccctgcttctgagactagcttgtcagtctgctagtgatgagctaagccttgtattacaggaaataggacgtacacgcagtagccaaatgccacagccacaacacacagccctctcagcaaggaaattccagaagttcataatttcctgcggttcttatacataggaatcctcttctatattccaacttcttaggccactgttgtttgtctaaaaggcctactccacagctggacaaaaggattgagaagatgggactctcctgactatttcgaacagtttacctgatcatggttctcaagctttatcaggtttgtgctctcagcagagcaggaagaactagggcctaaggctcagaactcattacctgtccgcacacccatcactgtgtatttactgagtgcccacaatacccgctaggactataaataaggtgagaggttcaactacctcctcccaatacaatgacataagtgctgtaggtgaaacgcggacataggcccctcccccagacctcaggacagaatggccgtgtttcccgtggttcccatagtctccctgtgacttccctctcctcccctgcccctgcttcccttcccaatcaaggtggccactctctggaacgaagagttcaatctgcatctccctgtgagccatgggtgagcagggtggccctgggtctggagctggcgtctgttgagcctaggcctttctgggcctcaatctcaggcttgggccggcccactgtgtcagggttcagccctctctgcttcatttctggcgctcaatagaatacaaaatgaggaaatgtaagccagctctaagcctggccctggctctgccaatggggatgccagtcatgtctcttctagatgaacaatccccccaacaggctcaggacagttctcaccttccctgtcgtgctcctcaggtaggcaggtgaacccactcaagcaccagctgcatgcaatgcctgtggcaggactggccgggagtccagtcagacccttggctgtcctcatgtgactcacacaggcccttccacaccatgccctgcctgtctcccaaaggacaccctccagttccaggttgtctgcagggcagtcagtgatgttgctgagaacaactgatttttgccatctgcaatgatgggtgataacagagatcgacacacttttctcccttaacagtctcatttttctagcaatcatggctacctttttctcctcacacttcaccaaagatactaatgaggctaacacatgtttctccttttctcccagccctaaatctcttctagaatggggctaactggaaagaaatggtgacctctgagaacctggagaaggtatggaaaaaaccaatgatcaactgagagcacagcccatcagcaggaacacaaagaggaacttctgctcggaggtgtcagctcagctggtttccagtggagaggagaaagtgcgtgtcccctctcaaccctttctgaaacagggagccatttgcactcggggtgagggagcccttccacacaggatcctccatcagctgcaagggggaagtacaggcaaatgcagggccaacagggagatcaatggaccaccatcagctattagctgcactcatacctggctcagggatcatgggccttgaggatatgaggctcaacttccaatagggaatttggaatcctattggagaaaacagattatcaaagagaaaaatagagccccaggagccaggaaagtgggatggaaaattaaaaagctaatggggcattgacctgttcaaaggccctaaaacccttcatgcttgtctactcctgaacttgaaattccacaccctaccggggacactgtgctaaacaaaggcagcagttcattttttttagcattcagcctggagtgcctagcatttattgagtgttagatgctctctctcgccaacagtaacaagattggtatagtgctctgaagagcagtatgttgtttatcatccctgtaaagctttgaaacggcaattctagtgccagaacattttctttcaagcaatttaggtaagcttctacctggtggacacagcagccagccagctaggcccctccaggtgtgattgattaggccagaaagcagtacttcacatacttatttgtatcatttttctataaaaacatatctattaaattaacaattcacttctaactactaacccccatttctaacagttatataacattgaacagaatgctatcacctggagcttttatcattaacgctcaatataaagaatccatttttaatctcactctggttttttgtcattacccaatatggaactgttcttagagaaagcagacccctgggacttctcagagtcagcgatagagattcaggacgcctacactgaagaactcttgccccccagttctgttccccctcatacctattagtcagggctgggttctatcaccttaatggcttcatcccgctctgcttctgggctcaagagaaaaactgaattcattattgacagcacctgttccttgtgatgtaagcttaaaccaaatgaggggcggtcagaaccaacttgcttacacctgtttcagtttaagactttgcagtggtactttctcccccactgaaagtcaggtttccccacccaacctctctaggaagctatggtttgacattagcccatgcttgctcaggtgtcctctccacagatcccggccaattccatatctagcctggcctctaaagcagagcgttctctcttgagtgagacagtggtttccccttatctcttaactagagacttaaaacagtgtccaggtgccaaaaggtaatttcttgcttaagtccaggaaaagccagagtttgccccaacacttgtcacctgtgtccctcaaccaaccaactgaacaaaacatctatgaaagacctagatgtctctttactttggaaatccctgatgcagggccaactgttaatctgtttgttcacacatccagtcagctgtgcctgtcacggcttctccgttgactgggggccccactgagctgaggctgtctgtgaggagatactttgtgaaggtctttacctcctgtttcgcagtgctcccaagatgtccagccaggcatattggggcactcagggtcacaccaattctcctgtgggcacagggaagggggccttctccacaatcccaccccacttttcttgcaagatgaacctaggcttggctcccaggctagatcactgatggtcaacttggcagtctgctcagtaatggggttcccaaaaaacgtgccttgacagagccgatagaagaaagggcagacagcaggaagtaaacagagcccactcaggccaagtccctatctgcttaaagttatcatcctctaccatttgaactgatttttgcactagccataccagggctttttcatgaaaagtcaagaacttgctaatgctaaaaggttgcaaataggggaaggttcagctggcaaattatttacccttacttaagcttctgcttattgagattttaatggtcatgtaccaggtttgtgggatgggggaggaagactgcaaggggaaaaggagctcttgggtcaaagttaaatatgaattctagccacatgctggggcagcttgggaataattaccttggttatcttaatcaggatagacagcagaactgtattcatctacaacacctgggccacttctccatcaggctgggcccacctctgcgtcagggaatcttaattcactgtctctctctctcttttttttttttgagatggagtctcgctctgttgcccaggctggaatgcagtgacgtgatctcagctcactgcaacctctgcctcccgggttcaagcgattctcctgcctcagcctcccgagttgctgggattacagacatgtgcgaccacgcctgactaatttttgtatttttagtagagacggggtttcaccatgttggccaggctgggctcgaactcccaacctcaagcaatctgcctgccttagcctcccaaagtgctgggattacaggcatgagccaccatgcccggacaattcacggcctcttaagcactagaggcaaccagcagagcaactgtcatcaacccagaatgtcctccaacctccttttcaataattagggtgaccacataacatattatccaaatgagagctcttgagaatggaaagggctctttgaatactcatgctgggactattcaggggagccgggctatacataaggccacctctaccctaatcactcccatgtctccctaagtctagacacaagacatgacttcaaagatatcttccccatgcagctgtgtcaaatttggtgcctgccctgcctgtgtaggcactgacccagaaggctgccacagaaacactgactcatgggccctgttcctgtgtctcgggctcagggataaatttggttacagataccaagcctctagaaaaacaaaagacaaaggtatcttccccggccacattcaccctattccggccaagctcaggcttcatgtcccctctgtccaggaacctgttatttcacactccgggttattttggacatgttctcatagctgtccttactcctttgctagacagacagtgtcttggtttctgactctttacaggaatgttgaactcacccgagttcccttgtctcatcatcttttgtcattcataaacaaataaacaatattggctaaaagtttggtcgtgagtacgattacaaatgacttttcccccaatataaatactataattttctgtaatatttttccaatctgtttctatgtatgtacttttaaaaataaaattatatatacaaattatcattgccttcatttttcatgcttttcctcagatatggaacactcttcataaatcttattttcagtgactgtatcatattctagcaagtagacaagccaaaacttaatgatgcccctgttatttactatttaggttgcttccaatttcattaaaacaaacagtttcatggacataaactgatcctttctttctttctttctttctttttttagatggagtctcattctgttacccaggctggagtacagcggcatgatctcggctcactgcaacctccacctcccaggttcaagcaagtctcctgtctcagcctcccgagtagctaggactacaggcacctgacaccatgcctggctaatttttgtatttttagtagagacagggtttcaccttgttggtcaggctggtcttgaactcctgacctcaggtgattcacccaccttggcctcccaaagcactgggattacaggcatgagccaccacacctggcccctttatttccataataatcctttagattatttccccaagatacatttcaagaacttcaattactgagtcagagtgcatgggattttatggctcttgcatccaggtcctcttgattcctgtcaacttgcctggtgctgacttgtggctccccagtattttactctcctgcctcagcctccgtttaagcttgttcttcttgatctggtgccagaattcaggcaagtatcaggtccagggattcctacatggtttgaagggatgtacacttagatacccaaccaagttaggcaagccttgggaagtgaggcaagtattgagtaagacagaaaaggatccaagcttcgagaagtcgtgaagttcaaaacgattgctatcaagcaaaacatgaggcttctgccctctccagtataatcctgccagtgggggcagctctggaatgcctcccatggtcttttccacccagctgagtcctactccaacctcaaggtccatctcttctctaagccctccccacccagcaggatctaagagcctctaaagccctatctatgacatgggtccacaagcaccccatccatcacatcgtgcccaccaacctatgaaaagtaagaaaaatgaggacaacatggggagctttttataccgcttaacgtaaataatttaaaaggctgtcctctaatctcagtttatgtccttcaaactttttagaaattcatgtgttctttcatttatttgtaaaaatgtaaatggctttgtttaattagaagtttgttcattcatcacgtttttgagagcttactacctgccaggtgctataatagtccctggagacatagcagtgaacaaaacagatgaagcttcccctgctcagcccagctcagattctgcagatcaaggccttgtctccccagctgcaatgcctatgagcaggacctgggtttgtacatctttggatctgcacacagtaagttcttaatacacacttgctgaggacagagttttataatgatatcaacacttcctgggaggatggtgggagcactggtgtgcacatcagtatgcattgatggcatacatcctatgggtctcccatatgtatgtatggcatatgtatgcatgcatggaagcatgaagtaggcgctgaagtcagccagctctggcaccacactgcctggcttccagccccagctctgctgcaagaccttcagcaaagttcttggacctctttcagctcatgtcctccctataatggggggaagatggtaacaacacttgtctcagaggtcatgaggactgaagtcctcaacacagtgctggttccctggaagccctccttaaatgtggcctgttgcagctataaccatagcaccaattgggtgctaaatgaaccagctattaggcgacagagtcaacattaaaccaagagaaaacttccacactccagggaaccaacctgaaattgaagatgtatttcactggttggccagaaaagttaataacataagacagaaattttcatttgtacataaaagagagggaaaaaaaactagacagactttctcctccttctccaaatatgccaataatagaaatatggcacaatgcccctgccaaatccaggtttctgtaatgatgggcacgtgccagaactcaaccacaaacagccaggctgagttggggggagcagaatttgggaataaacacacacagatcggggactttcctgaagtatggacattccacagacagatcatttccggtgccacagaaagcttcggaatttaagaagtctgaaggagggtgcagtagggtgggaaacagagcatgggccacagccagcagaaggacaaaggcccaagtttgtagaggctgctgttagcactgagatttaagtggaatgctgtgcagatttaatatcagtggcgcagataaaataatgtcagcagattgggtaattaaagcttcttggctcacttcctcactctctcactttctggaaggatgttcagagggaaaagagatgggtgcaataaaccaagaattcctcagggttatgaggatatttttagtttctcctgacatctaggatagcagagatattatttcaggatcagatcttgactatgccctttacactgggctaagcatcactctttaaaaccctttgatgaaaatgagattcttttaaagatgtccacagagtaattaagacaagactacttctggggagtctttagcccctagcagaggccatttctagcagagtggaacatatactgtgaagccagttgccaccactcctgtttcttaccatctccccaaattcctttccctacctgcccagggttcccctctgggcctgcatctggatcagatctgctcagcccaggcctacagctacaccaggggagttgtcagggggccgtagcaaggtcatcacagagcagcactggcccaaccacctgttcccacttgctttttaaagcttgggctacttgacaaggaaagagtgaatcacagaaccacagaatcttattctgtcccaaactgggcaacagtgggcctcatgtgtgcaacgagatttgccagggtatagctgagccatgaggctggtgattacaggctgatagcgggtaaggaaccaaaaatagggcaggcctgagagtgcgaggagctgcagaactaactcctccagatccttagggtggtcctggattctcaagaggtaaggcaccctcctcacacatgcagaaaccatctctgtgcatgtccaacagacctgaggcctgaggctccaagaagggacagggggcatggcaggggaaggagttcaggtcactgttagcagggtcagctctcttaggaaaggtctagagaacctcattagggccatcctcttccattgcccagctcctatagcagaggggtttattgtggggaccttgacagagcccagacagcacatctttgaaaggtaaccactgagttaccactctcacaggtagtccattcccttatgatgtcagggggcactgtattattcaagaaatgatttttgctgagccatgatatgcctccccgtaaatggacccaattctgcctcctgcagtcacacagagtgaactctcctcttctataagacatgcctacaaatgtttgaagacaggcatcacttatcctttatcattctgcagattaaacacaatcagtcccacttcaactatttctacttggcagttttcaaatacatccacttcctctgggcacacattagtttgactatgaccctcttgctatgactctgaggaatgaagaaagaacacaaccacagggaacctgtaatcccagcactttgggaggccaaggcaagtcgaccacttgagcccaggaggtcgagacaagcctggacaacacggcaaaccacaactctacaaaaaaacacaaaaattaactgggaatggtggtgcatgcctgtggtctcagccactcaaggggctgaggcaggaggattgcttgagtccagaaggcagaggttgtagtgagcagagatggcacctctgcactccagcctgagcgacagagccagaccctctctcaaaaacaaaaacaaaaacccacaactcgcaaccacacagtggttaaatgtgcagatttgaatctcagttctgtcacccactgtgccttagtttcctcagcagcacctgataatcttagttgtggtgaattaaatcaacaattcatggagagctcttagaactgtgcttggcacctgataagcatctaattaagttttagctacttcttagcacaatgcttacattataagaagtacataatacatacacaagtcctccacctagatattccagttccctgactcaccagcttccttaccgataaaacaacaacagtaccaccctgggcaaggctgctttgaaactttgatgaggcaagaaatgagaagtctcctggtcagtgcttggtgcatgacaaggatgaaataaacattagcttcctttcctttttattgatgcaacagttgggagaccattcttcatgtctctcacagttttgcacatcttgcaagcagaggcactgactgcctttgttcccgactatcttttcaagaagatttgcatagcaaacagccttcaaagagagagtttccctcaggatggagcaaagtgcaggcacacttactgttcattacagagctctcaagttccctaggctcaggaattctctccactgtgtgtgcaggtatcacctggctctcttggtgtcaacctgtgggggttggagctcaaagaaccagtacaggaaaatgatgatgttctgattactgttactgttgtgaatcataaagtcccttatctctaccccatgagtctcatcttctgccagcaggtatgaaactgtggcaggttaactccttaacttgaaagtatatgaaatctaagacccttcacagctattagcaaaagcctatagaaaagatagtggcaaaataaactcctttcccatagtctttatcttaaaatgtcatctaccccttcacatcctagcaacgtttagctgactttttaaaatttttaagtaaagaatgtttccttattttcttattattcctgttgattttcatcttctggattgtaattcaaatttctgttcatttgagatatttctaagcctccttttttttttttttttttttttgcagggggcattcttttgaagactcctctttttaagttcctttgtctgagatgcacagaccatcatctctccttacatcccattcattcctcccaccaaaacaggtgcaccaccctccttctaaatctagtctcttaactgtagcatcagacaccaggtctgtactgaataaaacttacggagagcttctaacttcattcaatttgttggcaagagaactgaaagttctaccagcatcctagggtgctcttctcctctcccttcatccttcactgagagcacagagcagggctctcatgctaacaaccctgcctgtaaaaggtggggatgcatgacctgagggtgtgactcaggcaaaggccagcaggacaccagctgttgtagttgggcagaacaggtaagaacagaaatctgagaaatctggcctagaacagctgactaacccacatcaagccaggatctaagaacatggttgtatgaatgggagcagggaagtacagatactgccagactcacctcaggcactaagaaaaggagggaacacagttaaggataaggttatggaaatgcctaatataatttctactcacctcaggcagctaagtggaaagctggtagatacagaagcagtcatggctccacgtctttttcagataccctaaattaatgggacatgatcttcactcctgcctcctaccactacttccactgccactcatttttagatcgaggatttgtgtgcatgataaagtctagcttgcagatacccatggactattcagctaagctaccagtgattgatttccttccttccttccttccttccttccttccctccttccttccttccttccctccttccttccttccttccttccctccttccttccttccttccttctttcctctctctctcttttattcttttctttctgacgaagtctgactctgttgcccaggctggaatgcagtagtgcaatctcggctcactgcaacctctgcctcccaggttcaggcaattctcctgtctcagttccccaagtagctgggattacgagtgtgcaccaccacacctggctattcttttttttgtatatttagtagggacaggatttcaccatgttaaccaggctggtgtcgaactcccgacctcaagtgatccacccacctcggtctcccaaagtgctgggattacaggcgtgagccaccacgcccggctgagctaacagtgattttcaaagttttctctcttgctttctataattaccctccctccccactacaaaattggtatatctaagtctcagcaactggtatgaaattataactaatgattcttttaaaaataaataaaaaattaaaaagccaacaaaactcttgaactatcatgctttgctattattcatctttttttatattttgggttttatttttagattttactgtctaaagatctcttataatatattttaagcagggcagggtatcccaagatctcaacatctggtcataagttacttgcagagctgtagcatagttttctttcttttgaaaaataattagtctgtgatggctttaatggatagcaaatgaataaaaacaacttttatcttaacatagttttagcagtaagaatgaattttatcaggccccatgatcagggattatctggaaacatttagtaataagttccaagaaaaactccaggggatgaacccttgatctgcaggcctcctaccagcttaaactttacagggctaggggtccaccttcatcccgcacccagggtctcctttgtgttgtaggggctcaactgctggtcctgcctcccccaagatggctttccattttgtcaaagtgttcacaagtgccccaaccagaaattactcttatgctttcctatgatactatgggtcgtctgctttcattatgtttatgtaagagacaggacaagatccaaacctcatcgcaatctcccaattgccagaaaacccaaccctttacctatatagattaacttccagtttgtccaaccctgtagggggttgctgtggtttgaatgtgtcccccagaattcatgttttggaaacttgactcccactgcaacggttttgagaggtgggacctttaagaggtgattaagtaatgaaggctttgttctcattaatagattcatgttatttcaggaatgggttcattattgtaggagtgggtttcttatttaaaaaaaagtccaaccctcctcttgctctcttattctctcttgtccttctaccttccaccgtgggatgacacagcaagaaggccctggcaagaagccagcccttgaacttggacttcccagcctccagaactgtaagaaataagtctctattctttataaattacctggtttgtgatattcttttacagcagcataaaataggctaagacagggtcttcaggctattccaacacagatactgcctctagtcaaaaatggccagaccctcaggcctgggtactcctcatcaatacagagaaatgaaacctggtcaagagaagaggccactgctgtcccaaagcgcagcccatagaattactccccagacacaggtaccatctggattatccagtctttgtaagaacctgaactggtagttctgtgtaagaaaccttcaagggaagccatgagggactcctccatccttcttcatctgcagcagggggtcatgtgtactttacagagtatggtaaagaatcccactgctgcatcaatcagtgggcaaagagcccatcatgacccatcagtgtccctgcttcctcaggttgaagttctatgaccacgtttgtggggctgacagtttctgaagttaagaatctgacacatttgtgcatctgtcctacttcttccatctgtcttctcctctgccacccaacccttctactcagagttgggatatcagtagcctcttctgcctaggaagggactagtcctggacttccttgtcatcactgtccccacacccacccaatacacaactccaaaagtagctcctcaggaaacgtcacttcaggcctcaacctcacactgcagagcttttggagtgaggcagttaagggacagctttaagtggctctaagtgcaaacagaagaaagaaatcatccctggcttcaatgaggttccagtttaatgggggaagatgaggtccacgaacacatatgaaagcaggaaatcaccaagagagcatcattccttgtgtgataatgggtttaaacacctcgtggctgcactaacacattaacatagttaatcaccacccctgcttcttgacagactttcttcccttggtttctggaatgccatgctctcctgtttttcttcctacttccttttccccgtctctaaatgactggcatgctcactcctgaggtgatcaaatccagtcctgtggttttatacaccatccagaagctggtgatctccacacacatttcttatcccaccctctccactgacctccagaatttgacatctcactgtctactccagatctcgactggcttatctaacaagacatacaggacctctccatttcctccagctaaatgtgctcttctcacagcatttcccatccaggcaaaaggctccactgtccacccaagtgctcaggcccagaattcatccctcactcctctccctccacttccaatccataagcagctctgactggttctaactttaatcttatcactcccctccacctccactgccaccagccatccaaggcaccattgtcatgcttttagaccactgtagcagtctcctatgtgcctccctaattccactctcacttccctacagttagctccctcacacagtcagattgcggtgctccccacttaacaccctccaatggctgcccactacacacagaataaaacccaaaccccttaccatggcctacacggccctgcatcacccagctctggctcactgccccaaactcatctcctattaagctctgccctcccactcttacactcactggcctgctttgctgttcctccaaccacaccaagttcactcctgactcagggcctttgcaatggacagttttcctaccctgaatagttttcttcctccagatcttctcaagaccccctcctttattttattgttttctgcttacatatcacctccacaggggggcctttcttgaccacttgaccatcctatataaaatacccctctacccaatctcttcatccccttatgctccttattgtactttattgtttcttttttttttttttgagacggagtttcactcttgtcccccaggctggagtgcaatggcgcgatctcagctcgccgcaacctctgcctcctgggtccaagtgattctcctgcctcagcctcctgagtagctgggattacaggcctacaccatcatgtccagctaatttttgtattttgagtagagacagggtttcactatgttggccaggctggtctcgaactcctgacctcaggtgatccatccgccttggtctcccaaagtgctgggattacaggtgtgagccacagcatctggctcttactgtactttaaaatcactgctggatgttactgtcttcctgttccactagaatgaaaattacgtgagagcagggactttgcctcactcctcattcaaagagcacttgttaaatgaatgaaagtcatgcctggtagaatgtcatgtcatgttagccacattgatgggagttacattcttttctggggaaggggactgaatttttcatagaaacaataacgtaagagatggttacactattgatcaaggtcctaatgcccaccttttaaagaaacatgatcaaaccccatatttaactacaagttatatatcaagcaatatagagctctctaaaatacatgtactttcattaaaaaaagaaaaataataatgaagcatatgtaaatataatttgatatatatatcataattcattgttcaaagttattatatcaaaagcagaatgatcatcttcattaaaaacacggaattcataaggctgggttcgttggctcaagcctggaatcccagcacttcaagaggctgaggtgggaggattgcttgagcccaggagtttgaggccagccctgacaacacagcaagatcccatctctacaaagaattcaaaagctggatatggtggtgtgtgcctatagtcccagctacttaggaggctgaggcaggaggattgtttaaacctgagaggtcgaggctgcagtgagctataattgtgctgttgcactccaacctgggcaacagagcaacaccctgtctcaaaaaaaaaaaaaagaaaaaaaaagtcatagaattcagataagagactttccactgacatctctgaaaatacctatggaggaaactacaggttacttgcccttttgaaacatctattaagaaatgttggtagggagagtgttagaaagtagcagggcatggagatacacctgtggtgtccaggagggcagcatggagccacccaacctctgcagatctatctcccctgccaagattgtctggagtcaggagagacttcttgttgcaaggaaaagataagcagaagatccccaccggtccccactggcattgcaaacacctacagtccttacaacaggagaatcccacagtccttacaagtcctgggcccagtttggagagccactggaattcacacagccacattgccctgaattcggagcacaaagtatgcacttcccatctctcccatcccttgtgagccaagctgctgcagcaaggcacaatcttgagacctcagccacctctggattgcatcctgctctgggggccagtaagtactgcaccttccagcactggagctccattttccttacaccaagcttatgtgggtggctgtagccacaaccccagttgcatgggcccaagatcagctgtgactctggtcctgtacagcagggaaaccaacccctgccattgcacttccagccagaggaacaatctgccagttctgcctggggaaaacccacccttgagccagccaaatggttgcatgccctcctctaaataggagaggcccctgagccttcaagcagttgatatgcccctgcaccagcaaagtggctatgcatccacactcaggacctgagaaacagctccataatagcatcccccctttgcaggcatgtccctggcctgcctagtggccctgtaccacccccacccccaaaaaagggcctgagaaacccacaggacattcctggcaggtatgcccttatgccagctgagcagctttgcacctgggtcccaaacctaagaaacaacgctgtggaccaccctcagcagatattctcccaggctggctgagcagctgtctgtccacgtcccagcctgagatatagccctgtgggccacctctggcaggcatgccaccacaccagttgagcagtcttgcacctgcatcctgggcctaataagcagctgcatgggctgcccctggcagacacatcaccaggctggctgagcagctataagcccatgtcctgagatgaagaaagagccccatgggccatccccagcagacatgccccccagccaagcaggcaaccatgcagctgtgtcacaagcataagaaacagacctgtaggtagtccccagcaaacacaacctgagtccagccaagtggacttctgtccgcatcctgtcctgagtctgaaaagcagccccacagaccactcctgacaggcacactaggttggccaaacatctgcatgctcatgctcctggccaaaataacagccctgggctcccaaacccagcaagctagacccaaatttggtcaatccatcatttacatttatatcctccaaccttagaaagagcccagcaagcccagcctagcaaagctgcaccactgtcaccacaaactctttcagcctaggtcactgagaaatcacaaatgccactagtgtggattacaggtgaagaaactacacagagactacactaatgcatccacctagaacccaggcaaatgcaccccactgaaccgacatcacaagacacattcatataagtctttctctacaaagcctacttcataaaattggaagaggcaacttttccaccagatgcatagaaatcaatgtagaaacacaaccataaaaaaatcagaaaatatgttacctcccaagaaagatagtaattatccagtaacagaatccaatcataaggaaatatatgaaatgccagaaaaacaattcgaaataataatcttaaggaaaatcagtgagataatctgatgaaatcaggaaaataattgaagatttgaatgagaaattcaacaaagagatggatatcatttaaaaagaactaaaaggaaatcaattaatgcaataaaaattagcagaaaacttcctaagtcttaggggagagatggacattcaggtctagaaagctcaaagaaccccaaatagattaaacccaaacaggtcctcactaaggcacattataatcaaattgtcaaaagtcaaagacaaagaaagaattttgaaagcatcaagagaaaagcaccaagttacatataagggaatctctattagactaacaggagatttctcaaaaggaatcttacaggccaggaaagaatagaatttaaactattgaaagaaagaagggaaaaactctgtcagccaagaatactatacccagcaaagctaaccttcagaaatgaagaagaaataaaatatttcacagacaagcaaaaagtaaaggaattcatcaccactaaactggccttacaagaaatgctcaagggattcttacatctggaaatgaaaagatgaaaaacaccatatatatatatatatatatatatatatatatatatatatatatatatatatataaagactctaccaaaaaacttagaactgataaacaaatttagtaaagttacaggatacaaaattaatatacaaaaatgagtagcatttctacacacaagcaacaaactagctgaaaagaaatcaagaaagcaaatccgatttacaatagctactaaaaaaaaataggaataaatttaaccaaggaggtgaaagacctctacaagaaaaactacaaaacactgatgaaagagattgaagaggatacaaacaagtggaaacgcatcctatgcccatggatcagaagaattaatattgttaaaatgacaatattatccaaagaataccaatgaaattcttcacataaatagaaaaaaaatcctaaactttgtatggaacaatgaaaggccctaaatagccaaagcagtcccgaccaaaaatgacaaagctgggggtatcacactactagacctcaaaatatactacaaagctgtagtaacccaaacagcatggtattagcataaaaacagacacatagaccaacggaacaaatagagaacccagaaattaatccacataggtacagccaattgattttcagcaaaggtaccaagaacatctttgggaaaaggatactctcttgaatagatggtgctgggaaaactggatatccaaatgcagaagaataagactagaccccccaccgctcatcctatacaaaaatcaactcaaaatggatcaaagacctaaatgtaagacctgaaatgataaaattactagaagaaaacataaggaaaatgcctcagaacattggtctgggaaaatattttatgaataagacctcaaaagcacagggaacagaagcaaaaataaacaaatagtattatatcaaatgaaaatgtttctgcatagcaagggaagcaaataaaacaaatagtgaaaaaacctacaggatgggagaaaatatttgcaaactattcacctgacaggggattaatatccagaatatacaaggaactcaattcaacagcagaaaaacaatctgattagaaaatgggcaaatgatatgaacagacatttctcaaaagaagaaatataaattgccaacaaatatatggaaaactgcccaacatcactaatcatcagggaaatacaaatcaaaaccacaatgaggtatcatcttatcccagttagaatggctattttcaaaaagacaaacaacaaatgctggcaaggatgaggagaaaaggaaactcatatactcttggtgggaatataaactagtatagcaactatgaaaaccaatatagaggttcttccaaaactaaaaataaaacagccatatgatccagcaattctactactggaaatttatccaaaggaaaaaaggaaatcatcgaagagacgtctgtatccccatgtctactgcagcactatttacaatagccaagaaatgggatcaatgtaggtatccaacagaagatgaatggataaataaaatgttgtatagatacacaatggaatactattcagccataaaaaagaatgaatcctgccatttgcggcaacacggatagaactggaggacattatattaagtgagataagccaggaacagaaagttagacatggtgtgttctcattcatatgtgaaagctaaaaaatattgatctcaaagaagtaaaaaagtagaacagagcatactagaggctgggaagggtaggaagaagggtgggatagggacagatttctaaaggatacaaaattacagctagataagaagaagaagttctactgttctataccatggtaggatgactatagttaacaataatatattatatagtttcaaataggtagaagaggatattgaatgtttcaaacataaagaaatgataaatgtttgcaatgatggatatgctaattgcccagatctgatcaccatatattaattatatcaaaacatcaccatgtactccatgaatatgcacaactattatttgtaaattttttaaaattaaattaaatttaaaaaatgtttacaacttgctaaggagtcctgtattacctatgagtgtcccattggctcagactttaagggactcacaaagaagggcatgagttctagactgcctttgcactgaccagatgtatctcaagagctttgctcacatggccccaatgatgcaaagaaaggaatactgggtgagtcctatggtgtcatgtgcccctaggctttaaaactgaagttttatctcatttttatttacttcttttcctcactgcaaatgttcccgtcacagcataaagtaggtgactaaacaaagagggcttctggcatagcccactcaccagtaccagaggcactactttcatcctgacttttggccaggcagatgtgtctttaaaatagaagggacttgcattattttgtgcatcctttgatcttctacctacggtgcttcacagtgtgaaaagccttaaggctttcctttaaagaacgccttgctcatatgttcagtgttcgctttggtccagcctcccacaaatcctaaaataaagcccccatctgagccacatatgctgtgttttctttcaggcagtagcaggacactgcttttccctttatcagccatattagagtccaaccttatagtcacttttaaaaaaattcctttaatgttatgggatttatttccttaacaaaacagcaggccctacatacttcgatatgtctttcaaagtaatctaagaagctattccctcaagtcaatgatggggtcatagttcaaagcaggtttagcaccatgggggaaattatcagtattatttttttgaaatcacagaccacacttcctgttattaattcatgcctccccaggtccaccacccaccaaccttctcactttctttgtttcactggtattggttttggccctgccagcctcctctgcactgagagttaactgacaccctcaccccaggctgatgttagctgaggacccctgaagtactgtagtagttagaccctaaggagggggtcaagggtagcagcgggaaaccaccttcctcactgctaaagctgcagaaagcaatggaaacaccctaagccccaaattacacatatgaaatcccaaacgatcacccacattttggaatattatttagaatatttactattgtacagctgcccaaagaaggcactgtctttgttaaacaggctcactctacacctattatcacacaggatttctcaccaaacagagtgcaggtgaccaggttatggatagtgttctggcagctgctcagtcccacagaactagctatggttatgggtccaggtaacacaaagttccacctgtgttccatccccaacaatgcctgcttgccaaggaaccatggagtcaaaggagaaatcaaaaccagagttagtcagagcagcatcctggagcagcaggaggagaaagttttcagccagcttggaaggatggagtaccacagcgtgcagtgtgaacagtttctagcagcagccagggcaacccgcaggcccttaatcttgtttcctggctagttccaatgatgatttccaccaccttcgccagttcaagaattctgaccagctaagccaaaatcaacagacaatgctacagcatactgccttcactcttacctgcttgggcagctggccaggtgccatctcaccttgggggcagcagtctcttctgggcacctagaaagacacacagctcccctctctgcagcctccccagggtggactgaggaggaatggtcaacagcataatgtaaactctgttcactcaccaccgtcttctctgttgtttgttgtggcaactgggccagtgggacaggaaaggcgtcctgaagctctcggctgggaagctcctgaagttgctctgaactgcagcagaggcagccgggagccacctgggtgggtgggaaggaggaaaggaaagccaaatcagagacagacacgcaaaagggatgtgggagcggctgggaggagtacatcactctgggacaggctatgtagaaatagggaagcatcccaacagtgacgatgggtggcttttattaccgtgtgggggggttatacgtttagagttcaggaacaatagttacaaggagaaccagaacgaggtactttcttcccccacagaggacagacgcagaaccatgacggtggtactcagggtagattgcagggtctagggagaggccctggcaggggtgagggaggaaggccatgggagctgccttcctgcaggtgaaaggcagtgcaggtaggtggctgttggggcattctggagggagctggctcctggctatcagggatctggcttcggtgacatggccaggggaataaagggctgacagggcaggaaaagaaacaccaacacactgggaaagcactgtgcttctagaggagtgtctctcctaccttcactgtcccagggctgggctgatatgctctgttcccccagcaccacaccaaggtggaacacgggacccccgactcagcctggcccaggctcctgaagttcccccttctcctcccttcagacacttttgttttcctctgagggaaaatctcacttcttaagagggaaataaatacctacagtaagtagcaattccatttcctcagagggacaaataacttatttcagagccctccataagctacccatccagatggtgtgttaatttgaaaaggatagtttgaaaatccaaaggaaatcaagccctcacaatggcatttgctgtttttgaatgttttctgttccctcccaaaatttatgttgaatcttaatccctgatgcaacagtgttaagaggtaggacctttaggaggtgattaagtcaagagggcagagccctggagaataggatcagcaaccttataaaggggctggagcgaactggtgaggcccttttttgctcttctgtcttctgccaagtgaggacaaagcaacttggcaccatcttggaagcagaaaacagctctcacaagacaccaaatctgctggtgtcttgatcttggacttccattttccagaactgtgaggaaaaaaaattctactatttgtaaatcacccagcctcaggtattttgtcatagcagcacagatagactaagacagcatttcagcaggggacttccacactgaaaacgtccttacacaatcccttaataaatcacaaaggagagagagagggtggaaaccctgagtttagggttgtggcttcccctgacactttgagggacactttgaaaaggaaacgggagagacggggctctcaaagaaggggcaggatgaggtggaattcccaccccattacagtcccacagccaggtgctcttttccacctggacaggaagtgtcagcagaaagttcatttcaggaatgccagccttgtctgcacccagttgctccctgtaatctgtttggccacaggaccaaatgagagctcaagcagaacaggtgtttctataaggaatggtttccacatgtctcataagctaatccaggcaatcccagcaggacatctcttgaccttgaagagaaaggtcaagctcaggacatctgctgccacccccctcaatgtatatccatctctggtgaaggtttagggatacctattgcttcttagttccttaaccttgaccccacctccagtgagcacacctggcccttcattctcagcagcccccttctgctttctaccagccagaggagcctccaaacctgctgctctccctatcctcagttccctaccctgccccatgcacacgggaggcccctgggtgctctgtcatttccattcttttgcccagctgattaggccacatctggctattatttcacaactcacatgcaccacagacatttaatactctcctgcttctcaaataattagaagccactcacaagaaaacaaaaaataaagctgttaattatgtaaaaattaaaactatataaaagctgataatatgggtgaaatgattttctaagctaatttttcaaccctatcaggcattacatctatccccgagttccctgacactcatggcaaaaaaggaaacaggagaggtcacacaattctccttgtcaaatgaggacacgaagccacttcatcaggtaacagggccctccagtgctaatctccaaaaggtctctctccagagagaggactgaacaacactggaaaattgtccactgaacaatggacaattctaccaatagggttttcaaaaggaaacatttggcatttcattactgttttttgtttgtttgtttgtttgttttttgtttcttggagacagatcttgctctgtcgcccaggctggggtgtgcagtggtgcaatctcagctcactgcaacctctgcctcccatgttcaagtgattcttgtgcctcagtctcccaagtagttgggactacaggtgcacgccaccatgtcctgctaatttttgtatttttagtagagatggggtttcaccatgttggctaggctggtcttgaactcctgacctcaagcaatccacatgcctcggcctcccaaagtgctgggattacaggcgtgagctactgcgcccagcctcagagtttggtaactttttaatatcaacatttgataaaaaggaaaataataaaatatgtcttgggatttttgcagggatctaaagcaaaggtctggacaggtaatttaataaaggtcttggtggttctcagtggaaagttgagttgccctcatcacccatcctggaggtgggggtgcaggtgggtaaaggtggtgcaggcaggttgcacggggttaagggttagggggattgagggagcattgggatgcgcagtgggattattgactgtcacaacgacttgagaacaagggaaaggagctgaatgtcctacattaaatagaatgctcattataaagagcattataaagcattttgtcttgcctaaaatgctaatagcaccactggagagaaacactggaagggaaatgagtaattagcatgactcttctagtgcctgctctaaaataccaattaagtctttacagggagttgatggcagtgaccacaagaatgtctgctccgggaagtagagatgaaggaggatgccaggtttctgatgtgtcagctctgctggtggtaaaatgcatattgtcttatgaggcataacgagcctgaagggtattgttggctggacagagagctgggcaatggtgcactataagcatgcccatggaaaggaacatagctctccttttatttctttatatgtctaaatgaagacacaactggaacacaaaaactacacatcaatccatcataggagaaactattttaggatagagcagtgtttctcaaagtgtggtccctaattagcatcacctgggaacttgttagaaatgcagattattgggtcctaccccagacctgctgaatcagaaactctgggtgtggggctgagaaacctgcgtattgacaagtcctccaggtgactctgatgcaggctcaaggttgagaaccactggtctagaaagcctgaggttcaatatggcaatcagtcacaagagagattttagaaatcctgcttcatccctgtgtagagtttctattaggctcagagacggaggggaatatttgaatatgtctgtggcaggcaactgatcaggggtggaagacctgaagacagaagaccccagggatgagaaataaggacaaagagtaaattatcaagggccaatctgagcctcaagtttaattaaccatcctaggaagattttgttttaatttaacttgtattcctgtttgaatagcaaatacagttatatggtttgaaattgtttgggggctcagaaaacaataccccaaaatgaagacttcagaagcagcctcagaagcaaaagtttctctctgaccttcttcttccctcctgtctctggccactcattctcctccaaggacaccagaatccctcttccccaaggcaggttatagaaaccagaatcccttttccttaaagccagccaggaaacctaaaaatattattctaacttctccccctggcctttctgtgtaaaaactggccataaagaaattatctgacctaccttgtttgactgtaggtcataagagccccattccagagagagtcttgccccatcagaaggaagaaatgctgcacagagaggaggaatacaaacagaaaggccttgctgagtttccctactcagtctattagcattagattataccctttttgcccaatcatatttttacacagttgtccacagtttattgaacctaagcataaaaatgaacgtttcctttgtatctttgggtcttcattcgaaggctcccatgtcatggaaaactatgatcaaataaatttatgtgcctcttctactattaatccaccttttgtcatttgatgtttagtgaaccttcagagggcaaaggagaagttttcccttgccccttcaactgaaaagatacaaaagtatatagtgaaatgtctttcacccacacctgcttctaggtacccagctcctaggtatccagcaccaacttctcttccagaatcagccatgtaatcacatcttctagagatatgttttgaaaatacatgtatatttttatacccactttttcttaaatacaaataataacatattatacacactcttctacaccttgctttattttgcttaatatattttgggggttatgccataccagaaacatcaagaaacacttagaagtgttctgagtgtctggaaacatacaacactccagggcatgggtatctttcctgcagctaaggagcacctggtaggctaccacatgatgtttgtggatttcttagtgaacctcctgtaggaaagctgtactaaaattctcagtttggagaactctccacaggcctacttgtattttgttttataacagaaggaggtaatatggaaactctcagccaggtcattaaaattcaacagtatcactaccagataacactagtacctggtgggtcaggcgtccaaggacacatagtagagaggagtttgaccactaggtagaactcaaagcatcaggatgacttggaacttttaaaatttataagactaataactataaattacaaaacacatggaaacataaagacatggactaattaagaacacttcctacttaatagagtcattttccaacacttagaatcaagtatgtaacacgggacaaaataataattcctatccttccaccagcttcagttatagtaacatttctttttatttttttgagacggagtttcgctcttgttgcccaggctggagtgcaatggtgcagctcactgcaacctccacctcctgggttcaagcaattctcctgcctcagcctcctgagtagctgggttacaggcatgcaccaccatgcctggctaattttgcacttttagtagacacagggttttaccatgttggtcaggctggtctcaaactcctgacctcaggtgatccacccccttggcctcccaaagtgctgggattacaggtatgagccactgtgcccagcctgtaacatttccttcagaattatttttgttctatacacccttcagcaccatcagtaagatgtcttgctccttcctgattctaaccagagttttatcaatgtagcctttgaacataaaagatgaagttgtatatattatatatacatattatatataattatatattatatatattacatataatatataattatataatacatattttatatatatatgctctattgagatataattcatataccatacaatttaaagtcttcaaatcaatgctttttaagtatagtcaaagagttgtgcactgatcacctcaatgaatttagtgcacttgcatcacctgtaaaagaaatgccatacctattcacagtcactccccatatcctaccctaaggtttcccaaccctaggcaaccaatagtctactttctgtttctatggattaaggatggcttcaacaggctcacaagcacactcaacacaactggggaaacaaaatcagtgattttgaagatgagtcaacagaaattatccaaactaaaacacaaagaaataaaagagtagggggaaaaaaagaaaacaaagaatctaaaagctatggaataatatcaaatggtctaatatgcatataattggaatctcagaaagagaagaaatagaggatgagtcagaagaaatacttacataataattaagcattttccaaaaataatgaaggacatcaaaccacaaatccaaaaatctcagagtacttcaagcagtataaatacaaacaaaaacaaccaaacacacctaggcatataatcttcaagtggctgaaaatcaaagggaaagaaacaatcttaaaggcagacagggtgagggaatacatgaaagcatacttctcatctgaaaaagtgcaaacccagaaaacaacaaaggaaatcttaaaggtactgaaagaaagaaccctgtcaatctggaattccatactcctgaaaatatttctcaaaaataaaagaaaaatacagactttggaaactaaatgaaaagctgagagaattaattattaacaaacttgcataatgagaactagaaagaaacttcttcaggcagaagggatatgtcagacagaatttgaatccaaacaaataaactaagatctccagaaatggttaaaatgaaggtaaatatataagacattttttaaaatgtttaattgctctaaaagatgattgactttttaaagtaaaaatagtagtaatgtactatgggtttatagggtatgtaaaagaaaaatgcataacaacaacagcacaagagttgagaagaaagaacttggagtataatattctaaggtttttataccatacgtgaagtgatataattggaaggtagactgtgatgaaagatatatgttgtaaacactagagcacacactacatttttaaaaagaagtataatgataagccaatagtggagataaaatgaaataataaaaattctcagctggatgtggtggctcatgtctgtaatcccagcactttgggaggctgaggcaggcagatcaactgaggtcaggagtttgagaccagcctggccaacatggtgaaaccccatctctactaaaaatacaaaaattagtcaggcatggcggcacgtgcctgtagtcccagctacttgggaggctgaggcaggagaattgcctgaacttgggaggtggaggtggcagtgagcaagactgtgccactgcactccagcctgggcaacagagcgagactccaccttaaacaaaacaaaacaaacaaacaaatctcaataaatacaaaggcaagcagaaaaagaggataaaagggacaagaaaaagatgaaacaaaaaatatttatggtagttttaatccaatcatatcaataattgcattaattataaatggcctaactacatgaattaaagattgttagactgtataaaaaagtaagacccagttatatgctatccacaaaaaaagctcaccttgaatataaagacagaaatgggttaaaaataaaacaatgggaaaagatataaatgtaagcactaatcaaaagaaaactgaaatggctatattaatatcaaacaaagcagatttcaggaaaaggaatattaccagggataaagagagtaatttcataatgataaaaggatcaattcactaaggaaatgtaacactcctaaatgtgtacacatctaacacagggttccaaaatacattatccaaaaagtcttaggcctgaaaggagaactaggaaaatccgcaattgtagttagagatttcaacactcctctctcagtaattgataaaacaagtacacagaaaataagtaagaatttagaaaggtgaacaccactatcaaccaacttgactgaattgacacttgacccaacaaatgcaaaatatacattgttttcaaatgcatatgaaagatttatcaagatagaccatattctgggctactaaacaaacctgaatcaaattaaaagaagtgagaccacatagaaatattctctgatcgttatgaaattaaactaaaacttagtaacaggaaggtatctaacaaattcctaaaatgcttgcagattaaacaacacatttccaaataactcacagttcaaaaaataagtcacaatgaatattagaaaatatttcaaatggaatggacataaaaaggcacaatatgtcaaatttggggggatgcaggaaaaggtcagaagaaaatgtgtagcattaagtgcttatattagtaaagaaggaaagtattaactcagtgatctaagcttccactttaggataaactagaaaaagaacaaattaaaaccaaatttctcagaaagaaggaaataataaagataaaagcagaaatcagtaacaatgaaaagaaaatcaatgaagccaaaagtttggtttttggaaagatcaataaaattggtaagcctgtaggcaggctgatcaggaaaaaaagaaagatggtacaaaaataaatctcaggaataaaatagagaacatcactacaaatcctacagacattatatatatatatatatatatatgaatccatatatatagaacaagtctctctctctatatatatataaacaaatctatgtcataatataaaaacttgacaacttagataaaatacaaaaattcactgaaagacacaaactaccaaaattcccacaagaagaaatagagaacctcaattaaagaaattttatgagagcaacattacttgatatgaaaataagataaagacattataaaaaaaaccatggaacaatattcttcataaatataaacacaaaaatcctcaacaaaataatggcaaatcaaattcagcaatatattttgaaaaaaatatattattattctgtgtggtttatcctgaaaatgtaaggctggttcaacaactgaaaatcagtgtaatttacagtatcaacttagtgacaaagaaaaaaactacataatcattttatttagatatttaaaaatcagacaaaattccgttttcattcatggttctgggcaactgctttagtctgaatgcaaaaaactggaattccttgttttaaaaaggcaaaagtttcttggggatccagaagtcctcttatgagacaggtctcaggtaatgttagaagatggagtacgaagaaacagatacatggtggagacttcaaacatataatgaaattatattcatgatatgctgttccagaaagagcttgttacatataggcagatttctattgaataaaagaggagcttcttactaccggacctctggacaaaggcagcagcttcatatttcaggtggtagattcttaaaaccacaagtgttcaaaaggtcctggacaactatctgtgaaggatgctatgaaaggtctcctatcttagatgggagtatagacttgatgaattaaaagttcttcctagtgctataaaatagtagagacagaaaatccagttggcctaactaatgtttattaagagcttggtaaggaaatatgagattaatctatattttaaaagtcatattgcctatctttacatagtttacactaataatttagtagagatgtatatttctatggaataccttgtaaaaatatttttctgtatatccctttctccctgcttctcactctaaagaagctgataagtgatagcttagtccttgcctcattaataccttcaaccactcattttctgtcagttcctttttttccgtcttcagacatcctctcttaaaaataccaacaatgagacctactcccttttctagctaccatcatatttctagcctttctttccactcatatgttttcaatgagtcatcaacatctcctgccacaatttcctttccacccactccctctttaaccccctacaatcaatccagttcttttatacaccacctacaaggtcagaatgctagggtttagagagtctgagagtgtcaggaagatataacatttgtacccaaggagctaatcagaaaaaatctacttaaatcatccaaatatccactaggaagagactagagacaggggttaaaaaagagaactaacatttattaggtatcttctggtatactgttgtggtagattatctcccatcatggccatcagcaattcatccatccaggtatactcatgtctctccaactctaactttatcagaaatcacaataaatataaatggaccaaattcacccattaaaagacagataaaatattattatacaatattatatacaatatctatctatatctgtagctatatattccacctatatactattcataagatgaacctagaaaacacaaaggcattgaaaataataaatgaaaaaataagttaggcaaaaactaaccataaaagagttggaataagtaaattaatatcagacaaaagactttaatataattaatcagaaagagaatcactatataataataacagaagtgagataaagaggtagagaatacccctggcatcatcagttttagaaatgggggtctagtaactatctccaatatcacagctcagaatcaggccaattctgctcaatttaatccaatctcacaattatttgtgtgaaaactcccaaatttgtcaccatgggcaaaaaagcttaatctaatagacatatatagaaccctatgcctgataattacaaaatatgcattactcttttcaaacacatagaaaatattttcaaaaattaaactgcaaaaggctataatgcaagtctcaacaaattccaaagaatcatatagtcaataacaaaaaacaagatcaacttgtctgttcatttcctctgccaatatcttatctctctgaaactgccttattcatttgtacttctcttttgacattgttcatagacattgtgtccatttatgcaacacatttgtattaaatacttacataccagtcagtgttctaagcataggggatacattaatgaacaaagcaaaatagacaaagatctctcctttgaggtgcttacatttctagcgtcacttctatcactagactgcaagtgccctaaggcaagactatgtctaatccagatttggctagctcccaatgtgctgctgggacggacaccatgtcggatctgacaaggtacagaacccacacactctgatatttaagacagagggcttgctgaggcttaaggtatgatcttcggatagtgtggaatacagcttatcaggcagggacctagaaccagaaggagtaacagactcaacacacccctcacaactcccgtatcagtaattcaatagctcaagtctcagcagtccatgggtcaaagcaaactgaagtctaaaccatgttgtcaaagcaaagatgccgaagaccagatgtcaaaaatactggaaacaatgaaatcagacagattaggagaaataatcatatattttaatatgtccttgcaaattggggcacagtttaaagaggccagataagccaagtgactagtgaccacatctcacaggtctgtctggttgtaagggccctttcatccttcctctatgagataagaatgaacatccaggtctaagagcatccaagctagggagcaggacaaggagactatatatgtagcttgcttcaaacagattcatgttctaataggaataaaggtaaggtggctggctttacagaaaactctgctacattccagaatggcaagttaacaggcagcataaccaagaaaagggcctgaaaaagagagatgcctccaacttctgacacaggtttaaaagaagactggttccttctgcagagacacatccctttccaaaggccgtatcagtccagagagaaagaccaaaacaaaagccccacagcaagaaacaggaaggaaggggaactattcaaattccctgcccctctcctccatagcacacaatagctgggacctctactggggcatcatagctccaaaggaatccttctgacatggtgttttctgttttttaagcctctgtttgagcactgtcactatggcaacaaggctgggatgcttctgctctaagtgagagggcttatcccttcaaatatgcttcttgagtcagcaacaaaggaactcactgaacctcaactaatctcatattctccttggagacctctcttaaaaggcattttccctccttgctcccacaaatcttctaggtttatgctctgtgttcagccaacaaccacattcacataatgattgagtttactctcacacacctatctcgaccaagctctgaggtgtcctctttagtcacataagcctctcccatacctattaaacagagacaaagcaaggaccttggtttgggggaggcctcccaggaaggctagtggacatgggcccccaagctaggatggaacagaggaatgaggggtaggaggagcaggaagccaacttgtataactttcttttccagagggaggaatccatggtggcatgtagccctggcaggcctgatcctcaccacctggatctgtcctcaacctgtcctaggctagctgctctgtcttggctcaggttccacatcattcccagccacagctctttcaagagtaaaagttggctctggggaatacatcctccctgccttcagaggggtcttccttagtcatgagttcttagaatcctaaaatataggcctacctcttattagttttattaccttagggaagtcacttaacctttctaagcctgttaactcatcttaagacaggagcaattgaccactccatcgggttgtgataaagacggaggggcaggcatacattctacaactcttagttctgtctgcacccagcccactcttccctcagaagcagacagtgtctaatcttaggaaggtctgtaagcacagagaaaaaaagatgcaccaacctcaccttgataactccagctccagtgtgtgtcaccatttctgggtaatatataactcttctcctcagttgtttttttttttttttttttttttttaaagacaggatcttgctatgttgcccaagctagcatgcagtggctattcacaggtacaatcatagtgcactgtagccttgaactcctggcctcaagcaatcctcctgcctcagccacctcagtagctggcactgcaggcatgagccacagtgcctgacctctccactagttttcaaagcaaacaaacaaataagagagggtattcagtctcttttgcctttattgtaagagacaatgaggtgacagcaaagataattctaggaagcaaacttctgggttctagtcctttttgctcactgagttcctcagcctatcctccagaggactgacctccctgtggaaaggggctgcacagggcactctgttagggtccattccaactctaagatctctgggtcttaggtgagtaccaaatgacccatgaaattggaataaagaagactttgcagagagactggtaccctctaggagtgtcctaaaacagggcagatgagacatgcaggacacaaagactagaagcatcatttatacccaggaaatatttaccgcaaggacatgtcaggagtccatccacctcagggacagagttcaaagttgacaatgctggggaaatagacatgagcaccttttgggttttcgttttgttttgttttgtttttttgagacaaggtctcactctgttgctcaggttggagtgcagtggtgcagtcacagctcactgcagcctcaaactcctgggctcaagcaatccatctgccgtagcctcccaagtagccaggactacaagtacacaccaccatgcccagctatatttttttattttttagagacagggtcttgctctgtagcgcaggctggagtacaatggcaatcatagctaactgcaggctcagattcctggactcaagcaatccacccatctcagcctcccaaatagctaggactacagctacacacttctatgcccagctaattcaagccattaaaaaattccaccacctccccactgtttaaaataaatgttttatttgggaataacattatattcttagaaaaatttcagacatgatacagagtccctggtactcttcactctgtttcccctaatgttaatctattacatcaccatggtacatttttcaaaactaagaaaccagactttatttggatttcaccagttttttaactgatgttatttttatgttccaggatctaatccaagatacctcattgcatttaggataaagcactttttaatggtgaaagatttctatcatagcgacaaaacggattcttgattaaaagaacatcagatacatttgtgtctctttgggaaccctttcttcccatttccatgtctgttcctcccgtaagaaccattataaactcattgttttatcattcccagacatgtttgtgtgaatgcacagaaagacagtataagcacaaacactgtatatatagtgttgttttccaggctttaaaacgcatataaacactattcttttcatatcctcctgtaacttgcttctttcattcaatgttgtttttgagattgatctcttaagaaatataactatagttcttttactgctatatatagtatgcataatatttcattcattttcctactggtggaaatttggactgtttcccattttttgctgcaatgaacactttaatattaaacgtctactcaggtacacaagaaagattctccatctaggaccgaaattcctgggtgtaaagggtataaccaaattgtttcctaaagctgtagtaccgtccttccagcagcgtaggagactgtcattccatatgctcatccatactaagaagtacatttaacttatgaattaatttgtggagaactggcacctttataatgaatcttccagtttatcaatatagcccttttctccatttattaaggatctcttttttttttcctttcaacaactgtaattttcttcataaatattcttgtgtactttttggttaggtgtactcctgggtatattatggcttttgttactgctgaaaatgggatcctttatctattaatttttctaattggttattcctggtaaatagtactttaatatgttgatactgtatttatggaacttggaattcttacagtatacagttggttctctatatccatgggttctgcacccacggcttcaaccaactgcaaatccaaaatatattttttaaaaatctaataaaaataacaacacaacaataaaaataatacaaataaaaaatacagtataacaactatttacatagcctttacatagtattgggtattacatataatctaaagatgatttacagtatacagcaggatacatgtagactatatgcaaatactataccattttatataagggacttgagcatccacagattttgacacccaagggaggtcctggaaccaatctcccatggatagtgagggatgactgtatcttccacttaaaaatcccaagaaaatcttattggtatgcaagtaagaacattttaatctttatcttcaatattcacatttttcttgtcctattgcattggctagaacctcctgtacaatgctgaatatagcaataaagggcattcttgtcttttttatgactttattgaaagcgagcctgatgttactgtgtattgttaaggattgttttttgctgtactattttgatagatgttctttaccaagttaaggaagttctcttctattcttagttttctgagaagtttgcctcaattgtgaatgagtgctaaattctgactaatgttttttctgtatgtaatagattataggcattattaatctgttaatattctttatgacattaatatattttctaatgttgaatcatccttctattcctttcacaaactctacttaatcagaatgtaaatatttgaaatagatttgtaaatatttcataagcatttatatttataaataaaactggcccacaattttcctttcttgtgttcttcttgtcttatttggatatttaagttatactatcattattttaaaaagacagcttttccccagtttctatcctcttagacagtttgcacaatattaggattatttacttcttggagttctacatgcaaaaaaccatttaagccttatatttttgggagaagaagtctcttaactatcagtttaaattctttataattgttattttactgcagttttctatatcttttgaagtagttatggcaaattatatttgcccagaaagttacccatgtgtcctcctaatccaaattttaacataaaaattttcagagtataggtttttgatgtttattatcaatttcatatcaggagttatatttccatttcattcaaaatattatttgtgggtcttattttgaaaaaaaaaaagccttactagggttttatctatatcacttttttaatcctccaaatgacattctatttcatttgtcttcctttgtttccttccttctacttttccaaaggtttctttaggattttttttctagcttcttgagtaggatatatatagtagacaacaataattgcttacacaatatttataatattctcccttgttccgtactaacatacccttatttggtttgggaaggcaatacaccatgctaaaataaaaaaaaacactatacttccctggctcccttgcagctaggaactgccaaatgacacagttctaaccaatgacatataagtgaaagttattacatagggcttccaagaaagctctctaattaaaggtagccaactcacttggcacatgcctttttcaaaacctgtcctttctccatcatgcttggaatgtgaatgctaaactggaagtaaagcagccattttgcaaccatgaggcagcaagcatgagtatgaaaattatgtttagatgactggatgttaaaagagcccaggaccctgatggcataatggagaatccatatttgccttggactacctcgaaacttcttgttatatggcaaatgttaaacccctaggtcattaaagccatggtcatttagattatcttttaaatatagccaaataaaatttatagtaatacctattcaacatgttatccttttctttttggtaggaattgagggcagatggggtctcgctctgttgcccaacctggagttcagtggcatgatcacagcacactgtagcctcagcctcccagactcaagatatcctcccacctcagcctactgagtagctgggactacaggcccgcgtcactacacccggataatttttgtattttttgtggaggcagggtgtcgccatgttgctcaggctggtctcaaatttctgagctcaagtgatccacaccttggcctcctaaagtgcttggattatagctatgatccaccatgcctgacctcaacttatttttcatatgttaaatgtttcataaatgcatttaaggccataaattttcctcaaagaatagctttagttgcatgtagttaagagatcagttgtgctggtccagatcagaaatactacctagccaacccaaagaattgtgatataaataaaaatagctatggtttaagtctctaaattttggggtggtttattatatagtaaaagctaactgatacagcagttgctttcaaatgtggggtggtgccataagaaaaattataacatgtggtactggctttgaaataatggcttttctagtggtgagaaaagcagtaagaaaacagtttgccggagaaatggagaagaaactgctatagcaggctggcaaaatgatggctcgtgttgggttgagacagaacaactggtgaaactaaagcttgcagtaacttaagagattttctttttttttctgagtacatttattcatttttttttattatactttaagttctagggtacatgtgcacaacgtgcaggttcgttacatatgtatacatgtgccctgttggtgtgctgcacccattaactcatcatttacattaggtatatctcctaatgctatccctctcccctccccacaccctacaacagggcccagtgtgtgatgttccccttcctgtgtccaagtgttctcattgttcaattcccacctatgagcgagaatatgcggtgtttggttttttgtccttgcgatagtttgctgagaaggatggtttcccgcttcatccatgtccctacaaaggacataaactcatccttttttatggctgcatagtattccatggtgtatatgtgccacattttcttaatccagtctatcattgttggacatttgggttggttccaagtctttgctattgtgaatagtgttgcagtaaacatatgtgtgcatgtgtctttatagcagcatgatttatcatcctttgggtatataccgagtaatgggatggctgggtgaaatagtatttctaattctagatccttgagtaattgccacactgtcttccacaatggttgaactagtttacaatcccaccaacagtgtaaaagtgttcctatttctccacatcctctctagcacctgttgtttcttgactttttaatgatcgccattctaactggtgtgagatggtatctcattgcggttttgatttgcatttctctgatggccagtgatgatgagcattttttcatttgtcttttggctgcataaatgtcttcttttgagaagtgtctgttcatatcctttgcccactttttgatggggttgtttgtttttttcttgtaaatttgtttgagttctttgtagattctggatattagccctttgtcagatgagtaaattgcaaaaattttctcccattctgtagattgcctgttcactctgatggtagtttcttttgctgtgaagaagctctttagtttaattagatcccatttgtcaattttggcttttgttgccactgcttttggtgttttagacatgaagtccttacccaggcctatgtcctgaatggtattgcctaggttttcttctagggtttttatggttttaggtctaacatttaagtctttaatccatcttgaattaatttttgtataaggtgtaaggaggggatccagtttcagctttctacatacggctagccagttttcccaaaaccatttattgcatagggaatactttccccatttctggtttttgtcagttttgacaaagatcagatggttgtagacgtgtggtattatttctgagggctctgttttgttccattggtctatatctctgttttggtaccagtaccatgctgttttggttactgtcgccttgtagtacagtttgaagtcaggtagcgtgatgcctccagctttgttcttttggcttaggattgtcttggcaatgtgggctcttttttggttccatatgaactttaaagtagttttttccaattctgtgaagaaagtccttggtagcttgatggggatggcctgaatctataaattaccttgggcagtatggccagtttcatgatattgattcttcctacccataagcatggaaggtccttccatttgtttgtgtcctcttttatttcgttgagcagtggtttgtagttctccttgaagaggtccttcacatcccctgtaagttggattcctaggtattttattctctttgaagcaattgtgaatgggagttcactgatgatttgcctctctgtttgtctgttattgctgtataagaatgcttgtgatttttgcacattgattttgtatcctaagactttgctaaagttgcttatcagcttaaggagattttgggctgagacgatggggttttctacatatacaatcatgtcatctgcaaacagggacaatttgacttcctcttttcctaattgaataccctttatttctttctcctgcctgattgccctggccagaacttccaacactatcttgaataggagtggtgagagagggcatccctgtcttgtgccagttttcaaaaggaatgcttccagtttttgcccattcagtatgatattggctgtgggtttgtcataaatagctcttattattttgagatacatccaatcaatacctaaattactgagagtttttagcatgaagggctgtagaattttgtcaaaggccttttctgcatctattgagataatcatgtggtttttgtctttggttctgttaataggctggattacgtttattgatttgcgtatgttgaaccagccttgcatctcagggatgaagcccacttgatcatggtggataagctttttgatgtgctgctggattcagtttgccagtattttattgaggatttttacatcaatgttcatcaaggatagtggtctaaaattctcttttttgttgtgtctctgccaggctttggtatcaggatgatgctggcctcataaaatgagttagggaggattccctctttttctattgattggaatggtaccagctcctccttgtacctctggtagaattcggctgtgaatccgtctggtcctggactttttttggttggtaggctattaattattgcctcaatttcagagcctgttattggtctattcagggattcaacttctgcctggtttagtcttggaagggtgtatgtgtccaggaatttatccatttcttctagattttctagtttatttgtgtagaggtgtttatagtattctctgatgatagtttgtatttctgtgggatcggtggtgatatcccctttatcattttttattgtgtctatttgattcttctctcttttcttctttattagtctcgctagcggtctatcaattttgctgatcttttcaaaaaaccagctcctgagattttcaaaaagaaaagaccctagtgaactcctagttgcagctaagtagatctccagacagaatttcgaaagtgtcatttaggagctcttaactgcatatgctaaagtatggcaagacaaaggtgagctaaagaaggaaatgttcagtttgcaaccagaatttagatggaatatagaaggtccaggatttgcggtgttggaaaataaaactgtacctcgtctccagtctccccatatttgacaacctttgagtaaaatattctcagagtaaaaggaggccttaaaagagcaaattaagagttgggttgtatgaccatttgttaaggcctctgaaggatttaagaaagtgcctagcacaccttatcttgtcaaaaaagctcctaagaatcttaagggcctgacagaagcctaatcccaagtcaccgaataactctagagagaaaaaaaaaaattgtgggtgtagtttttatacaatgagttgggctatatcctattacatagaaagcccacaatattttaaagaaaatcatcccaacaaaacaccatcagcttggactggaagggactaaaattgattaagccacaaagaggtctctgggccctcaactatggaaagaaagacagatgagagagggactcagctgcactatttcttatggaaaaggaaaggctttttaagggggagaaccaagatactagagaatggagtcaagagccttggagaacaacaaactgggaagacaccccagagagcagaagcaatggtcctagattagatgacctggcaacatttgccccaggggaattttgatttgttacagaccagtaactgctatgtgccttttgtttttctcctttttgaagagaaatgtctattccagttatcctgcccgtctcaccactatatgatggaggtgtagggagcaggtgacttgtcattttaaattctggatcaagagctgccgtacccaaggagctacagctgaggaccctctttcatatctgaatgtgataaaatcatgagatcatagacttccaacctgatgctataaataagacagagagcttaggataaggatgagcatattttgcatgcatgagaaatgaggccaaagagcagactctgatagattccaaaaacacccataaattattttacttctgtcaagatgtggagtctatttctctccccattgaatccaggcttggcaatgtgacatgctttgactaacaggacattagcacatataacataagcagaggcttaaaaagtttttggacagttaaatgcttctctcttgctgcatttggaaacctgggtctaccatgtgaataccccaaggtagcctgctggaagatgagaagcaatttggaagagaactaagacatccaaggatcagacagtcaacttccagacatgtgagtgaggctatcctagatcatctagtcgccggctgaccatagaggcatgatagagtccaatcaagatctgctgagctggcccagatttaaaaattgcccaaccaacccaaagaattggaagctaaataagataatgtttattttgggccactgagtttagtaatgtagcctaaccctctgggtacaattgatgactatagttttttcttaaaaaatctataattattatcttcctgactctgaatatggctttaacattttcccccaaaaaatctgcaccatcttgctattgttgcctagtcttcattttaatcatgtttttcaaaccatacacacttatgaattttttgcatagctaacaaataaatataaatatattttatcaatttctatgtttaccattgcctcttacattgtacatattttctcactgtttaattttttctttccaaaacatatcctttatgggaacaatagacactggtgactccaaaaggagggggaggggcaagggctgaaaaacctcctattggatacagtgtttcctatctgtgggtgatgggatcaatagaagcccaaaccttagcatctcacaatatattcttgtaatttgcacgtgtacccactgaatctaaaatagaaatgggaattaaaaagaaacaaacactcaaaatatatcctttaatagttatttcagtgagcatctttgtatttatattcttggtctttgttttgctctcattctcctgggatagtttatctaggtatagtattttagggtcaacacagaaaagttactcctctgtcttcttacctctcttgttgctgatgaaatacctgtcagtctgtcatttatttatacataacttgtatttttattttggatttttaagttgctcttttttctcttttctgaagagaaataaaaagcagtttctgcagtttcactatgtctaattgcgggttaacttttgtttagctttcaaagtattaggagacacttttgttctgagaactcatgttgttactcaattctggaaaattattaatcatttatttaaatattgcttcacttccattccctttttaaatctctttctgtagcttttattaaataatgttgaagcctgtcatttaccttccatacctttaaaccgttctttcatgtttttgacatctttatatttctgtgccgcagccaggctaaacttctccgtactattttccaatctgttaactcatgcttcaatggtaaccagtctccagtgtatcccatctattgcatcttatttcaataactatatttttcatttatatatgtttttatatatacctgatctcattgtttattattttttttaagagatgaggcctcatcctgtcacccaggctggagcatgagcctgtagttctagctactcaggaggttgaggtgggaggtttgcttaagcccaggagttggaggctacagtgagttatgattgtgctactctgctctagccttggtgatagagtgagaccctgtccttaaaaaaataaatacaagaaattaaaaaaataaaaacaaaattaaaatttttaaaaaggagaaggagatcatctgtgaatgccaaccattcctaactggtgccccagaagcatcatcactttgccaaagcctctcactccaaaagacaagcatggtaaccaaagcaaatagaccccgatcctgctttttgccaccactacctgccctagagatttgggaccttctgcttttacaccaaagctttcactgatcaagccacctagagcagaggactttgtcaggaattttaaagactaatataatcttttccactcattcgagtgtaaacatttcaggtagaaagagtgagatgaaagaggaaacagtgaatactgcaatttgtttatatctcaaaactgcaagtctattctttccagaacagaacttggtacactggggcctgggcacctgagtccccagtgtttgtgatgttatccttactcagttactggaaatataaagggacaacacctagtttggaatcaacaaatggagaatctatgacacttcagtagtttttcttcctctttacctggaaaggaacgctttgttgcctgtgagtgtggaaggagaaagttggttcccaattggaacattttcctctgtaacacaccactacaaccctctcgtttgtgcatacactgggaactgcccagaattggtctcaccagggtaccaggttgaatgaggcacataaatctcaatgctaaccacctaacaacaggggttatttcacatgtgtgcttctttttggttttgcttttgccaagtcaaccctaacacagccagttttccatttaactatattatccattcaaatatttattgagtacctcttaataataacagcctttatttaatggggaccttctttatgtattacagtgcattttatatacgttcctaatcttcacatcagctactcatacaaaccagggcaatgttatcttcatttttcaatataggaaacaggctcagagaagttcagtgatttctcaaagtgttacacaggctggacttgaattcacatatgactcccaaacccaaattgtttccatattgcaaactgaggacacctgatctttggtataaaaaaaaattgtgcaaaattgacaaataggatctaattaaactaaagagtttctgcacagcaaaagaaactaccatcagagtgaacaagcaacctacaaaatgggataaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgagaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacgctgttggtgggactgtaaactagttcaaccattgtggaagtcagtgtggcgattcctcaaggatctagaactagaaataccatttgacccagtcatcccattactgggtatatacccaaaggactataaatcatgctgctataaagacacatgcacacgtatgtttattgcggctctattcacaatagcaaagacttggaaccaacccaaatgtccaacaatgatagactggattaagaaaatgtggcacatatacaccatggaatactatgcagccataaaaaataatgagttcatgtcctttgcagggacatggatgaaattggaaatcatcattctcagtaaactatcgtaagaacaaaaaaccaaacaccgcatattctcactcataggtgggaattgaacaatgagaacacatggacacaggaaggggaacatcacactctggggactgttgtggggtcgggggaggggggagggatagcattgggagatatacctaatgctagatgacgagttagtgggtgcagtgcaccagcatggcacatgtatacatatgtaactaacctgcacattgtacacatgtaccctaaaacttaaagtataataataataaagaaagaaagaaaaaagaaaaaaaaaattgtgtgtcatgggctatggccctaactaagttttcaatcctggggcaaatccagcctaatagcctacactgggcctgtcaccctggcctgtatatattaattttcccttgcacttcaaccctcccacttgcacttggggcctatggcctgatgactctcagccacgggcataatgtaaaccgaaggacaaaggacttttgggtacccgctggtattggattctgggccatcttcagtgccctaagggttggtagttttcttgctgctgctcctgctacagaggctcttgggagctatctgcttgtcatgcttatgtttatcacttgcaatagtgcccagatcctgtggtattgtccttggacctgaagatggtttcatagacagaaaaatgtggagtgcagcttgggagaactgagaggtctccagagtgggagaggtctcaaagtactaaggaaaggaaaataggactaggttctccagaaatgtgattctaacctttcacccattccctttgtctcttaggtccccagacagcctgagatagccataggcctcttagtccattttctgttgcttataacagaataccagaaactaaggagtaagaaagaaatgtatttcttacaattacagaggctgagaagtacaaggtcgagaggctacatctggtaagaaccttcctgctggtggggactcttaagattcctgaggcagtgcagtatgctgaccatgctagctcaaggctctcttcctcttcttataacaccaccagttctcctcccttgatagccattaatccattaacacattaatctgtgaatggattaatctattcattaacctattaatccattaatccatgaatggatttatccattcatgaaggcagagcccacatgacctaatcacccccaccaaaggccccacctctcaacactgacacactggggacccagtttcaacatgagttttggagcggacgtccaaaacatagcagcctcctttcactaaaatgtatctgttcactcatattaacagctctcttcctaccaaactggcttcatccaggagagctgtgtgcttacgaagagtcagctggcttgtccctaaaaccggttatgcccattgtatttattattgaaattgaaacactaaatttacatataatttaaatagtatataaagtgattaaatgtgaatataaaagatctgtttctgtgaaagttaaatgatagaaatgaattgttaaaaaaattactattgaattaggtttggatgggacaactgtaaaaaacagggaaaaattataaaaactaaaagagttctgcattctaatggctttcaaagtgcctaaattccattctacactaaaaagattcaaactggaatgtgcagaaaatgccttacaggcatagagcaaacaagtaagataacataggctcccatttgtaaacccagttgggtcccatggtgaaagtttggcaactaaatgtttaacattatatgttttaagttaaaatgttttaggtatgtatacatgaagttttcatcagcttctcaactagtcaattactcatcctaatcacacctccaacacagtctgtctattcctgattacatctgactccaagtccgtgacaagtttaagtccttccagacatgggtactgaaataacattgctgaagtcactttagcctgacttaatcagtcacaagccatgcatttccaaaaatctaatttatgttcaaaagatgaagctgtgtcacaacacaagatattaaaagaactgtccatataccactatcatatgaagagcttctatagctcaaggagtaaaagacaaatcgtttaatagaaaaatgagccaaggacaagaacaaacaattcacaaatagccaaaatacatggaaacatgtccaacctcagtagtggtaagcacaaattaacaatgagatagcgtgtattacccatgaggttcacgaaagtttaaatgactggtatctgtttctggtaacgtgtggggatcaaattgctgccagtaatttcccctttaggtaacagatacaaaaaaaacagatacatatataaatttttaagtgatggattctttaatattttcagacgcagttagaaaaaaaaaaaactccccctcagaaggaaggaaaaaggcatgattctaaactaaacacaattctaaaagtgaaattccaaaaacattctgagcaatggcatcatcactagcataagtatatactttctgaagaaggttattttgaaggacatcagtgactgggatgatgccttctgttatgctggttaaaataccctcctttgattctgcagacagcagagcagtgctcacgccctggcaggcccggcacacggctccagaccagaggtgtagggggagccatgatgctgagcaaccagcatcactgtctcctagacctgcagttcttccctacaccctgtgtacaaggcctgcgttgcactggggtggacagctggctgctcgaattctttgatcagggcactgctgtgtctctagcttctcatgctgaaagagactttttggtatttgagcctaacgacacccagaacctggaataaaataaagacccaccttctctagaggatcagggagccaaggacatagtgttctagctatacaatgaaatgcagatttcccaataaaaggcaaaattcttcacttcaggaggttgaataggatggaaaagaattccagctgcttaaatttatggcactgaaaaaagccctgtctgagaataattcttgtgtctgagcccaagatgctgtcaccttgccgtggatcgttaaagtactcagtgtgctcccatcctcagagctgtgccctgagacagcctaaattggtcaataaacacagtagttctgtcttgttgcttcttcttctgaaattaagaatattttagctgagccagtgtcagagtaaaatgcatagggggccatatttaggtaaaaactggttagacacaggccgggcacagtggcttacacctgtaatcccagcactttggaaagctgaggagggaggatcacgaagtcaggagattgagaccatcctggctaaaacggtgaaaccccgtctctactaaaaatacaaaaaattagccgggcatggtggcgggcgcctgtggtctcagctacttgggaggctgaggtaggagaaaggagtgaacccgggaggcggagcctgcagttagctgagatggcaccactgcactctagcctgggcgatagagcgagaccctgtctcaaaaaaaaaacaaaaaacaaaaaaaaaaaactgattggacactgtgtgattgcatgttgagatcatgaaagaaaatgtcaatcatcctccttcctgctctatatttgaaaaagaaactagccaagcagccccgagggcctaccaagataagctctgcagcgagacagctgggttcacacccagcaccatcgctcaccagcaatgcgcctgtagaagcctgtaggtgtctgtccttcagatccctcatcttaaatacagaggtactaacagagctcccctcatggggtcatcataaggagaaccttagttaacagctctaaagtgctgccctcacagtgaacactcaaatatcagttattactgttggaagggagaaggtactggagctggagtagacgccagagggcctgaatgtctagcattagtgtaacaacccttgtagaaagcatttatccatatgactctgcccaagctgtctttggccatttacatctggcatataccacatacctctttaagtgtgtcattcactaactacattgagctcccggtgggcaggaaaacaagtgtcctaatccagcacagagtctcaacaggtaccccagcaggtacttgacaagtacttaattgactctgcttcctgcctatatggagagtggactggactcaaaatgtcaatcctacaaactccatttaaatgggcttttctagaagtggggctagatcaggacatagtcatcaaaaccagggatagacatgggtttctgtgggccatctgggcaacaatacacttgaggtgtcaccccttccgcaggcaggagtatcctcatgcttgctgtcagggagctctctgttcactcagagcagaagcaccttccctgcccactccagagctccaggcccgtgggggctccattggaatccgagccagcagtcagtgcccttcctaaggaaggctctaaggccatgctggctcagcgtcaccagtctgggctgcctcctgcaccaccttgagtatttagagaccagctcagctcatggtcctagcttcttactgtaacttcatggccatctgtgctaaaactatgcagttacacaatttaaactggagaatcctgtgtccctgtagttcatctgtgtattcagcaagttttcctgagggtctactatatttctgggccttgaccacattcttaaaatactgaatcttaaaatagctgacacaccattattgagctactattctaagtgccttaaatccattgtctattttaattcagtgaggttggtgttatctctgttttacagatgaggaaaaatgaggcacagaaatgaagtaacttgcctgagatcacagagtgagctgcaaggcctggatgaagacctgaagccaggtctgtctaacagagagtaggcatcctaaacatgatgcttgctgactttccctacctctacttaatctatttatcttctctggctttatgactcttgctcatgtcacccttactacctaaattcaaaagatttagactagctgtatcttgcctatttcatgactcttctagaccaggattgatatgacagagaaccaatcccctgatgctaaataaaaaaggtgaaatccaggttaggcttaataacatcccctttcagcagcccccacctcccttctcccctacttgttcttccaagtttttccgtcttttttctatcttctccccactgtgcccactcaggtatcccatgggctccccagctcaatcccaaactgaactcccctgcttcctgaattccctaccagggctttacactgagctgcctgcactcacgttgaaaacctgtcatccacgtaagaagggttattataacacagtggtttaaatacgggctctgcatccagactgcctgggttcaaatcctggatctgtctctgccaggtgtggttacttaacctagctctgtctcagtttcttcctctgcaagagaataaaaacagtacctaacaaaaaggaaggtgtttttgcaacaaatggggctagaacaacggatatccacaggggcaaaaaagaaatcttgatccctacttcacactatacacaaaaattaatttgagatggatgacaaacctaaacataaaaactatagttataaagcttctagatgagaaaatggtgattatcttggtaattttgggggtggtaaaagtttctttggacacagaaaaaaaaatagccttgccaaaaaaaaaaaaaaaaaaaggtaaaacttctgctctaagaaagaaaatgaataggcaagctacaaattagaaaaacatgtttgcaaatcacgtatctgataaagaactggtattcagaataaaaaattcctacaactcaacaataaaaagacaattcaaatttttaaatgggcaaaatacttgaataatatttcaaaaagaaagatacataaatggccaataggcacataatagcgcttaatatccttaattattagggaaatgcaaattacaactataataggatactgccatagcagtatccacaagaatgactagaattaaaaagactgacaataccaaatgttgatgacgatgtgaagcaactagattctgatacattggaaatataggtgtataaatgtggaaacagacactttggcagtttcttacaaaactaaacatagactcatcttatgacctagcaattccactcctagatatttacccaagagaaatgaaaacatatgtctacccaaaaagacctatacaaaaatattcatagcagctttattcataatagccaaactggaaacaactttttttccaaaaactggaaatgggataagtaaactgtggtatagccataaacaaaatactctttagcaattaaaaggaacggactgatacacaaaacaacatggataaatctcaaaaacaggccaaatgaaagaaacattaagccaaagaatatataccatacaatttcatttatgtgaagttctaggagagacaaaacaaatctgtgccttaaatattagaataatggttgcatctggagggtggggacagaaattggaaagaaatacaaaggaattctgtaggatgatggtaatgtccaaatcttgaaaggggtttgggtttcacaggtgcatgcttttgtccaaagtcatccaatggtatgcttaagatttgttcatttcactataaataagttttacctcaaaagaaaaaataacgtaaacaatattcaactcaaggtaatggtatgcatgcttaagtatttaggggaatgtacaatttcctaatgtctgtgacttaaacatatcacaaaaacaagatggactgattgacgatggaaggatggacagataggtgataaaacaaatacaggaaaatgttaactttagaatctaggtggagggaatatatgtattcaccatacatgtgtttaaactttgctgtatacttgaaaatttttataacaaaattatagaaattagtccctacaaagtaagagtgttcctggtgctttgggaggctgagacaggaggattgcttgaggccaggagcttgagaccagcctgggcaacatagtgagatcctgtctttacaaaaagtaaaaaaattagccaggcacggtggcatgtgcctgtagctccagctactcgggaagctaaaagcaggaggatcgtttgagcccaggagttcgagactgcaaccactgcactctagcttgagtgacagactccatctctacatatatgtgattgttgcatcatcttttacattctcttttttgtcacctctcacatgggcccaaacacctgctaacctcacaatcactcacatccctccccttgctggctttcctgcagtttctagcttggttcaggccctggttacatacctggatttcaaatctctgttttgcctatctgtggggttccctactccaatctggtttgaatgtcactggcaagtcaatcttcctagttcacagctcctattacatgtactctgctgctcaacaatatttgatgactcttcattaatgaataatatccatactcagtgtcctgtaacaaggcccttacattctagccttattctgccattgtcctaggaaaatacagaaattattagctatcatcaaaccagattaccagtattccctaacataccatacaacttctatctccatactcatgtctcttccacaggaatctattcctaacccacagctttcagcagtgaagaatatgaatggaaactggttagaaaactttggccttaatagacaggagtttcaagtcttcctgtagctacttagcagtgctaagccagccacagaaaacacccattccctgtgttcgtgcattcattcacttgcttgctaacttgcttagtacttattgtgtgccagataatgtgctaggtgcttcaaaaaacaaacatggcagactctgtcctgaagaagctccattagtgaagagtgaggtagagaacaggtataattcaccataagtcctgatctgaaggtggcagatttttacttcaggttaactttagattgagaccggtgagaaagtggtaagattcttgtggcagttttaaaacatggtctcaaaatctttgacactcctcctaccaaggtgcaggcttatggctgctttgatcaacagagtacggcaaaaagcaacactatgtgacttctgaggccaggtaataaaagaccagggagtcttcacctggctctcatggaatgctccttctgggaacacttgctccagaaacccagccaccatgctgtgaggaagcccaagccacatggagaggccatatgtaggcactctggctccaggtatcccagctgagcccagccttcaagttgtctcagtctagaagccaggtggtaagtgaagaagcctccaaatgatccaagcccctagctgtttgagtcacctcagcttttcaggtcttcacaagccattcccactgtgtcctgttcaaattcctgacccacagaaccccagagcataacaaaatgattgttgtcttatgccactgtttgggagagttttctcccagcaattgatgactggaacaaaccctgcagaaataggtgctacttatggcaggaccctgggcagtcttggctagggggctggagccagggaggattgagacctttcaaagaatataactggtacaccccctttaaattttcacccaatttatcaagtttaccacatcttcatttattcaacaaatacgtatggagtgcctggtatgtgataggcattattttagaattggataaaaatccttgccctcaaggagcttactgtttagtgggaaaaacagacaattagtgaggaaaatacataaaatgtaaaccatgttggataggggataagtataaggagaaaaattaaaactgaaagaggggacatgaaatatcaggatgaggttgaaattttagagaggccaggaaaggcctcatggagaggtgacttgaataaagtcttgttggaaagacctgggatggaaaataccacattgtcccctccccagtacccacccatatcagctgctcacacctcgtcacccagacagacctcaggacaacccttagagtcaaggagcttgggtgtctctaaaatgttacctctcctgttagaattatataatgccaaacagaaagggacgtcagaagctatgcagtccctccctcctcacccttcaatggggaaactgaggccatggtgttccaggtagcctgagacttaacctgagatctgcatgtctgcccagtcccgttatttctatgactccccactggctcctagaacacccctttccctcggtggctaagctctttctgctatggctgcatcatcccagctagaagcacctaatacttatcagtgactagttttgtgacaaatccttagggtaagtggggctggggaggccaagaacagaagcagcactggccccagacaactgtccagcattcccaccagtgacactaccactgtccataattttctccaccaacagccccatccacggtgtagtctgtgatatgaaaaatggacatgttccattttctcttcccaatccatctgtcatgggttgaagtgtgtccccccaaaaatcttattgaagtcctaacctctggtacctgtgaatgtggcctggtttggaaatagggtatttgcagatataatcaggttaagatgaagtcatactgaattaggatgggatttaatccaatgactagtatccaaaaaaaaaaaaaaaaaaaccaggaggaaatttggatgcattggacgcagacacacagagaggaggacatcatgtgaacatacactgacacagaggggagaagtccatgtgaagatggatgcagagactggagtgatacacatgcacccaaggaatgccaaggactgctggcagccactagaagccagaagagtcaaggaaggatcctcccagaaccttcagaggaaagcttgactctgtttgaacccctgatttcagacttccagcctctggagctgtgagaaaatgaatttccattgttttgagccacctggctgtggtactttgttacacaacccaaacaaatgcatacactctcctacataaaaagtctgaagccacacatggttcccatacagtcttcctccctacagtcctcaggtccacagctcataagcaactcctgcctcccccaacaccactccttcttatctacctgctgtgtacatgcaaagactcccacagagccctacagaaagtgagttgagaggtcagccattcctagagtttttagtacagtttgctgattagccgggtcctatgtcttgctgtaggcacaacctagtttataaagtttggctccaaccagtctaggatctgttggtctttttgaaaggtgataattataatcctcaatgactgataaatgactggtatatgccctctgatgggctgagaggttgcacagaagtaccaccagtgggagagagttcactctcatgggtctagtagcagccttttaaatgggaaccatccttctaaagggctagttggcaatatggaacaaaggcaaaaaaagaggatcgtatcttttgacctagcaatgcttttcttggaatataatccaaggaaataatacaacagaaaaaataaactatttggacaaagatcattataacagtgttacttataatagtggaattaaaaactgaaaacattaattgtggaacaattaaaatagagtatcgtaataatacccaacattttctgagcacttactatgtgccaggcattcccccaagcactttgcttggattctctcatctaatcctcacaaaaactttacaagtttgttgtattatccctgattctttatagataaataaacttgttcaaggtcatacagtgaggaagtagcaagtgagcactaatttataccctgtgcttagtttgactttattgtggccacctgatcttggacaaattccttttaacttccctaaactttgggccatcaactacaaagtgggaacaagaacaatatcataagattgacaaagattaaatgcaaaatgtacaaataaactgtaaaacattatccaaatgagaagtatttatagcaaaataataactgaatattttatgtggcaggcctaattgcagcctattttacatgccacgttgaatagctgaaattttgtcttttaggtagcaggggattaacattgtttttaaccaggggtgtcacaatgagatctgtgtttcaatactgttttcaggtacaataatacaagattatctcagggtgacaaaattggaactttatctagttcttgatccttaacaagttttatgagctctccagtaaaagccttggtctgattgtcccagaaggcaatgaggcctcagtctggggtgagcagggcggcctaggagctgtagtgcccttaactcacagactctgcaggaaagcagggtcctcatcccctaacacgtgtgcaaaagggtcttgaaccttgtcaagaggaaagcagaaacctcagaacacatgaaaaggtggtggtgttctgaaggcagttggaggtgactctcctcactcctcccacactgggtagtcataaggagggttattattatcaacaggtccaagaggccttaaattttcccattaaatccaaggcaattatgcaactaattcctctaaaccaggactggcacagctccaggttcctatcccagtgaacctggctgaacaatgaaagacaagaggcccaaacaacctaaggcatcatccagacctagggtggtcttgctccagagcagaatcagaggcttggcccttgaatcacccctccccatctttcagctctgaaatattctaggcaggaaaaggggaccagcacaccctctccatatcccagtctgcaaatggattctcccatgttttcaagtcgttttgcacttctgttgtccaccactctgctcacctctgtcagcccaggagagaaagtgagggacttaacatacccctcacaacaattctgggaagttgttacatctccattttataagggagtgaactgaagttcagagtagttaaataatgtgcccagattcacccatctaataagttcttgagctgggattgaaacccaggtctgttagctccaggaccttcccatcaactgcccacccagccctcccaatcaattaggaaaattggctaagatggacgatgaaatctacctgtgcaaaatccatttgtaatgccttgtcacatggctctatctagtccacactccacaggcatgaaggtcacttaggagccagaagggcatggaccctcctgctctgccccttcccacacacaggcacactcttctataaaaggatctagaaagccatggtcctggaaaggggtcaatcaagcccttttagaacaccagcactgggctggcacctggaggcctgaattcctgagcctgccagctatggtgccaaccacatcccccagaaaaaggacagagagtaattagaaagcaatgcctcacagaccaaacatgagtcacatttctaaaagagtctcaaaatgaaagatcagcctggggcctgcagtgacagcacttgagcccaactcctccacccaacctccgtttcttctaggctcctggggggaccaaaaaggaagctgcagcagagtaccactgaagggcacaggtgtttccacccagccacaaaggttcactagccatctaccatatacctgacaggagatcagagatggccctattgtggccctacccctgagaagctcatggctcagtgacaatgcaagctgagaaacaaagacagggccagcacagaccagatgctctaaaccaagtggaatttatctcaagaatacaacttgtctggaacagttgaaaatcaatcaatgtaattcaccacattagtagactaaagcaggtaggtgtaggcaaactatggcccatgggccaaatccagcttgttgtctatttttgtaaaccaggtttactgaaacacatccatgcccattcatttacatgttatctacagctccttccgtgctccaatggcagagatgaatacctgtgacagagatggtatagcctgcaaagttgaaaatattttctatctgtatctgcctctttacagaaaaagtccaccagctcctggtctaaactattaggagagaaccctttcatccaacaaaactgcaggaactccaactccctttcctctcctttctacagaccatattgggaggcagatgagcattagggtcctagactgtcagggtgggaagaccaggccactgcttcccatgaaagaaacagtccatggtgtgaccgttcgcctccttcccattggtcccacccccaagcagaagcctcagggctccctgctggtaaggcttttactaaagctctcctaataaatgcttagaggtaggaaaactggttctacacctccatgtcccctttcccaacccaactgtcccagaaaaggagaaccctagaaattatcagaaaagaagaaaggtctcaaatcaatgatctaagcattcactttagcaaactagaaaaggaagagcaactgaacccaaaacaagcagaatatatgataaagaaaaaccaatgaatctggaaacaaaaaacattgagaaaactcaaaccaacaaacacctggttctttgaaagaaccaataaaattcacaaactgctagccagattgaccaagagcaaaagagaagatacaaactataaatatcaggaatagaaaatgagacattactacaattcctaaagaaattaaaaggataataagttaatattatgaacatttataaatattctgtcttttagattaaatagacaaattatcccaaagatacaaactaccgaaaatcactcaagaagaaacaaataacctggacagtcctatatttattaaataatttaatttgctgttgaaaatcatgccgcaaaacaacttcaggctcaggtgtcactggcaaattctactaaaactttcaggaataaataacaacagttttatgcaaactcttccagaaaatagaagaaggaacactttccaactcataaggctaccaatataccctgacaccaaaaccagacaaagacatcggatcaatatccttcatgaatatagacacaaaaaacttcaatgaaattgagtaaaccaaatccagcaatatataaaaagattaataatataccacaagtggagtttattctgggaatgtaaggctggttaaacatttgaaaatcaattactgtaattccacatatcaatagactaaagcaaggatcagcaaactatgactgggaaaactatgaccagcaggccaaatccaacctgcagcctgtttttgtaaatacagcttcctggaacacagccacatccattcacttatccatctattgtctgtggccgctttcatgctgcaatggcagagctgaatcactgagtagaggagatttatgagagttgagtagagagttgaataaagtaccttatggcccacaaagcctaaaatatttgttatctggctattatgacctgtttttaactcccagaacacttctgacacccagctatgtggagtttttttcctcataccaactgaatctctctctagacaccagctgcgtcttacaatccaattcaatgctaacactatcaaccttgagttagatctaaccttagtgttagatcctacagcttaagggctcagtccccaagactgcccccatttcagatcacaagtcctgggcccctcttatttctgaccaaccgacgataagttagggattcccatgacccccttcttgggtttgataatttgttagactggtttacagaacttgagagccctctttccttatatttgccagtttattttacaggatacaatctaggaacagccaaatggaagagatacataggacaaggtatgtgaaaaggagcagggaacttccatgccctctccaggcattgccagcaccttgccagcatctcagtgtgcttagtcaattccaaagctctccaaacccctttgattaggagtttttatggaggttccgttacataggaatcactgattaaatcactggccattaatgatttactcagttttcagcccttctcccctccccagatgttagggcagggtgtgctgaaaattccaaccttctaattacatggttgtttcctctgacaatcagcccccatcctgaagctatataggggctcaccaagtgtcacctcaccagcataaactcaggtatggttgaaagggacttattatgaataaccaaagacattcctctcaccactctcactcaggaaactcccagggttttagaagctctatgccagaaactgaaaataaagaccaaatatatatttattatttttctcacactgccctttgtgaaaaagtttgccaactcatggacaaaagaaaaaatatgatcatctcaacagatccgtaaaaagcgcctgaacaaatcattattcattcacggtaaagacaaagaaaatctaagcaaattaaaaggaaacttcctcaacctgataaaaagtatctacaaaaaacctatgactaatatcatacaagatgatagaagactcaacacctgcctcctaagattggaaacaaggcaatgatgtctgttttcaccactcctgtttaacattatactggaaatcttaaccagcacaataaaacaagtaaaataaaggcaaagaaattggaattgaataaataaaactatctttattcagagatgacatgattatctatgatgaaaatctcaaagaatctagaaaaaaaagctactagaactaataagtcagtttagaaaagtcaaaagatataaggtcaacaaacaaaaatcagttgcttaaaaataattaaaaagctcagggaaatagttaagagcagatgagggctgaaaattgattctatatcccagccttttaaattgtttaagttacacattagatttagctagctactaatcacattagattttcaaactctgcaagtacacattttgctgtactttattctgatttaaatttttaaaaatccattaaaatactaaatcaattgtagttataaatactagcaatgaacaattggaaaacagaattttactaaaagtaccattaaaaattacaccaaaacatgaaatacatagctataaacatgacaaaatatgttcaatatgtatatgccaaaaactataaaatattgataaggaaatcaaagatgacctaaatggagaaatatagtttatttatgtacttaaaaatccaacattgttaagatgtcaattctctccaaattgacttatagattcaatgcaataccaacagacttccatcaggaatttatgcagatgccaacaagatgattctaaaatttatatgtcaggccaaaaaatctgtaatagccaaaactattttgaaaagaaagaactaagttgaagggctcaaatttccttacttcaaaacttacaataaagctacaataatcaatacagtgtggtattgttgaaagaataaacacataaatcaatgggacagaatactcagaatagaccacacatacatgctcaactgattttcaacaaaggtacaaacacaattcaataagagaaggataatcttttcattgtggtgctagcactattggacattcatatgcacaacagaatctctatctataccttacatcatgtataaaaattaacttaaaatggatcagaactaaatatacaacctaaaaatgtaaaacgtcttgaagaaagcactggagaaaatcttaatgactccacattaggttagtatttcttagatataacagcaaaagcataacacatctttaaaaattgataaattgaatttcatcacaattaaagacttctgtcatgcagtaacaggcattgttaaagagaatgagaagacaagctacaggcagcgagaaaatatttgccaaacacgtacccaataaaagattaatgtccagaatatataaagagctctcaaatctaaatcataaggaaacaaacaatccaataaaacttgggcaaaagacttaaacagatacttcaccaaagacaatatatgtttggcaaataagtacaaagatgttcaacatcagtagtcactaaggaaattcaaattaaaaacacaatatgataaaactatacctattagaatgtctaaaatttttaaaatctgacaataccaagtactgacaaagatgtggaaaatataaccctcatatattactaccaggaatgcaaaatggtacagccactttggaaaacagtttggtattccattacatttaccatacctcccagaaaccccaatcctagatatttacccaagtgaaatgaaatctatgttcacctaaaaatctgttcacaaacattgatagtgagttgttcattatcacctcaaactggaaacagcccaaatgtccttcaactggggaataggtaaacacacggtgatacgtctttacaatgaaataatactcagcaacaaaaacgaataacctattgatatacccaccaccatggatgaatctccaacacattaatgctaagtgaaagcaggcacactaaaaagcctacaaaccatgactccatttatatgacattccgagataggaaagaacacagggagagaaagcagatcagtaactgccaaggtctgcatggtgggagagcagacaacaaaagctcacaaggcaattctgggaggtgatggagctcttctgtatctcaattgtgatggtgcctatatgactatatatacatttgtcaaaattcagaactgaacttcctcataattatgtattaattgttcagaattgtacattaaaacaggtgaattttactgtatataaattatatctacttttttacatgagaaagaaaaagagtcttcaaaaaaacctattatgatgcagcattgaaaagaaaagttattgtgtacctgggaaaatgctgatcatttgtcaaacaatggaataaaaagacagtagaaactgccaaatttaccagaccagaatacaccgaaactaggaaaagttggtgtgactgatttatgtgcaacagatgatcaggtagatactgaatatttatttttttcaaagtttccagttaacttttagaaaaagatatctaacttttagcaatattacttatagaaaagctagaactcaaaatttaatctaaagaatacatagacaaaaccctggtagactttaatattcctcagacttattctgtcaatcctaaaggtgccaaaaatgtcaaaattgtgggcacatacaaaactggccaagggaagcaaagacaattaatagttcaatctcacttaggactacagatgtaaaaaaccaaaataaaatattagaaaatcaaagtcactggggtattttttttttaaaaaaactatacattatgactaagtgtttattccaggaaggcaagaatgcatcaacattcaaaaatcatgaacacagattatgaaaaacagcatttcaccttgaaatcatatgtaactctgatagattatatcagttatcacattatcatagttcagaaggatctttatattttgattataatgatgaaaaaactggtatgcaatttcaaaaattaaggtatattgtaatttagaaacttttctaaaattgtctatatgaaaggaagtgctttttcctgagaaactataaagtgatacgaatcttagtggctataatttggaataaagaaaatataagaatccatcttttatcatgctattacctttattttttctcttcagctggcccgaattggtttctgttaattttgaagaatccttcctaatacacaaatcaaagaaataatagaaacaattacatagtgaaacatcaaatcaggttgacatcacaaacatctggaaagctttgttaaaccagagattccctgaccccaccaaggtagtctgggctgggactggggagccatagattatttttcaaacaaggttcccaaagagattttgttatcagccagttctggaaccactgctatgaggaaacagaggcattaacatgtccttcccttgatgttttttcagtatagttacagatataaaattttagcatgagaaaaattaaacaaatgataaaaacataccataataatttatgacttgtctctgtaaaaagaattttacagggacttatttctagagaagttgaggctgaaaaggtcagaggcagcctctgggggcagtatctgacagttattaggaacttaactcattccctgaacaaatgtttaaggatagaagaacctgtcaatcaaacagacaagtgaagaatattccaggtgaggatgaactcacagtcacagtcagagacacaggaaagtatcaattgggctgagacaagaagtctggttgtagtgggatcaaggagtgtgggggtggctgctatgagactgggcttggaggtcagattatagaggcctgtgaatggcttaaggctgttctgtgtgaaacagggagccaccgggggttcctgaaggtggtgacacagtcagactatgttttagatcaacaaagcaatcaagtgtacgatgtatttgggctacagagaagccacagttaatactccaagtgtgagctagtacggtctggtcaggaaaaaatagtaatatcaaagtaaaaccaagtgtttctctgcctgggataatcagcaggcccacaggggaggagctgagtccctaggtgcctgcccaatcacaataagaagcctgagaactccctaaaacatactattgggtaacatcagtagcaactgcgttgattgtatcatgtataccatgagtgactattggaaaggcaggagcttttgatagtaatcagaggcaggttgcaagataagaactgttcctccaggcacgttctaaagccacctgctgcttcctcatgaacatactcgtttccacaagatcagcaaccaagtgattacgaaaatgatcaccctgttgacactaataggaaaataccaaatggaaatttaacttggacaatggggaagtttaggaatacatctgcttgagtcatgttctgtgaatggactcagtacttggctggaaagatgcataaagctcaggagaaaagttagaatgaagtatacctagccctacagaagacataactgaagaagtgaggtgaatgagtggaaagtgccttctcatggagtggcacacagcaaatcccttagaatcttctctgagcacctccatttaccccattagccagtccttccacccagatgtactgagcacctgtggtgtgtcaggcaccaggctatgagtaaggatacaagatgaaccacagctggtgacctccaggagcacagtgcctagcaggacactacccttacgaccacagcacaagcacaggttgccaagcacgtgttcatctgcctacagcctcatcagatgagtagagaagggcttctctgtccatttaaaggtgcacaatctgagacctggagataccacgtcacatagcagaagacagtgctgaagctagcccccaaacccggggcatcttcctggtgtttcccacagcctcagatgacattccatgtagtctgaccccaggaaaggggaacagcactcggtatccaggggccctgaagcagacagatggcagtgatcacaggccagataaaggtaggacattcactcctgctccccattggaccctcagactaaagaggacagccttaaaggactctagagaagcaggtgggcagatgagggaaccaatgtgtatccattcttcctgcctatgtcaggccgttcaccttcctatgccatcaccatcctccaccaggataggtagtgatgagaactctggctgatgctggctctactacttggattttttttttagacgaagtcttgctcttgttgcctaggctggagtgcagtggtatgatctcagctcactgcaacctctgctcctgggttcaagtgattctcttgccccagcctcccgagtagctgggattacaggaggctgccatcacacctggataattttgggatttttagtagagatggggtttcaccacgttggtcaggctggtcctgaaccctgacctcaggtgatccacccgccttggcctcccaaagtgctgggattacaagcgtgaaccacggtgcccagccaccacttggcatcttaggccagagtttcctcttcagtccaatgcaaaggtcaagtggacctgacccttagtcctaacaccctgtgattccagaactaggaagtgagctacaatatatgaggcatgaaaagagaacacaaagccccagaaacccaaaagtcttctacgggcctctgggctttcactctggccacccaattgcctcttaatatttttgatcgagtataaaataaaacaatttcagatgtttcagaaatattattggcagcagagggaaaacaaggccagaatgaaaaccacccccaaaataaacctcaggacaagcacacctgcatgtttgggagtgcgctgcaaggtcaaaggtgttgtgccagggcccagcaaggaaggagctaacagccttcagacaccggagccaaatgttcctgccttcctctctcctggcaaatgcttaccctcccttcctcctctccatttttgaggccttcctgcatcactctagcccctgaatttcttgtcatcctttaattctgttaatgaaacttggaaattgcatgttgtccctgttttctaattacctatgtgttagctctcttgctacccacccagagtctcttagcatagacacattacctttgttttttgttgttgttgtttgtttgtttcttgagacggggtctcacactgtcgcctgggctggagtgcagtggcgccatcttggctcactgcaagctccgcctcctgggttcatgccattctcctgcctcagcctcccgagttgctgggactacagccgagtagctgggactacagacgcccgccaccacacctggctaattttttgtatttttagtagagacggggtttcaccgcgttagccaggatggtctcaatctcctcaccttgtgatccacctgccttggcctcccaaagtgctgggattacaggcgtgagccaccgtgcctggcccacatttacctttgttttataagcctctacagagctcaatagaaagtagacatcattagtgtctgctggttgatttacaagtcattatatagacctggagaacactgcccggtatatataataaaagctattctttgttttgtgcctatttatattcctatattcatttaatttttataaccgccctcattgtcagatgacaaaactcaagtcagctcacagaggttaaaacccatgcccaagaacacccagccagtaagtgaatgggatggaactgaacccaagtttaacaccaaagatcacattctgcctggctgcctcctcctgccagaaacctgaatgagacctactatacatcagaaatcctcatctctgaaaacaagaaaggtaaacagcatcctcaactataaaagccccaagttgcaggtgttcggttcccccaaagattatgagaaataacccataaggtcctggattaacaaattagcatcagatctgagcgcccagagccaagggaaaaaaaatcaagaagcaggtctgaaagaaaaggaaatcctctcctcatcccttttcttttgtctccaaaggggctttctgtctccagagggctctgcactgaagacccagggaaggagaggagcagagggtggaaggggggcaaggaagtaccaacagaggggggatggggacaacgtgggaaatctaagaagctggatctacacaaaaatttccacagctccctagtggggtgcccattcaccctcagacactgaagtacagtgagcaggagggcagggaaaagaaggtggtgggagcatctggaaacacagccttaccttccagcccatgaggcagcaactgttgctggctctcctcctgccccagctgactgggctggctgtcagtaaatttcatgggggctgcagccctcacacaccaggtgcatgcaacaaggaggagggatgcacctgttggcccgcagtgcaaatacggaggtccacccaccttgagtttgtgaggggaatgcatttgctcaacctgttggcatcaaacgaatggaaaagtgtgcagccaaaactcaaggaagaataaagagaatccatctgcagaatggtgcaggtgggagaggggcgtggcttgtatgggcactgcttccccgcacaaccatgtctgcctgcttgtaaggtaggaggctgggggagcacagggaagagatagaagtcacatggcataggagctcatcacagtgacatcgttctgtcccactctggctcactgctggacggttccttgattctgagcactcaggccacccaatagaccctgctcaggcctaagcatccacatggacattttccatgcaaatggccctgcctcatgtcctctgcatgcaccctctgctggccaagttgagcgaggacattgtcttttgttgggaaaggatactttttaagtgttgtttctaaattttactacatttgctgaaaagacaggacaggaagcttttaagaatgaacaatctcccagcctgtgtgggttggtttgagctgtgagaggtgcagctgggcttccaagtaggcttatatttccagactcccaagtattgttctcagaaagatactaaataagacaccccatactcatgggacactgtacccatgtccccaagcaaggctgcattctgaaacccccaccccaccttatgaacttcctaaaagacagacaagccaactagttgtgtttcaaactctaggctcatcttatattttgaggataaaagcaaggggtcattctcaaagacactgagtatatggtgaccccagcgcattcacaatctatgcctctgagaccagcaaagatctccctagccagagacccagaacctttccccacccttggaactcaaaggcctctcccctctgcaccatctgggtcacctccttctctgacaagccttctcagcagattacccccgccacctgccagccaggagcccctcctctgcagtgactgtagctgtctgtctaccattttcaggcagcaggtggggccacctggccttaccagttagcctaggaatgttccaaggcctagtctgctctgcatatgttttctaagatctggcccctggggaagcagcccctgatgaaggggtgagcaaacctcacacaaacagcaactactctggctgggtgcagtggctcatgcctgtaacccagcactttgggaggcagaggtgggcgatcacttgagcccattagactagtatggacaacatggtaggaccccatctctacaaaaaatccaaaaaactagccaggtgtggtggcacacacctgtagtccctgctactcaggaggctgaggtggaggattccttgagcctggtaggtcaaggttgcagtgagctgagatcacgccactgtactccagcctgggcaacagagccagaccctgtctcaaaataaaaaataaaaataaaaataagacaaggaaacatctacaatgctgcagctaccctcctcctcagctagccagttattacacaaaagaaactgaacatgggagataaaccagcataaatgcttccccactgtggggtggttctccaagctcatgcttagctgcaaatgaggtccagcatcctttgtatcatcagtgaacaatgagacagacctgcacatcttggcaaaaaaagctcttgtgcatgtccccagagtacccgctacccaatccagcatccagagtccaaccactccggacccaggaccaactgctcaggttcctcccagacccaaggctcctggcccactgagagtgggagaaaaaggggtaacctcactctgggcaggaaggaaaattccatgctgccctagagcactgtggtgccagcagcatcatcctccacagtcccacagtgtgcaggcggggaagagactaagagaatcacggaagagagaaggaggtcaagaatttaagagaaaagaaaacagttctattagaaccctaaatgccttgtaggaacctagtaaagtcaccagatgcacctacacttctcccagagacttgcattgttgattcctgattctttgaagtgtgggcggggttccccaaatggtcctcctaagcccaccatctggaaataatttattgataagtgcattttgacaaaaagtattccattcaggtggagaagaacacagcctctcttggaagggggatgcagctccagggcaggctctcaaaggctgtggggtgggcgggtcattgcatatactctggtctttgcacttggggagaggagggatggtaaaaaccaacggcctgaggtctggcatcatgcccactgcccaggtgtttccctacacccacccagctccctgaatcacaacagctaattttactccctctagactctagtagagctgggtcttctccttctggctacgaaatagaaagtgccccgcaccccaacacacacaccccaatctaaaaaaaatatatatccttgaaaccatttccccatcagcccatcttcacatctgcaatgccactcctagaaattcagtcctttgggtcttgaagggttttagttccataagttccagggaggggtctacctcaaccattgacaactcacatctcctgagaagtttatccaaaactttccaactgcaatcatcggcgaacaaggtccctcaacaatgggaccccagttaacgcgaaggaggcagagcgaggtaaggagcttaaatgaggagtatggagtaggaacaagtctgcaaagcccgcgccccagcttcgcctgggatggccaggtctggcactcgcgggccgccttccccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccagcccccacccagaactcccaccctcggagccttgacttccagggcccgcgcctggacaaaagcatggggcgggctcactcacccgcgcggcgaaggcggcccgggagccggggcaccggcgctcggcggggcgccccggccgcaggcgcacagcgcgggctccgagctcgctcagcgccctgctgccgaccgggcggcgcggggagcccgcgaggcgcgtccgggactgggcagggcggggcggggcggggcggggcgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtcttggtgcgtgtcttagtcctacactgggagacctaggccttaggtcggggtctgatgctagcttcgtgagcgtgcatgagacactggctgcctctgggcctcagttttctaatctgtaaaatgaagatgtcagcggaaccatggggctaaagttttagtgctggaaggttgtctatgtagtttttttcagacatcctccagtggtgcaactcagccccatggttcctctgacatcctccctttgtgtgtgttaagaatctctcattggtttggaagatacctacaaagttctttaaattaaaaaaggggaaaggggaggggggggaggggagggggaggaggtgtttctggttttggcttgctttatatttagtttgcacccaatatgaaatattttatagcttctgatctcttcacttggaccttcttttgttttttttaaaaaaactgtttactgcaggttaaggagtgtttttaaaaattttttaattgtaaaataaaacataaatacagaaaaccacaaaaaacaaatatatagatatatagactagtgaattattataaagggaacatccttgtaatcaccacctggatcaagaaatagaactctgccagccaccccaggagcctctccatgtgccctacctcaatgacaaccccctttctccctcctcccaaaagtaaccactaacctgactttcatgtagtcacttctgctgcttttgtttttcttggtatcttccaagggtgcaccttacccctccccccactctttttttttttaatttgatttgccttttcagtcttttccttacaattatttgttaaataacttaagcccttgatctgtgaggttttccagagtctgggggttgcacattcatgaggcaattcagcatgtttctctgtcctctgtattgacagcaagttggcagctgatccagggtcttcctcagactgaagtttgatgtcttttgtaagattatagatggttgtgtgttcttttcttcaagaggtacatgatcatgatgtctggtgtttgctcttttttgaggttaacagccgtcgatgctcaattcctagattcattaattaattgaagtttgcaaaatcatggtattctaataattttgttttcatttattagttcataagtggataaggagatgcttcctctcatctactatttgattaccctgagataggaaaggcacgatgaatacctgcttttttttaaaaaaattacccagttttcaagttaaggaattgattctctgtcattcttagatttctttaatatcattataaattcatgaatttaaatatatttgataggtttccatctacgatattagagctcaaattgtcccatctttggccagtaggagcttcttcaatatggctcctggctccttttgataagattctagtagtctttttttttttctctctctctctctctcactagtgtgcaaagagcttcaaagaccctagaagtctttgatagcttccttgctatctgatatgacaagatgttccaggcacatctgtacatttgctgcctcaaacctggaatcagccatttctccaagaagctctagtttttttgttttttctttccttccttccttctctctctctttttctttctttttttctttctttctttccttctttccttctttccttctttctttctttcttttctttcagatggagtctcactctgtcaccaggctagagtgcagtggcacgatctcggctcactgcaacctccacatccctggttcaagggattctcctgcctcagcctcctgaataggtgggattataggcacgtgccaccacacccagctaatttttgtatttttagtagagacggggtttcatcatgttggccaggatagtctcaatctcttgacctcgtgatctgcccacctcggcctcccaaagtgctgggattacaggcatgagccaccccgcctggccagaagctctagtttcttttgttgaaattttaagataacaatatgagcactaggagtattcattgttactaggttggtaactgtttctaggccttttcaatagacagagctactaaagaatacttcatttttttatattctagagaaatattattcttcataatattttcatcagtttatattatttccaatttaatttcaggactgtagtttttacttaacatatattacattaggacctcttttctttcatgtagagaattctggttctcaaggacaaaagggaggatgaaattagaatatcccaatttactaatttgctttagtttgcattaaacatataataataatctcagaataacaatattaatactaccatcatcagttttgattcttgaaaacagttttttttgcatatgctatccatcttttatagttatactctatctaaattatcagcttctatagccatctataccataatcttcctatttaaccctaatttagtcttaattttacagttctacaattctaatcctaattaaagttcaaatatatatttaatgcttaccattagttccttatgtttatgtatctttagtcattttggttgtctgaaagcttgtcctctactagattccttaggaagggctcatggaaagaatatgctctgagttcttgcatgttgcttacagtttgttcatgccattttacttgaaggtcaattttgttggattcaaactacttggtgtcttggtccagctgggttgctataacaacaacaacaaaaaaaaaaaacacaaaataagtggcttataaacaagaaacattatttcttatagttctgggggctgggaagtccaagatcaaggctccaacagattcagtatctgttgagagccctctttctggtttgtagacggcaccttctcactttgcctagatgcccaaataactttatctttttctttcaaatccagtaattttattagaatgtttgttggtcattctagtttgaaagtaaacagtgtgtatttctttcaaaatgtggtttcaaatacatatattttgttaatttcaggaaaattttcttcaattaaagtcttaaatatttgttctgttttggattgctttagactgcttctctggagacttctattatctgcatattgaaccttttttgtctatcttcaacatttgtcactttcccttaaatctttttaatttctttcttcatttgtttttaagtttataaatttccctcctttttaccttattttcttttaagtttttattagttatatttatgtgttcttgtgttccttataggtcaatctttatttctcaaatgctttttaaaatgtttaattccaaaaaaaaataaaaaataaaacgtttaattcttctgtgagttctgttctaatttctgagtttctctaattctgatgtatgttgttctttcatgtttcatgtcactcagtgtgtattagcttttctaggacattatagctttaatttttttgagaatatctttctggaggttattatgatctttattcactttgttgtagtagctatatgagagttgaccttagtattttttttgttgatcatttttacatgaattttgttttcttgaacttttaaaaggagatttggtccagacagtttttcaaacttcacaaagctttcccgtttgttgtttctgagtagtgtcaaaaaatatatatggtggctggacttctaagatttcctggctctgtttccctcactcacttttatctggctcttctttttctttcaacttgcattagtcagttttcacactgctataaagagctacctgaaactgggtaatttatgaagaaaagagatttaattgactgacagttcctcaggcttaacaggaaggatgactagggagcctcaggaaacttacaatcatagcagaaggtgaaggggaaccaagtgctttcttcatatagtggcaggagaaagagagaatgcagggggaagtgccatacacttttaaaccatcagatcttgtgagaactcacttattatcatgagaacagcaagggggaaatccacccccatgatccatgatttaatcacttctcaccaggcccctcctccaattcaacatgagatttgggtggggacacaaatccaaatcatataattccaccccaacccctctcaaatttcatgtcctgctcacattgcaaaatataattatcccttctcaatagtctcccaatcttaactcatttcaacattaactcaaaaatccacagtctaaagtctcatctgagacaaataaatcccttctgcctatgaacctgtaaaatcaaaaacaacttagttacttccaagatgcaagggggatataggcattgggtaaatgctaccattccaaaagggagaaattgcagccaggtgcagtggctcacacctgaaatcccaacaatttgggaggccaaggcaggtggattacttgaggtcaggagttcaagaccagcctgggcaacatggtgaaaccctgtctctactaaaaatatttttaaaattagccaagtgtggtggcacgtgcctgtaatcccagctacttggaggctgaggcaggaggattgcttgcactgaggaggtagaggctgcagtgagccaagatcgtgatactgcactcctgtctgggcaacagagggagacacaatctcaaataaaaaaaagggagaaattgaccaaaacaaaggggctacaggcctcatgcaaatccaaaactcagcagggaagtcattaaatcttaaagctctaaaataatctcttttgaattcatgtctcacatccagggcatgctgatgcaaggatgctcttccaagtccttgggcagctccaccccagtgggtctgcagggtatagcccctgtggctactttcacaggctggcattgagtgcctgcagcttttccaggtgcatggtgcaaactgttggtggatctaccattctggggtctgaaggatggtggcctgcttctcacagctccactaggcagtgccacagtggggactctgtgtgggggctccaactccacatttcccctccacacaaacctagtggaggttctccataaggcctctgcccctgcagcagacttctgcctggacacccaggcatttccatacatcctctgaaatctaggtggaggttcatgaattagtccattttcaagctgttgataaagatatacgtgagactgggaagaaaaagaagtttaatggacttacaatttcatatggctggggaggcctcacaatcatggtggaagtcaaggcagagcaagtcacatcttacatgaatggcagcaggcagagggagggcttgtgcagagaaactcccatttttaaaaccatcagatcttgtgagacccattcactatcatgagaacagcacaggaaggacccatccccatgactcaatcatctcccaccaggtccctcccacaacacatgggaattatgggagctacaagatgagatttgggtggggacacagagccaaaccatattattctgccccggcatctcccaaatttcatgtcctcacatttcaaaaccaatcatgccttcccaatagcccgccaaaatcttaaatcatttcagcattaactcaaaagtccacagtccaaagtctcatctgagacaaggcaagtcccttccacctataaacctgtaaaatcaaaagcaagttagttacttcctagatacaatgaaagtacaggcattgggtaaatatggccattctaaatgggagaatttggccaaaataaagggactataggccccatgcaagtccgaaatccagcagggcagtcaaatcttaaagctccaaaatgacctcctttgactccatgtctcacaaccaggtcacactgatgtgagaggtgggttctcatggtcttgggcagctctgcccctgtggctttgcaggatgtagcctccctcttggctgctttcatgggctggcattgagtgtctgtggttttccaggcgaatggtgcaagctgtcagtggatctaccattctggggtctggaggacagtggccctcttctcacagctccactaggcagtaccctagtagggactctgtgtcggggctctgacctcacatttccctcccacactgccctagcagaggttctccatgacttccctgcccctgtagcaaacttccacctgggcatccaggcatttccatacttcctctgaaatctaagtggaggtttccaaacctaaattttttacttctgtgtacctgcaggctcaacaccatgtggaagctgccaaggcttggggcttgcaccctctgaagccacagcccaagctctatattggccccttttagccagctggaacagctgggacacagggcacctaatccccaggctgcacacagcacagggatcctgggcctggtccatgaaaccacgttttcctcctaggcctcctggcctgtgatgggaggggctgccacaaaggtctctgacatggcctggagacattttccccattgtcatggggattaacatttggctcctgttacttatgcaaatttctgcagcaggcttgaatttctcctcagaaaatgggattttctcttctattgcattatcaggctgcaaattttctgaacttttatgctctgcctcccttataaaactgaatgcctttaacagcacctaagtcacctcttgaatgctttgctgtttagaaatttcttctgccagataccctaaatcatctatctcaagttcaaagttccacaaatctctagggcagtggtaaaatgctgtcagtctctttgctaaaacataacaagagtcacatttgctccagttcccaacaagttcctcatctccatctgagaccacctcagcccggatttcattgtccatgttattatcagcatttttgtcaaagccattcaacaagtttctagggagttccaaactttcccacattttcctgtcttcttctgagccctccaaactgttccaacctctgcctgttacccagttccaaagttgcttccacattttcaggtatcttttcagcagcaccccactctgctgttaccaatttactgtattagtccattttcacaatgctaatatgctaataaagacatacccaagactgggaagaaagagaggtttaatggacttacagttactcatggctggggaggcctcacaatcatgatggaaggcaaggaggagcaagtcacatcttacatggatggccgcaggcaaagagagagcttgtgcagggaaactcccatttttaaaaccatcaggtctcgtgagacccactaactatcttgagaaaagcacaggaaagacccgcccccatgattcaatcatctcccactgggtccctcccacaacacatgagaattatggaagctataagatgagatttgggtgaggacacagagccaaaccatatcagttcccaaaaactcaactcttgccttctgtgcacccccaggcccaacacaacatggaagctgccaaggcttgtgggttgcaccctctgaagcaattgtctgagctgtatcttggccccttttagtcacagctgaagctggagcagctgggactcagggtgccatgtcctgaggctgcacagagcagccaggccctaggcctggcccatgaaacatttttccctcctaggcctccaggcctgtgataggaggggctacagtgaaggtctctgaactgccctggagacattttctccattgtcttcaatattaatatttggctccactcatgcaaatttctgcagccagcttgactttctgtccagaaaatgggtttttctttactaccgtatggtcaggctgcaaattttctaaactttcacaagaacagcacaggggaaatccacccccatgatccaatcaccttccaccagccccctcctccaattcgacatgagatttgggtggggacacaaattcaaaccatttcacaactcttccctgtcatgttaattttttcacttttttattgtagcaaaatatacataacccaaaatttataattttaaccattttttttttgagacggagtcttgctctgttgcccaggctggagtgcaatggtgtcatctcggctcattgtaacctctgcctcccagtttcaagtgattctcctgcctcagcctcccaagtacctgggactataggtgcgtgccacaacacctagctaattttttgtatttttagtagagatggggtttcaccacattactcaggatggtctcaatcacctgaccttgtgatccacccaccttggcctcccaaagacctggtattacaggcatgagccaccgtgccctgccaattttaaccatttttaaagtatacaatttagtagcattaagtacattcaccatattgtgtaactatctatttccagacttttgtcataatcccaaacagaaactttgtacacattaagcaacatctcccatttcctcttccctccaacacctggtaacctttattctactttctgtctctatcattttgcctattctagataccccatataagtgtaatcatataatatttatccttttgtgtctgtcttatttcattcagtgtaatgttttcaaggtttatccaggtagaatatatcaaaacttcatttttttatagctgagtaatattcatatctagcattattttgtttatccattcttctgttaatggacatttgggttgtttttacattttggctattatgaataatgcataatatgaatattggcatatgagtattgtttgaatgaccattttcaattcttttaaaaataaaacatacttaggaatgaaattactgagtcatatgtctattttttttaacttttttgagaaaccaccgaactgtttcgatggctgtaccattttacattctcaccagcaatgcacaagggttccagtttttccatattctcattaatatatattattttctattttttgatagtaataaacttagcaggtataaagtggtagtccattgtaattttgatttgcattaccctaatgactaaaattgtggagcattgtttttgagtatcttctttggagaaacgtctatcgaattccttttcccattttaaaattgggttgttttgttattaaattgcagggttctttacatattctgactattaatccttttctagatatatgattagcaaatattttctctcattctgtaggttgctttgttgtctatgttattgatgtcataccaaagaaactattgctaaatccaatatttcataaaaattttccctatgttttcttctaagagttttacagtttagctcttaaatttaggtctttcatccatcttgagttaatgtttgtacatggtataaggtaagggtccaactttattcttctgcatgtggatatccagttttccaccaccatttgttgaaaagactgttgtttacccattgatttcaaacctcgttgaaaataggctgaccatataatgcaagggtttatttctagactctccatt

SEQ ID NO: 1294 - DNA, 58959 bp, Homo sapiens
tccctcttgggtaagatatccaccaaagggcaattgtaaaggtcagatgaggtagcatataggaaagatacacatgaaaatgatttgctagtgcaacatctgatagtcaaagtgttatttttatttttctggaaataaacaaatgatttgaaaaagtatcatgtggtgagcaccagatggataatgagacaagtttattaaacatcttaaactgtgcagtcagtgacaaaagcaagtgggaagcaactaaagatgttagagctgggaaagccgcctcatctggtcaaagtcaggaggagcaaatccctctgagccaccagcccgtttgcccacttggctcgaccccagctgacagcccgtgcaggagttattgctgcttgggagacttgagattttggccagtagcattcttttgtaatcttctatgtgactgtatccgcccacatttctgactcagaatgaacagggaaaggcgctgctggcagctgaattacctcaaaacccagctccagccaaccctttgaatagtgatgagagcaatgtgctcctccacacatcacctaaatagggaggcccatttgttatcaccacttggcagatgaaagtattgtttcacagcggttaagtgattaggcctggataagcaagcagaatttcgaacccaagtagcctgaccgtgggccttgtgctgttagccctgaggctgctttagggaccagagattacgttattaggcaaatattaaataaactcagtgcatttagttgccttcccaccctcagaaagcaacctggactcaaccactttattactgatttatttatatcactctattttgcagatgaaaagcatcattgagtatctctccctctctctttttttttgagacaggattttgctctgtcgcccaggctggagtgcagtggtgcaatcatggctcactgcagcctcgaccccctgagctcaagcaatcctccttcctcagcctctcaagtagcttcagtgattctatttttagtacttttagtggtcaccccacacctctaaaggaaggtttgggccaagcatggtggctcatgcctgtaatcccatcctttgaaaataaactcaccctcatagctcagtaatttgttgctgctgagatgattgaaaagaatggaccttgagttcgaactgttcagttgtggttgtcacttaaggtccagcttgctgggcttctctggagtgctgaggcaaggggtgccccgccctatccaaaatctgtgttatgagtcagaaggcagagacgccaaaagtccatggggcaattcccaggaggagggcctgctctgagtgacatgtcctcttggttctgtggactcctcacctggagggggcatctgaagacagaatccaggacagtaagtcccaatgaggagttccattcatggtgtggcaagtaagctccaactggactgatctccgggcagatttcaactgttaactccgggggaaaaaaaaaagcactggagattaaaaaaaaaagcaggcagattctgaagaggagtcgacacttggaagaaggaaatggcacaggatgaatttctcctgtttttaatttaaatttttttcttttctattttaaaaatatttatttatttacttaaaaaaattaaggtgcggtctcactatgttggctgggctggtctcaaactcctgggctcaagtgatctgcctgctcagcctcccaaggtgctgggattacaggtgtgagccactgtgcttggcctgtcttttgacttttaaaacctatcctgaacatttttccatgctgctgctttttttcttccccctctctgtcgcctagggtggagtgtaatgacataatctcggctcactgcaaactccacctcctgggttcaagcaattctcctgcctcagccttctgagtagctgggattacaggcacgcaccaacaggaccggctaatttttgtatttttaatagagatggggtttcaccatgttggccaggctggtctcaaactcctggcctcaagtgatccacccacctcagcctcccaaagtgctgggattacaggtgtgagccacagagcatggccatgttttccccccatgcttctaaatattatatatatatatatatatatatatatatatatatatatatatatatatatatatatatagacaggacctcactctgttgcccaggctggagtgcagtagtgcaatctcagctcactgcagctatgacctccccagactcaggctatcctcccatctcagcctcctgagtagctgggactatagacatgcaccaccacacccggctaatttaatttttttttttttgtagagacagggtctcactatgttgcccaggctggtcttgaactcctgggctcatcttccagagttgctgggattacaagtgtgagccactttgcccatccatgcaatatcattgttggtgactgtgtatcagtcacaatatgactagatcgtaattgattattaagtgtgttagccttatattttacacatgaatcacaagcatttttctcagttggtttccgctttataactttatggtgagcctgtcctttcattagttggctgtggtccagtaaaaaccaaccaccatctctctgggtaaacatctgataaatggtgtttctcatgtgggcagggtccatgtcttttttgtttatcactgtattgccagtgcctagcatagcacctggagtgaaagaactactcacaaaatttgtgtgcgggtccggtggctcatgcctataactccagcatttgtgaggccgaggcagatggatcgcttgagcccaggagtctgagaccagcctggacaacgtggcaaaaccccaagtctacaaaaaaatacaaaaattaagctgggcgtggtggtgcacaacatgtagtcccagcttcccaggaggctgaggtgggaggattgcctgagtctggggaggtcgtagctgcagtgaactgagattgcaccactgcactccagcctgggcaacagagtgagacccagtctcaaaaaataaataaacaggccaggtgtggtggctcatgcctgtaatcccaacactttgggaggtggaggcaggtggatcacctgtggttaggagtttgagaccagtctggccaacatggtgaaaacccatctctactaaaaaaaaaaaaaaaatacaaaaattagccgggcatggtggtgggcacctgtaatcccagctaatcaggaggctgaggcagaagaatcacttgaatgggggaggtggatgttgtagtgatccgagatatcacttcattgcactccaacctgggcaacaagagcaaaactctgtctcaaaaaaaaaaaaaaaaaaaaaaaaaatatatatatatatatatacacacacacacacacacacactatatatatatacatatgtatacacacatatatacacatatatatacacatatatatacacatatatatataaaataaataaaatttgtgttgactaacacaaattgatcatgtttgattgactaacttgtgacctgtgtttaaggcgaagactcaggttaccatcactggttgctggcctctgttagtctgttgaatagcttttaatttagtaattcatgccctttgacctagtaattccccttctagagtctatccgaaagaatttttcagagatgcacgcaaagatttatgtataaggatgatcattccagttttaagagtgaaaaattctaaataatttctagcaatatgaaaataatacgtaattacaacataaacattaatatggggtttttgaatgttttgatgatgtgaggaagttcttatgatgtcatggcatatacaaaaccagaatgtaaaattgttcgtaggatttctcaactctgttaaacttagcatgaaatacacctaacacgtgttgtgtgggttgggaatgatttcagcaccaaggaacagaaaacctaactcatggtggcttaaacttagaggggttaagttttctctcattggctgggcacggtggctcacgcctgtaatcccaacactttgggaggctgaggcgggcagatcacttgaggccaggagttcaagaccagcctggctcacatggtgaaatcctgtctctactaaaaatacaaaaaattagccgggcgtggtggcggatgcttgtaatcccagctacttgggaggccaaggcagaagaatccatgaacctggaaggcagaggttgcagtgagctgagatcacgccattgcactccagcctgggcgacaagagtgaaactccatctcaaaaaaagaaaggttttatctcatatgtagcctgtagtctggaggtggtggttgagggtctgatggcagcagtgtggagatgtcagggccggatctctgcgattctcttttttttttttttttttctgagaatggagtctcgctatgtcatccaggctggagagcagtggcgcaatctcagctcactgcaacctctgcctcctgggttcaagcaattctcctgcctcagcctcctgagtagctaggattacaggtgtgtgccatcatgctcagctaatttttgtatttttagtagagatggggtttcatcatgttggctaggctggtcttgaactcctgacctccagtgatccccccgcctcagcatcccaaaatgctgggattacaggcatgagccaccgtgcctggcctgcgattctcttttcttaatggctgggctgccataaagaaaattgaggcctgctccagctccaggatgactgcacttgagtcaggaaggaggagggggacttgtacggtgcctgcagtgtctgtccctttgatcaggaacaccaagagcctaccaaggtgccccagcagatgttggcttatttctctttgactggaattgtgtcctgtggctaccgccagctacaggagaacccgggaaagtgagtatttaacatcccagtctctagagtggaggcagcaatggggaatcggtgggaatatctattaggttagctgataaactaacatttcatttccattttacttctttcaggctggtgggtttatgggtgtttttacttttcttctttattttttctgtctcatgtaatttttctacaacaagcatttctaatttctgttgttgaaaaaatatgacagatactgctttaaaaatcctttgtgaggttgtgggctttcatttctggaagcgttcatactatcatcagtcaaatttgtggagaaggaaggaactgttgaattctgtgggggttggattgacacctctctctttcccagtagactatgacatccccagggaatgggtgggtggggaaatctatgatttgtttagctcctgtcaggtactgtgttagttacttggcaagcaagcatcgtctcatctaattctcatagcagccttccttttacagacaagaggaagacaggctaaaaaacttaatcaggtcatacattgggtgaaaggaagctggatctcagcaccaggctttaattttgtaggttcctgagacatagtaatctcaataaagtgtgtgttgaatgaatgtggagtcaatgaatcccttggatgtgtaagttttttaaagaaaactgcagcggttccgtgataattatttcttgtagagcacccattcattttaacttgcgcaattgaaaaataacaggctgtagtaaattgcctgcaggagaggaactctgtgcacactttcctgtatctaaaatccttgcctaattgccggatgtaaataatgagtatgactcctgtatgaaaagacagccgaagatttgtttctcatgaggtctctgaagttttttattatgaaaaaattccaaatatattcaaacagagagagaatggtagtatgaactccaaggtacgcatcacccagcttcaagaagcatcactattttgctaacttttccatttgtctccccgctcccacttttttttattagactaaagtactttaaagcaaacccaaagactaatttcaccatgaaacatttgatatttattccaatatttattttattccaatatttataattggaataaaagggattttgtgtggccctgcgtttttctttctttagatctgcaagtacaggaagcgatgatgtaaaaatcgtcccagggcacgtggacttctggaggcccaggtgaaaagaggcatattcctcacaggctatgcaatttgtttttcccttagctcctctggctccagccgtaatactttcctcaaatgctgaaaattaaatatctggcctctcttagctagatttctggggagtgcttcttttgagactatttttggcatgaaaatatcactcaagttgcttgaagttatttggaatttttgaagtatgaaaagcatctcactagagccatggttgaggctgagtgggtagagttacttattacacaggctatcatttcccatccagcttcttgctttctgtgcccatctgtttaatggttctaatgctttaggatggccgggcgcggtggctcaagcctataatcccagcactttgggagtctgaggcaggcggatcacctgaggttgggagttcgagaccagcttgaccaacatggagaaaccccgtctctactaaaaatgcaaaattagccaggcatgatggcacacgcctgtaatcccagctactcgagaggctgaggcaggagaatcgcttgaacccgggaggcggaggttgcagtgagccgagatcgtgccattgcactccagcctgggcaacaagagtgaaactccatctcaaaaaaaaaaaatgctttaggacaaggactgcatcctggttgggatgtgaaaggtgacccaacaggtgtggaggaggagtggctggtggccagtagaggggaatctgcctggctggccagccttccttccagctgtgtgccctgcctaggctctctggaaaagtccagaatgctgggaggtccatggagagtttctgaaaatgctgggattgtcggtgtctcttagtccatgttgtgttgctataacagaaaaccacagactgggtgatttctttatttatctattttgagacggagtctcactctgtcacccaggctggagtgcagagtgcaatggtgcaatcttggctcactacaacttccacctcccaggctcaagcaattctcctgcctcaggctcccgagtagctgggattacaggtgtgtgccaacaggcccagctaatttttgtatctttagtggagaaggggcactatgttggccagtctggtcttgaactcctgacctcaagtgatccatctgcctcagcctcccaaagtgctgggattacaggtgtgagccacttcaccagcccagactgggtgatttataaagaaatttaaggctgggcgtggtggctcacgcctgtaatctcagcactgggaggctgaggcgggtggatcacgaggtcaggagatcgagaccatcctggctaacacggtgaaaccctgtctctaccaaaaatataaaaaattagccgggcgtggtggtgggtgcctgtagtcctggctactcaggaggctgaggcaggagaatggcgtgaacctgggaggccaagcttgcagtgagccgagatcgcgccactgcattcaagcctgggcgacagagtgagactctgtctcaaaaaagaaaaaaaaaaaaaaaagaaatttaattcttacagttctggaggctgggaagtccaaggttaagggaacatatctggcaagggtctttgtgctccatcatcctgtggcagagggcgtcacatggtgagagagcatgggggcagggggaaaaactcatccttttatcaggaatccatgagaattacccactccaaagatcactaacccactcccatgataatgatacatcatggatcaataattcactcatggccgggcgtggtggcttatgcctgtaattccagcactttgggaggccaaggtgggtggatcacttgaggtcagttgttcaagaccagcctggccaacatgaggaaatgctatctctactaaaaatacaaatactatctgggtgtggtggcagatgcctgtaatcccagctacttggaaggccgaggcaggagaatcgcttgaatctgggaagtggaggttgcagtgagccgagatcatgccactgcactccaggctgggtggcagagtgagactttgtttccaaaaaaaaaaaaaaaggaaaaattcaatcttgaaggcagagccctcattagttcacttcatcatgtcttataagaagcaacactgttgcactggggattaagttctaacacatgaactttgggtgacacattcacataaagtgtttgccgagacctaatcatagactctagagtgcttctcctccctcacacctcactgtcacatcactaaaggcccatttacaacagttcctttttatgccatgcctgccttttaacaatgaattacaaggcatactaaaaggtaaaacacacggaagagacagagcaaacattaaaaccagactgagatatgccaagcatattggaattattaggcccagattttttttttttaatttttgaggtggggtctcactctgttgcccaggtgggaagttcagtggtgccatcacggctcactgcagcctcgacctcctgggcccaagcaattctcccacctcagcctcccaagcatctgagaccacaggcacatgccaccatgcctggctagtttttctttattatttgttgagaaagggtctcgccatgcttcccaggctggtcttgaactcctaggctaaagtgatcctcctgccttggcctcccaaaacgctgggattacaggcatgagccaccacacccagccagaccaggaattttaaaaaattatgattcatatgttaaggactccaacgcactagaccagggactggcttctgcccccaaactggcttgtcagcaatcacaaagctcacaacatctccagccccatgaagcgcagcttgtagcttcttacagtgcatgtgcaaattgcacaaacagggatgctcatatcatgttccaccaaggccaacaggctttcctatgtcattgaaatttgtgacatattttcattgacacaccaaagaagccaagactttcctctgatgttggaagtgttaagagtgggaggatgggctaggatgatgtctttttgtttactacatattcataggaagagaaaagcaaaagaggatgaagttctgggaagtaataaaataatctgtctgggcagggaggctcatgcctctaatctcagcactttgggaggccaaggcaggtagatccgcttgagctcatgagttcgagtaacatggtgaaactccatatctacaaaacatacaaaaattagccaggtgtggtggtgtgtagtctctgatactcaggaggttgaggcgggaggatcgtttgagcctgggaggcagaagttgtagtgagcagagatggtgccactgcactccagcctgggcaattgagccaggccttgtctcaaaaacaaaacaaaataaaacaaaaacttagtgtccattggaaggaccctcaaaatgatcttccagccttctggttttacagatgggaaactgaggcccagaaaaggaaaagtactgtgcaagaccacacagccagtggatggtagaggggtgcttcaaaccagcggtgtttgcctccgagatctgcgtgattccccaaactccagtcaggtctccctggtccccgctgctccctgcagaggtctcatcaaacgcctggtctgcctgcaccatgcagcctggaaggtgagccgctgggggatatgttacccaccacgtcttgatacgtgcagaggtggggtatgtaggggtgactcactttatccttcagttcagaagccattgcagaaatcagaggcaggtgttactttgtggtgttgggagtatagattatgtttattttctctataatttccagggttttccaaaattttacaacaaacatctataattttatgaacactccccatcttatttttaaaaagaaaaaagttggggggcagagaaatgcccagctcagtactgagatccatcaagtgaggccagccggtatctgtcacaccaggcagaggccccgtgctggaagccctggaggttaccagctccaagcctggtatccaaggcctcctgggcagccttagcctcctccttccctttcctcccaccagaccctgctcctgggatgtccttctcccattaccaccacaaaatcggactaatttttcagggcccaacaccaattctgctaatttttttttggctcaatcttggctcatcacaacctccgcctcccaggttcaacggattctcccacctcggccttctgaatagccgggattacaggcacctgccaccatgcctggctaatttttgtatttttagtagagaccgggtttcgtcatgttggccaggctggtctaaaactcctgacctcaggtgatctgcccgccttggcctcccaaactactgggattacaggcgtgagccacctcgcccagcctggatgaaggtgttttcaaagccctacctccccctgttgggacgaccctctgtctccctccttggaccactggcggcactttccttggacctgctttataatctttatcatgtcctgccttgtcctggagttgtttgcgcccaggtctgtttctcccactggactgaggcctctttgcaagcagaacctgcttatcagctgcctttgtgttcccagctccatcctcagcctcccacatgctagacttcaggtgtctgttgaacttacatgaattgaaactatgggatcctaaaagaggggtgcgatgtatcagtttatggcagggctcatggcccttggcacttttgacatctggggtcggataattctatgtggtgggagctgcagtgtttagcagcgtacctgacctctacctatcagatgccagtactgttagatagccccagtgcatccgggtctcctactccaggtccagggttcatcccgctctcctggaagccactcaggaccccagaaagatctttgcttctccactttggtgcatccgctccacccccaccctcacatcctgggttctatcttgtcccctttccttctgccccacccctgtagcctgtgccaggctgtgaccctggtacaggttgtccctactggtccatgtagactagactcagactgtgcctggacacacgctgtcacatgctcttcagctccttgggctcgtccccgtgcttgaacacactgatggtgacctggcccgtctcggagccatacttgttcttgacgaagacgccgtagcggccgctgtcttcactgttgaccttctcaatggtgatggtgacctctgtccccctcacttccatgcggtatcggtcaaggaaggtgacaggctggtcattcttcagccaagagatttcaggggtggggtctcctgagacgatgcaagtcaagcacagggtctgtttgaaaagacaggaagggaacagtctcacctccttgtaacttgaacttagcatttgctttcatgcccccagagagctcccagctcaggttgctccctgtgataatttagtacatgtgttttattataatttataaaggggagagattttattttaaccccacatccttcatcctcaaccttttattttattttgagatggagtctcgttccatcgcccaggctggagtgcagtggcatgatctcggctcactgcaacctctgcctcccaggatcaagtgattctcctgcatcagcctcctgagtagttggggttacaggtgcccgccaccaagcccggctaatttttgtatttttagtagagatggggttttgccgtgttgatcaggctggtcttaaactcctgacctcaagtgatctgccctcctcagcctcccaaagtgctgggattacaggcgtgagccactgtgcccgggcattctcaacctttctacaggaatacttacccatcagaatctcagaccataattactctcgcaattatcggtcccagaatggccttcactttgttttattgctttttgtaatatatatgtcactacgattttacaatgcaagtaagattatatagatttagtgcataggtttatgaattaaaatagaaaattactgaacaagctctaatgcagagcactataatgtaattattaaacacacaggctctggagttgggcttcctgggtgtgaatctcagctctgccccttcaagctgtgtgaccttaggtctcttaacctgggttaagggactctgggtttcctcagctataaactatgattagtaataaataaaaccctatttcatgtgattaccttgatggctaaagaagctcaaaaagataatatacatggaatcgtgcctgacaaaaagtaagcaccatcaataagtcagcaattgttttcaggaacactagatttacataaataagttcagtcctagacgggcttttagggatctctcagtagacatttcttttggacgctgaagtccgcaggtagaagtctaggatgcccagggctgtctagacagatggagatagaactaggtcaagtacccactgagggctgacaccaggcccagtgactttcctttgtaccacatgtcatcaatgaggtgtggtcacttggccactctttggctttgaatccatggtgctgcattgtttcgtgatctgtggtggatgcacgaaggaacacagagggggactgctggctgtgggctgggaagggtcagtaccttatcttccatgatagtggccacatccggcagacctctcaccactttggcacgatctggaagggaaataagagaccccagcgatgaatccttttctgccagccgcttcccagaagtttcatagagttgaggtttatttttaagcaaggcttcttttttttcctttttctattttcattattttggatggaaatcttttttaaatttttttttcaaaattaattttttgagacagggtctcgctctgttgcccagggtggagtgcagcagcacgatctcagctcactgcaacttctgccttccaggctcaagcaatcctcccccgctcagcctcctgagcagctgggactataggcatgcatcagcccgcctagctaatttttgtatgttttgtagagacggggtttcgccatgttgcccaggctgggcttgaagtcctgggctcaagcaatcctcctgccttggcctcccagagtggtgggattataggcatgagccgccacacctggccttggatggaaatctctagaactgtattacatgcttctttgtattcataagtagaagatatgggacatagtgtttttctgccactgatctgaggtcatttgctatgattggtggtacctggaggtgaccatgagatgctcctgccctcaagaaccaggaagaaggtaagtgggactctgagacttcaactggcaaaatccacacaacgggtgtgaccaacaaggtcagagaaagcaacagaaccttttgcttttgtctgaaaaaacagaagcttttgggacactttgaacctggtcaagcgagggacctggtggccattgtgggtggccaggaagagtgtggttgtcaaccactaagcagaaatctggtctactcctcatggtgcaggggaagctgtgggaacaggacgggtggtcagcacggcctagaccagggatcagggatgtgcaaagatcccgatgcggatggtgtctgtccagtgggtgaaaggggagcaggaccccagatggggaggggaaggccccacagatggatgcagttgtgggcagaaagtgtcaccaacccttcacagctggacaaaatgattgtttccttcagctctgatgccacatgccccagcaacccagtattggtgaattcagctttcctctattagggtcctggacggggcttctgttcaggatgacgcattccactatgggcagggacattctcactgggtgaatgattagattcatggtacaagagcctcctcgtggcctgaggctgaggctggtcttgggctgtgctccctccaccgaggcgcccctcagccccctgcaggagcttctcactgcatggccacttatacccctcaattgccccttcccaataacagctatgagcctgaggcctgcacttcctgtcaagtggggacactcggggtcaatgatgccacgcagagcgaattatcccctcccacacatggcctcaagctggcggtgtgagttttcttgtctgttcttagagctgtgctgtctccttctatggccacacctgtgctctgctgcctgcccgggtctttccctcactgaaatccttactcctcatctgctgggccagtgagagcagacagccagactcctaccaccaggccgcttagaactggcttgggttgggaggtgatgaatgggacaagctcgagctcatggacttggtggtggctccccgggtggcccggaggccgtgccatgtgcctctgggtttggggcttcatcctggattcgatgaggctccaatacctcgagagccatagcttcagctttaaagtcaccccatccccacagatcactcgggaaggcctgcccagcctcattcctgtctgtcccctccttttcggtcccaccaatgtagtccatgtgcctgcgagaaccaggctcgcgctggatgcttccacaacacaatcccaggtgtcctcggattctgtctctgtcttgcccaggtcttccctgcagctctgtaagaccctagagccccacagaccccactgtggaatgaggccttcagcagcccaccaagagggttgagcttccaggaagtttgccccaaattcagaaacaaaaacaacagaaatatcggccgacttactcttctcgatgatggccaaggttctgaaaaacagaaatgggaacaaggtgtgacattccacttgctaaaggacagtccagcccaggtggaggtgaggggtgatgaaggaaaggtggagctggctggggctcccaggaaggagtcctgagcctagtttatgccacaccctgaaggggcctataattcacactgagaaatgtagaggaaacttacttcagtctctggtgttcagccattgcatcctcaaaagctataagaaggacagaggagaatgggggccatcagggcctctgctgtctgatgatggggacagggtgaccctgggagcaaagcttatccctgactgtcctccactctcctccccatgccgatgtttctttggggcagtggcaggactgcgtgggagggtaggcgtaccctcagaagaccatgggattttcttttttctttctttttatttagctaaaaattttttaaaaatatttctttccttaacacctatcccagagtaacctttattattattcttttattttttgagacagggtctcactctgttgcccaggctagagtacagtggtgtgatcacagctcattgcagcctctatctcctgggctcaagcaatcctcccgcttcagcctcccaagtagctgggaatataggcaggcgtcaccatgcccagctaaattatttttagtttttgtaggaatgttgcccaggctggtctcactatgttgcccagactggtctcaaactccagagctcaagcgatcctcccacttcagcctcccaaagtgctgggattacaggactgacccagtgtgcccagactgtccatgggattttctaagcaggtttccctgcagacataggtggatggctcaccttgccctgagagatctgttgagagctgccggacttccttccctgcagctatttccagagtgtatttgcccttgtctgagtctttggggtccaggatgtgaagccagatctcatccagggtggtgcccgtccttatccgatcaccactctccagacgtttgtctctgaatgtgagggtggagaaatggttaaggctgcctgtctgcaggtcaacagatacccgtgccccaaaatcctctcctctggttttgttttgagatcacgggctatgggtggtgactatgaggcaccagataaatatccattcacttactcattgattattcaaccctccattcctcattcaatactgcattcattcattcattcattcatcattcctagagacgctgtcctctgttcccagtgttgtgttgcagaggtgacacctctctgcttagtcacagggctcagaaactcgctgggggaggaacctattgtcctgaaattccatctgttcttggctctcactcatttgacaacctggaccaaattagtcaagccttctccatagagtgggtgcagtaatgtctgctccacaaggctgaggcatgcagctggtaaaaagcactgggaaaactctgctgttggattatctggggccactcagagagtggctgagtctctgtgggtacctcatctatcctgccttcaagccctggctctcagttagtggccagccccacagacccttttcctgcatgtttcccctaagcctggctgaccaagtttgctaagtctgcagaggcccacaagggtcccctgacccacctgaccacttggctcttctttgtccctgcatccctttctcccccagttcccagctgctgcccagagactgatcctgctgtggccatagagtttccagaaaaatgttgtcccgccaaggttcccaccttccctggggatctcggcaaagcctttctactcctcccactgctaatctctatcctcaactccttctgtggacagcaagaccaggaagagactctgtctctgctaacccctgggaccaggctctgcttgggggaccagaaactctgcttggaggaccaggcagggagaagggagggaggcccccatgggtcaggtgctgaatcctttccagcctggctggggttctggggcaaggcggacttacttgtggaaccaggtggttttcatgtactccacgttgtagtacttgaccttgctgaagatccggatcccttcctcggtcccctggattttcagtggagttgcagagagggctggggagacagaggagaaggatgaatcttccctgaggccatttaggcatcagattttggggccggcttgtctgcctctgccctggggggcaggtgctgtgggggaaatgcagtgctgtgaagaggcgggattttctcttcggtgtttgaggttagaaactaaacccacccccaatagccaaggccagtgttaggctgcttggaggctgttgggcatcagggcagggcagggctgggcaaagaggcaggctgcttaccaccaatcctgcccaactcggtgaagatggcatccagggctggcgggaaacagagagaagggttagctggcatagggctcccctagggatgtgctaggagtggggacatcctagaaaaaggctggtggagcccgtgagctgctctcagggggacaggcaactctgtaggatgactctcatagcttggggataggagggggttcagggcactcagcaatggggtgggcagaagggcactatggatggaggacaaacatgcaaatctgacagtttttgcaggctgagctgatcagcctgatgaggagcctgggcccactgtgggacggaggagtgaactcaggcttcgggtctccaagcctgggctcactgtggtatactgtggtgaacgagggcatcggagtcacaccgacctggctcctgccactgactagatgtggaatcttgggcaagttacttaatctctttgtgcctcaatttctccaagtgacatggggatcccataaatcttactgcacagatcacatcacagtctgctccactgtgctccctccacagcccctgacccatcgccagctcctaccgtcacccgtgaggtccaatatggtgtcgtcctcccctcgatcgtcagaaaccatcgctctgtaaattcccttgtcctttttggacaactggaaagaaggatgagcgatggtggtgtcagcatgggctccagaaggagagatggataccaaatccggaggcctgggctccaggcctgcccctcactctctgtgtgacctcaggtaagacccttctcctccctgggcctccatttactcatctgggctgggtgagctctaaggctcctttcagctccagagcccttggattcctagctcggggcttgtctgggcctggggaaggggtggagtagggggagttgaggacagaaccagacaccttcgtttgcattcacaggcagctgctctgagcatgacatgacacagtgagcctcactttgcagagcttgtctgggcctggcccacctttcactccctgggggctcctggatggagggacccccaccacctgcagttccccaggaggaagcgtgttttctcctgcccaggacaagggggcccttttggcccatgtttgtcagccccaaattaagtctgaacaaacactcagcaaagtaagaacttgagttgtgctttcaaggcaaggtccagagatcagaagtgacctctcattacacagcaccttccttcagccctcatctctcaatacttcccaccaggaccatctccacacagtgggtttggggcaggatccaagacagaggcagctcttaacctgaggattgaggtgctgagccccaaaagtcctctcttatgtcctcaccatcccaggaagtctccaagttctcagccaaacctagggtgggtgactggagtggcttctgaccccaccttctagccttatgtctttgcattgaaacactctgagcctcagtttactcatctgtaaaatcatggcatcatccttgccctgcctgtatgctacagctgctgtggggatcaagggaggtaactcttaggaggccagaaagtttgcaccaatgggactgatgattataataaaactctgtaactttgaagcacctactggtgccacagcctgtctgaggagcttgcacagtggtggcaaaggctgacttggcatcagcctggccaggatttgggagaagaccttgaaatcattgttttcttcctagtcagcaaggctctgtttgctccagtcctcctgggcacccagtgaggccacagacatcagcagcagggcagaaaaaggttgacgtttgagagcaagccttgtgtttctctcttaaccaggccacggtccaccaaaggccatgggggaggacttggggggagaattgagctccaggcctgctttattctgcccagatctgcctcacatggagacatccttcctgtcccgactcctagactgttggggcaggaaggaggcgttgaaagagcatcccttccaacccgctcatgttgcagatgaaagctgaggtcagagagcgacgggggctagcccaagcctgcacagtcattggcagggccagtactggagctaaagaaaaaaatcagtaatactgattctgtctctattgaaaatttgggggctttaatagtttttttgcattaattttgattttttagaatattgcatacaatattatttatcttgattactgagttttttggtgcctcttaaattttgtgctcagggcctcacttgcatcaacctagcctcggccctgccctgactcccagcccagagctcttggccctccctggcttgcagccaaaggagaaagtgagccctgaagctggagccacacttgcctcttcaatgcagagaagtcccgttcccgtctctgggtcatactgaccatctggcatctctgccctctggaagaaccactgaaagcgagtctccttcttggtgttggtcacctggggaaggtggggaatgaggagactctgtcaggcttgtttctttttgagtaaaaacacacctgtgcacactttcaggcatctcagtggagtcctttcacataccatgtgtctcctctgctggcctctggactctgaattcttgctaatggttttccctctgcctcttgatccctgccttactctatttttcttggaaatgtccatgtgcttcagttaaatgtcatctcctccaggaagccttttttttgaagcatcccatagtcaccccctccatcacgattcatcaatgtcctgccccatccgggtcaagcatgagggatgctgttttccaatggtcctgccttgaacatgggctcccaaggcccacagagaccacttcatcatctttgtacgttcagtaccgtgcagagtggcacaaaatagatgctctgagtttactgaatgaatatgcttctgggagagcacccaccctccccttccccagttatctaaacaggctgaagagtgctaagaaggaccttaggctttggaatcagatagacttgttcaaacctgggctctccctcttaccgtgtggccttgagctatttctccatttgttttctcatctatgaagtgaggatagtaatgcctgtgtcacagatgattgtgaggcggatgaaataatactgtgagtctctgagcacagggtaatcataaacacagggatacccctcaacatataaaccctcgtgggctcctagaccccctgacccctcagaaccccttctggagccactaggatctcgttcaaggctggtccacctcacacgaatcctaccccatgggcgctgggaaggtgggtttgctttttgggttacgtgtggtctcctcgggggtactttctgtgtgtgcgatcagccaagcacagagtatggaatttagggggccgggtgggcagggacagcaactgggcttggggacaagccacaggtccccctgcactgggcctgggggcagggcagggcaggacttgccttgcacgtcagctgcacttggcagtcctccgtgaccttccactgcaacggccgctcaaaatagggacctgtgcgtgcaaaacaaatgtgcccactgtcagagagccaggctcagccagggtgccacctgtgtccaggcagtgctggggggagggacagctaatggctatggacttctcagatgctgcctctgccagggctgggactggggtgaggcaggggcggtgctcagagcgcaaatttctttctttctttcttccttcctttctttctttctttctttccttctttctttctttctttccttctttctttctttctttctttctttctttctttctttctttctttccttctttctttctttttccttccttccttccttccttccttccttccttccttccttccttccttccttcctttgtttccttccttctttctttctttctttatttttgagacagagtctcgctctgttgcctaggctagagtgcagtggcgcaatctcggctcactgcaagctccgcctcctggtttcaaggattcttgtggctcagcctcctgagtagctggaattacaggcgtgtgccaccatgctcggctaatttttgtatttttcatagagatagggtttcaccatgttggccaggctggtcttgaactcctggcctcaagtgatctgaccaccttggcctcccaaagtgctaggattacaggtgtggggcactgtgcctggcttcagggtgcaaaatttaagagggctcagctctcaccctcaggtcaggcaagagctattttgatctggcactgggacagaactggactgaatgacagtggacctcccttggggacccagcagggctggggttcccattaatccgcagtccagcatctctagcacgaaccagtggccagggattttgaacttcaccccagcagctcttaccctgttttctcttccagtcccttctcttagcatctgccttcctcagaagcttgtcaaaatctgtgaacacagagggaggaactggcatgagccgagaggagtgtgggtctggagaggggacatggggtggacagaagtcgagggggctgtgctcagcaggctgcagagccgaggactcagggctgcagggcaggccaggtgtgcggggcagggcggggcagggctgggcggggcgaggctgggcatggctgaccgtcatccaccagtgtcaaggtaatctggtttttggcttttccatcttggagttgagcggtgtacgaccctttgtcctcctcagacaagttctggatgatcacttccaccaggcccttctctcggtcaaaattgattttgcggttctgaaaaggacaaactccagagtccttttccctgttctgggaactttgttgtggggtacacatcagagtgtagtgggcttgggggtggtaagcacagagctgtcagccttcagagactggggctggccgttgggtaaccctctgctgctccccccacacctagtcccccggggtgcttgaataagttacaattttttgttgttgtttttttgagacagagtctcactcttgcctaggctggggtgcagtggagcgatcagttacaatttaataataagtcccgaacccctgctgtgccatgattttgcctattttcttttctttttctttctttttttgttttttgtttttttcttgagacagtgtctcactccatcgcagagtctcgctccatcacccaggctggagtgcagtggcgcaatctcggctcactgcagcttctgcctcccatgttcaagcaattctcctgcctcagtctcctgagtagctgggattacaagcatgcgccaccacacccagcttatttttgtatttttagtagagactgggtttcaccatgttggccaggctggtctcgaactcctggcctcaagtgatctgcctgcctcggcctcccaaagtgctgggattacagtcgtgagccattgtgcccagcagcttatttcctacttcttttaaaataggaaaaaccccattggcgtgtgtaaaggataatggaaaaaaaaatactcgtgtacttgctacccagaattaacactcatttacattttaccatattctaacagtttttaaaatttcattttcctcatctaggttctttcttcctctggctttatttgtatgtatgatttgggggagtaatctaattttgttttatttttctatagggacaactgattgtcccaccactgaatactaatgagtccagactttgtaacacttcctttaccatgtggtaaggtcattgcacaagctttatgcagaactttcaaatcagttttctgatttgcatcttttgatgctgggacaaccagccccattgcacagatggagaaacacaggcacagacaggtgaagagacctgccaaggtcatataacccacagcaggtggacatgagactcctgtcagaactagtgccctctttctataatacatgttttctttcttcttttttttgtcattggacctttgatatatatataacacatattttcttccttttttcttttctttctttctttctttcttttttttttttgagacagagtctcactttattgcccaggctggagtacagtggcacgattttggctcactgcaacctctgtctcccgggttcaagcgattctcgtgcctcagcctcctgagtagctgagagtacaggtgcgcaccaccatgcctggctaagtttttgtatttttagtagagatggggtttcatcatgttggccaggctggtcttgaactcctgacctcaggtgattcgcctgcctcggcctcccaatgtgctgggatttcaggcatgggcaccccgcccagccacaacacgtattttctaatggctgctttgccatctggagatgaaattcacaaataatatgagattgagtcatgaatttgaatctctcatgaggttgacatcgccatgtcagcagtaaacagttgaatattgacaaatcatgtggttcaatctaatacaacctatctacagatatgatttacaaaataatatactctaaccataatataaagaagaaataagtcgtttaaaataaaaatatttcaatatataggtgcttggatataaccttaattatgctgccctgctttataatgaatcggtttgactttaagagaagaaaagcaaaaaaatcagaagctattctgtacaaaagcaggaaaatgaatgagcataggtaaagtaaccagcagaataaaaattctccattcagtgtatagtaacattgcacactttgggaggctgaggcaggaggattgcctgagttcaggagtttgcagcctgggcaacaaggcaaaaccctgtctctacaaaaaaaaaaaatataaaaattagctgggcgtggtggtgtgtgactgtggtcccaactactcgggaggctgaggtgggaggatcgcttgagtctgggaggttgaggctgcaatgagctgagatcatgccactgcactttagccatggtgacaaagtgaggttctgtctcaaaaacaaacaaaaacagaaaacaaaaaataaaattgtttgggagactgaggcagaaggagtacttaaggccaggagttcaagaccaacctggtcaacatagtgagtccccatctctaattaaaaagataaaaaaagaaaaaaattgtacaaaaatagtttgtatttatacctaaaacagagttagagtctagccttggataattataggcatgaacgcaggtttttcatcttaagaatgtctggtggggtaatcagaagttgtggggggtgtgggaattctttgtttgtgggaatgtcccttgcactggccagcatgtagtgtccctgccaaccccacccccaacaccagcactggtactaagagccaaatgttcccatcccgtcctcatcactgcaacagcaaaagcacaccgtcatttctgaaatggccactagggggaagtaccagcccatgcggaatcaccatcccgcgaggccacctccccggcaggggagcctcacttcagggattgtgagcacccaattaccggcgagctgaagatctccttgttgttgaagattagatgtagctcagcggctggagataacttttctacttccagccaaagccgcacctcccctcgctccaggatgtcaatgttccagccggagatcagtttgatcactgggaggcgcaggacgggaagggggtgggttggaccccttctccctttcccgctcccttccagccccaccttgagcacacccttggcatctgacatgcaaaacctttagagaacctgaaggagactgtactgggtggggctcagaggagggttttccgaatgcccactctagatttaattaatctcagcgaagcgtttcctcttctaagagctctggggctgcagttctcaacctggcagggcattggatcccagacgactttcaaaaaccctagcatctgggctccaccctcagagattctgatttgtctggggcatggcctaggtattgggattaggaaaggtgtcatcatggttctgttgtgtagccaagtttgtgacctcccctgctctagggactgtacacactgtccctagccaatggagagaagcagaggtttagacgatcccaaatcctaatgactaaagagccaataacagtaattataaaagaggaaaacacccacatttcccttcctcgcatcccctttcctgctgctcttttccttccgtgagcttcccgagtggtccctgaccttctagctctgtgattctcccaccctctgtccctctggggttgtttcctggtccttggcctgactctgctctgctcagaacatgccaatgggcccagtgggaactgcacaaggctggtagcttggactgcttgcttacctgggtttctgatctcatgactcagcttcttcagcttctccagctctgggatagggggaagtgaggaagaaaccagagagaatgaaatatcctggtcgggggtggggggcccacaggagccgtcctaggatcctgtgctgggtcaaaattccaagagacacctcccccgaccttggggttccttggctccataggggccatgatgagtactgtgagcctttgccctggggcactgagggtgatgccggggctgctgctggccaccctgagattgcgtcctctccccgtccttcaaggcctagatcaagtctcgcctccctagaggagcacctaccatgtgcctggttctgcatatacttcattagtcctctgcagtgctgtgggctgagcattactgtctacctctggtcactctaggaccactggtgccagggccttattgctcacccctgtcacatgctatcttagtgtccctgggtctggacgacacaccgagcactgcagcccagaagtctcagactgttctagaatgctgtctcatttgctgaccgtttcttcttcttgttcgttttttcttttttttgagacagagtttcactcttgttgcccaggctggagtgcaatggtgcaatcttggctcactgcaacctccgcctccagggttcaagcaattctcctgcctcagcctcccaagtagctgggattacaagaatgtgccaccacgcccagctaatttttgtatttttagtagagacagggtttcaccatgttggccaggctggtcttgaactcctgacttcaggtgatccgcccgcctcagcctcccaaagtgctgtgattataggcgtgagccactgtgcctggcctgctgactgcttcttcgtgttgcctttcctgctaaggcgagctctgaatctacgtgaatgttttgtacacagtaggtgctcagtcaatatggactgtgtggatgaattggcaggggcagagaccatgcctcattttccctagtaagccccagaatccttaacactatgagtctagattcatggcaagcacacggcaaacaaaaccaaaaaaacccatcattttcgtggatggctttagtttgcatagaatcatctgattgtatctgcataacaatattgtttcaggtgggggcagccagggattataatccctctttacgggtgaggaaactgaggcccaggaaggtggcatgacttgtccaaaatcagccagcaaattatggaactggaattggaacctgggtctctctggcttctgtttcttaacaaaatcaaaaggccccatgtgccatgagcagggtagacaatgggcaagggctgtcctggttgctacggaggtagcagagtgtctcatctgttgtgagcacaggctttgtttcagtttaatttatcaaatatggatggtcctttagacgtggtattcactctctggttacccgcagtccccagcgctccctattgtcaccccatttctcagaccaactgctgcttgcaatttatcatcacacttgcactgttgttttttggggctacagaaggaaacaaaaataattctagtacctttgctcttactaaaagtgggaaaacaggctgggcacagtggctcacgcctgtaatcccaacactttgggaggctgaggtgggcggatcacgaggtcaggagattgagaccatcctggctaatacggtgaaaccccatctctactaaaaatacaaaaaattagccagcatggtggcaggcacctgtagatccagctacttgggaggctcaggcaggagaattgcttgaacccgggaggcggaggttgcagtgagccgagatcgtgccactgcattccagcctgggcgacagagcgagactccgtctaaaaaaaaaaaaaaaaaaaaaaaggtgggaaaataaaagagagaccagaaaaatgtaaatttcactgggtagggatttatgtctgttgagttcactgatgtaatatccagggcctacctggcctgtggcaggtgctcaacagatatctattgatggaaagaatgggtgggtgagggcctacttctctgtggaaattgccactttactcattttggttgctttttgctgacctgtgtgggcatttgtgtttgggactctctctctggggaggtggcagggagcggggtaggtgcattaccttcctcggttagcgtgtggcttgcggagatgtcttcatcggcatcagtgactatgactgagtaggtgcccaaatcctcgaggccgggttctttcaggatgaccttggacctggcagagagaggagagcagaggctctgggaggagctccttggtcctgtgcactagaggcctgggagccagggagtccaggttgcttctggtgagcctgtaccccaagcagaccctggccaagtcaggaagcacaggcagctgcctcctgctacctccttagggtcccctctggcctgacaccttcaatggtgccattatctgggctctctggcactgggtctgcactggccacaccaccctgacttcctccagggcttgaggcataggctttatgccttctggacagagctgaggccgtgagccgctgggggaggatgagacatgggggcatgtgacaggggcccttgtggtcatctggtccaactctgcatactatagatgaagaacctgagtacagagaacttgcaagagcaagtccctggcagccaggctagaatccaagtcctctttgaaggtctccttgaaggtacttagttagaggcacatacaattccctacagaaaaggaatctccaaaagaacaatgccattggctgagcgcagtggctcacgcctgtaatcccagccctttgggaggctgagtggggaggattggttgagctcaggagttagagacaagcctagacaacatagcgagaccccatctctacaaaaaatacaaaaattagctgggcatggtgacatgtgccaagctactcaggaggctgaggcgggaggatcacttgctcttgggaggtcaaggctgcagtgagccgagatcatgccattgcacagccggggcaatagagcaagaccctgtctcaaaaaaagaaaagaaaagaaaagaaaagaaaagaagagaaaaaatagcaccattgcagccgcttaaatgcactctccactcttctcactaaggtggcagtcagcgtcctcagtgaaagactgagcagcgcctttcaaccatcatggatgggtcctgccctgtggtctcagccaggagcccctgccagctcctctgacagtatttgggtcccgttgagcagttgtttctcctctcgcctcacttacttgttaactttatcctcgatcttgaccctctgggggtccagtgggcccttgtagtctttggaccactgaaactctgaggagtcgggggcttcaggggcttcaaaagccaaatagataaagccctcttcatccacaccaacctcgatctcatgggcacctgagggcgagatccaacagagggcagcggatgtttatgcataataaaccaggtcacacccctcccctgcttaaacctccagggcctgcctgttgcacttaataataaacttgactccttgctgtggctgccaaggccttgcaggatccggctccttcccacctcaaatgtcacctcttcagagaggccctccttgactgccctagctaagcatcctatcaccctgttttctttcttttataataaagcacgtatctctatcttaaatcgctttcctcatgcaatagtttacttgtttactgtcttctgctccccccacccctacattagagcagggatcttactctctcattcactcctgtattcgcagtgcaatgtgcgcatcaccaaatatttattaaatgaatgaataattaaaagaatggaaagagaatgtgctttgtagttgggagaggtgagtgattctgtcatatactagcgtgtgacctggttgatcttctttgagctataataaaatcagtgccagtgtgggatgatgacccctccctcaggggcttgctggagggccagagaagtgtgagggcctagcacagcatcaggcttctcccaacttcccttgaactccacccgtccccagtggcgtagcccagtggcagagctctggcctctccggccacccctacctggcttgtcctccaggagcacgggatcagtgggcatggacggttgccccagaccagctgaattcatggcctgtacctggaacacgtaactctttcctggctgcaagtcggaaacctgggggcagagggcaagagccagcactgaggacagcagtgactcttcctgaaacctgggccccagggagcagggagccactctcaataagaaaaccctctcccttcttgtgtccctcatctttccatgtgacaaagatggccattcaacacctggggattgtctttgccattcttttcttgggtcctctccaccaatcaccaggttccatctgttttatttccctaatgtttcttttttttttttttttttttttttgagacggagtctcgctctgtcgcccaggctggagtgcagtggcgggatctcggctcattgcaagctccacctcccgggttcacgccattctcctgcctcagcctcccaagtagctgggactacaggcgcccgccactacgcccggctaattttttgtatttttagtagagacggggtttcaccgtttttagccgggatggtctcgatctcctgacctcgtgatccgcccgcctcggcctcccaaagtgctgggattacaggcgtgagccaccgcgcccggcccctaatgtttcttttttctttttttgagacagagtttcactcttgtcacccaggctggagtgcagtggcgcaatctctgcccactgcaacctctgcttctccggttcaagtgattctcctgcctcagcctcccaagtagctggtactacaggcacccaccaccatgcccggctgagttttgtatttttagtagaggtggggtttcaccatgttggccaggctaatctcgaactcctgacctcaggtgatccacccccccttggccgccgaaagtgctgtgattacaggtgtcagccactgcacctggcctccctagtgtttcttaaatgtgaccactttcctccaggtcccgtccacggtcgtgattgaggctttgtttctcctcacctggggcagtccaacagtttcctaaagggcgtttctgccctgggactcttctcccccagtctgtctttccctctgccaatctgatgatgtgtacatcttttagtggccttcagggtcaagttcaaatttcgaggtcgagtacctataatcttcctaacctggccttagcctgttgtcctcttgcccctccatctgtccccttcactccacactctctcagtatccccacatccatcacgccatttcacacctccctgcctttgcccttgctgagtgcgctgcctggaatgccgtcccgcctccctcctggctcactccagtgtagcctgtgcttcatcacccagtttcggcagatgcatggattccaggaagcacctctcaccttctcctttgagcgtccagaattcctgagaccccctcaattgcagcatttatcacgcagtattgttattgcctgctacccaacaactgtgacttatttagcttcccatgcctaggaattggtccaggcctggcattaaagcaggtgtgaagaaatgtttagccggtggctgactgaccgaatggcggccaactgtccacatgcagaagccggtgccagatcacctaggctgtcccgccctggcctgggccaacctacatgcggagggggcgagccactcatataggggaagacctcaaggtctcagcagagtcccctggctgaggcttgtcttccctgattctgtctgaggtggccttaatttcattttttggtaaaatgaaggtattttaattttttccgattataaaagagatacacacttgttgggaaacattttaagtgataaagcacaacacgaaatgaaggactaaagcgcccctggcaggctctcccccagagatgaccagaatggaccatttagtaacagtatttttagagattttttttttttttgaggtggaatcttgctctgtggcagggagtgcagtggtgcgatctcggctcactgcaacctccgcctcccaggttcaggtgattctcctgcctcagccttctgtgtagctgagattacaggcacgcgccaccacacatggctaatttttgtattttttttgtagaaatgaggtttcactatgttggccaggctggtctcgaactcctgacctcaggagatccgcctgcctcggcctcctagagtgctgggattacaggcatgagacccgccgtgcccagccaaaatctttttagacttttacaaggacataatccatgtagaaacaggacatgcaccgtatcctatttgttagtatcttattctttgccattgttacgggcttcttgagcctgccttctttcctctgggtgctccctaatgaaatgttgatgaatgggtttgaaaactgcatatcctcctgcctgctggggaaaagcacccaggaaaatgggctggagaaatacttccccttttcctagggctgcagaaaatggaaactaatccacataacattcttacaaatattcctcaaataaaggaggccctgagacacattggccttaggtgtagacgctatggcctgtgaaagtggccttcagtcacctggaagtctaactctgattggttgtctaaggtagtaatttgtgtctgttaataatgcttcaagtgacttctttgtttcctgatatgtctaagtatttgtgagttgtcttggttaggccaggagaagactatttgtgattttcttacctcctgcatgtgtggaagttaaaacaaccatcactccagaacaaaactagtgattctgctagacctctcatttagccaaagactctagagtttgtttctcatttaaattaaggaacatgtatctgcatacatgtttatttatctatattatatctaacatgttacatatattatatgctattcacatataaatatcctactctgtattctgctttgtttttcttagccatataggatggatatctttttgtgtcaatacatgcacgtaggtccacctcattcttttttttgagacagggtcttgctctgtcccccaggctggagtgcagtggtacgatcacggctccctgcagcctggacctctgtgggctcaggtgatcctcccacttcagcctcccgagtagctgggactacaggtatataccaccacacctggctatttttttttttttctagagatgaagtttctccatgtttcccaggctggtctggaactcctgggcttgagcaatcctcccacctcggcctcctcagagtgctgagattaaaggaatgagccaccatgccctgcccatctccattctttatactgtcttgttcctttaactgccttattctttatactgcctggcacaggattctacttttaaggtacactgtgattaacttaagcaacacccttactaatggacgtttaagttgtttccagcttgggccgttacaaacaaggctacaagaagcatccttgtccttagatctttgcacgtttgcctaattacctgtctataattcaatctcagaagcagaattgctgggtcaagggatatacatgtgcaaatgctgatatacctggctgataccaagtgagtctttagggaggcacctgcctagcatggagcaggatatgggcaccagccagccagacctacctccaacttgctgtgtgaccctaggtaaatcgctcttcctctctggtcctctgcttccattaagtgagagcagtgatgtctggaggtcattccagctctgatgctctagtggcagggaaggctcagggccagtcagaagatgaaggcataagaacttaccctcaggtgggtgccagagatggggcctggggtgaccggcttccactgctcagagccttcctcctggaaactgacgtgatagcctgtgacaggcccagcccccatatacagtgggggttcccactgcagcaccagggatgtggcccgcacctcggatgcccgtacatcgtacggggggcctgtgacaagtgagagatgggaagagatgtgtgagttgggcagccaggcagccagccaggtaagcagcaagcccagcagtcagtcaacaagcttgtcaatccctcagtcacagtcaagccaggaagggcctgttctgggtgtcgccaagcccgggccaaccttggcttcatgacaaagcctggctctgggcctgaaaccacggttaacttttcaaaatgcgctcagcctcccctcctcccggtagcttccctgaccttccccatccccatcccagacagcattaatccttctaaagtgcttcagtgtttagtgactctagtgtaacttctagagtcagacctctggggttcatgtcaaaactccacctcttccagatatggggactctggatgagatacttagcctctttgttcctgtcccctcgtctgtaaaatggggataataatagctcttataatatagtgcttttgtgagcattagtgagataatttatgaaaagtgtttggtacctagtaacggcccaataaatactcgttgtttataattgtggttgtcgaaagcatcatatgttttagttatctgccactgaggtagaggttttgtgtagaaaacagaactgagctgaacaaaatgatggaagggtgtgattctccttcctcagtgggaggtgaggggctcatttgtgagaagacttactgggttatgggagcagtgggtagggtggccaactgtccatttgtccaagactaagagggttcctgggacttgggattttcagtaggaaactgaaagtctcaggcaaaccaggactagttactcaccctagcagtgcacctttggggctggagattggtctatggctagaagcaggcaggctctcgagttgggaaatagtttgtgctggggatacagggccagttgatggcccaggtcaggggtcctttaagacaggcttaggactccatttgtgtcaggaattatagagtgggtttgtgcaagggccaggggcctggggtgcaggacaaacagtgcaagcctgaatgcatagaggagagcggcaaccttcatctcattgggtaggtttgggaaggagggaagggcaggcactggacttcaggcctgcaggcctctcacctggctggggcattgtccactctttgcactcaaacaggctgctgggtgccgacagctcgccaacacctgcccagttggcagcccgggcacggaactcatagaagtggccttcatgaaggtcactgacctttaagagcagaaacacaaactatgaggctgaggctggaggagggatggggaacagaagcagtggtgcgggagggactcagagcaggtggtctgtgggggctttgcttttatttttattttttgagacatggtctcactttgtcacccaggctggagtgcagtggcatgaacatggctcactgcagcctcaaccttctgggctcatgcagtcctcctgtgttagcctctcgagtagccaggactacaggcgcgtgccaccacactcagctaatttttgtattttttgtcaagacagggttttgaacatgttgcagactggtctcaaactcccaaactcctgagctcaagcaatcccagctcaagcttggtggctctaaacagttctgttcaaggtgggtctgcactggaaaatgatctcgatggctgaggcaggggaacttgagacttctgtcagcctctgtcagactccaagactcaagcagtgccctctggtcgctgctaaacaagtcatgacacaggctggggccaccttccagccctaccttgcagacccgggtggggatgggctgctgattgaccgcatgccagtccagctcttccgagtcatgctggtccaggaagtagcccaggatcttgccacctccacgacgcttggggggtttccacccaatgaccatttcattcttcccgcagttcaggagggcaaagccatatggggcagacggggtagctacagggaggtaaggaggtgaggacagctgctccctaggggtggctggattggacagtggggcctgagggagctgacgagcctcctctagttggtgcctgccctactccaggggtttttccctgagccagtagtatctgtgcctcaggagggcatcggagcctcaggtttctgggtctgagggcttccccaccccccagagctgctcaggccccatcccatggcctcaagccatggttacttccttcccaaaggaaagggcagccagggccagctccagtttccctcagagggcgtatgtgccactggccaccaggactgggccctccaagatgtgatctatgagccccagctccctgcccagcccagggaggtttgcaggctggacctgcccttggactcacccagagcctgcttgaccctgatgggctcggtggcggctgagctctcgcctaccccagcctcgctgactgacctgacacaaaactcgtactccttccccgtcctcagcccgggaactgtaaacctgggagagaaatgtgcagctttcatggatgtacaaacagcctggagacattcccaaacttgctagaacaactttgtggaataagtggtcaccagcgtggtagaatttgaaggttcaggtcaattcttcctaaaaatattgcccttgatcccatggcaatgcctgagatgacaccgtggagggggtagacctaagagttttaaaggatgtttgcttttccagatccacccttaaaacgcaaatacgctaggaaaggttctaatttaaagcaaaggcagccaaccccaaacccagcgccacatggtacatcttcaagactttgggctttgtccttgaaaaagaacatgtggctgttaatacctgcactaatgctgggatgcaaaaacaccgagtcctttcagagccctcaaagagaattgtcatccagagacacgcaaggatgctctagcttagagaaaaatgtccttctcatcctgtcccttcttgataagacccaattgtggacctctttctctctcttcacctatcaacgttctcctagagcaaatcttgttttgcagggagctcttctcagccaggccttcatctttcttccatgttggatgcttcctgaccttgaaaattggactccaagttctttagcttttggactgggacttacaccagtggtttgccaggagctctcaggccttcggccacaaactgaaggctgcactgttggcttccctacttttgaggttttgggactcggactggcttcctcgctcctcagcttgcaaacagccggttgtacgactttactttgtgattgtgtgagtcaatagtccttaataaactccctttcctatatacatctatcctattagtctgtccctctagagaaccctgactgatacagaaagggtgaggggtggtatggagcctgaactcaggcctccctggctccaaagctctccactgctctgccctccccacctctctctgggtttaagctcctggagggatgagaccaaggcatggtcatctctatccatggagtcctgcaaatagcacattctcaacaaagtttgttgaaaaagaccatctgggttcaagtcccagtcctgccatttactaagctacaaggggctttggcaagttatgtaacctctccatgcctcagtttcttcatctgtaaaataataaaaataatagtcctacacatttaggcttgcaggtagaactagatgacctcacatatgaaaaatgccagaacagtacctggcgcagggtaaatattgtgaaatgctgggcttcattatcattatggccccctttcaaggatgcctggtgcaggaagaggggtgatctggtttggctctgtactcccactcaaatctcatgttgaattgtaatccccagtgttgggggagggacctcgtgggaggagattggatcatgggggcggatgtccgctttgctgttgtcaagatagggagcaagttctcatgagatctgcttgtttggaagtgtgtagcacttcctgctttgctctttctccctctcctgctcccgccatgtaagacatgcttccttccccctcgccttccgccataatcataagtttcctgaggcctccccagaaaaagaagcctgtataggtcgcagaactgtgagctgattaaacctcttttctttataaaagaaattacccagtctcaggtatgtctttatagcagtgtgagaacagactgatacgggtgggcagacgtacctggtgccttggatgggtttgttgttaactgtttgccactcagatgtccccaccttccgggagtagatgtaataacccaggagctctgggtctttcacaggatcccatgtcagggagacagaggtctgtgtgtctctgaaagcttgaacttgagctggaggagggagggtagctaaaaaatagaaacatgggctgaatgagaaggctgagttacatgggtctgacaggctggggaaggggaggagcatggggagaggccagaaggagctcccacagcaatcaaggtgcatgaattcctgacctgctgggggctttgggacctcttccctaggcccagaagtgtatcctaaaagtcctctctccccttacctctgagcatctctgcttcctcactaaagcacaaaagcatactcactcattcatccttacacacacacactctctctcactcaaaagtcaccaaatctgataggtttcctcagtccttatctttaatctcagttttctttccttgaaatttctctactgattttcatggctccctgaaactaagctttttgagataggggctgctgtaacttgttaaatggatggatggatggttggttgaatgaatggatggatggatggttggttggatgaatggatggatggatggatggatggatggatggacagatggatgcatggacaggtggatacatggatgaataaatggatggatggatggatggatagatggatggatgaatggatggatggatggacaggtggattcatggatgaataaatggatgcatggatggatggatagatggatggatggatggatggatggatggatggatggatggacaggtggatacatggatgaataaatggatagatggatggatagatggatgaatagatggatagatggactgatgggcagatgcatggatggactgatggatggcaggtgcatgatcttcctagttctctttttatttctaaactccttacacatcctttggttgttctctattttcttttggcccccaaacgttggactcatccaagcttctgttccttgacctgctccactttttctcctctcttcttattcctaagggtcctgcctatcccaggtcttcatccctcacctgtttgaaggcttcacctctagccctgccctcccttcctttctgaattataccagagccttgcctggtacaatttaagtgtggtttatggtccagagactgcccacatctgatgactaattgctcactggccaggccccaaatcaaatccaaatgttaaccagaagtaaagaaaagcaccacttgctcaccaacttgttcatatgtgccgtgtgtgtatgtgtgtgtgtgtgtgcgcgtgtgtattttttcccctctaaattattgaagcagaacaaatctagaactttgaaatcttccccaaatgggaccttcagcaaaccaggcttttcttgcataggtggtactgtagcaaggttccttaaagggctgattgtgatggcagctacggggaatctgatgagagggtaaagaacctcagaatccagaggcctcagaggtgggagccctgggaagctggggtcaggatgcagttgcagttgggagactcaggaaggagccagaggtgggagcagtgatggggccctttagaacaatgggtttgccagttgaggacagcaaggtgtgcagcttggaaatgactctcccaggtcccccgttatgctgcaggtgagtggtgtcctgcctggtaagccagggctcaggtgggacagctcaacccccaccagacaaggagcagggggctgcttgggagtgagctgcaggatctaggggcaggccagagacctgtggaacggagggaccagttgcttgcacagctgctgtgcagggcccagctgtgcactctaacccatgcattgctgatctggaaaaaggcagaaggctctctccctccatgagccttctgcccagagaaatgtgatttctgatgtcttaaaactccccaggcctgagatcaaattgcttttcagcttcatgatgggtagaagggagcggggacagggaagtgggcagggctttgtccctgcagcttcaggtcctgagcctggcctggcctgcctcctccccgacccccggcatcaggagggtacctggcgggccccgcaaggcgatgggttcgctgggctccgagggatcgctcaggccatactggttcattgctcgcactctgaagacatacgacttctttttctccaggtccagaacggcgaatctcggggatctcacagggctttccgagctgatggcctcccaggtgccactacctatgactgactgaagaaacagagggactcacattggctaactggtcgcccagaccggctctgtgctggtcacctcccatgatctctgtccccagcccgtgtgctctcatgatcctctatactcagcccaggctgcccctgagcatggggctctgccccatctgcctcctcacctctccacccggattcctaccgagacctcacgtccagcctgtccacaacgcggctccagagcttcccacacctgcattgcactggtggcccccatccttccagtccctcgggtgaaacccctggagccacccttggcccttcctctctttgtctcatgccctaaatgtgctccatgaatgaacccagttggctcacccttcaaaatttacccagaaaccagccatgccttattgtcctcatgctccccaccataaccttgatgcaggctgccagcaccccgcacctgaacgatctcaatggcctcttgactggtctcccctccatttctacctataacccccttccgtcttgtctcaaatggccatcagggggatccttttatagcacgtgtcagaccaggtccctgtctgcccagaaccctcccacgtcccgcatctccctcagagcaaaagcttccccatcgcctgacccctcggcctgtctggccaccgttccctctgcccttagtctctgtgcctctctgctgtttcctgagggtccaagtcccacctctgggcctttgcacttgctggtccctcagcctggaatgttcttctccgagaaatctcttggcttcctgtaggcctttaataaaaatccaccttcctgggcagtggggaggccatcccagccactccatctaaaaatgtcagcagctcctctccccacacttcaagttcccctccctgctcaatgtctttctccttagcgcctaccactcactactgtgcttaatattctactgatttactccatttatcattggcaccccctcccctgactgccgtgtccctagggccaagaacaggactggcacatagcaggtgctccatctatgtttctgggacaaatgaatgaacaaatgaatgaattctcacaataaccctgcaggaaggtgttaatttctctgccgatgaggaaagtcaggttcagagagtttcggtaacttggccaaaagtcctgcatctaataactggtggatatagtattaaacttcactcaggtgtggttggctgcgaacctgtttactctccacagcatcagggacccagaaggcagccagaaaccccgagtctctgggcagatggagggtggagagcccagggtgagacagatgagtgaggtacccagagaccctttctgctgagtctgggcaagagagttaagacctagaagcacaaggggacccactgattccacgctctgtggttttccccccacaagcccatctggctgtcagtggcctagaccaggtaggacaagaaattgccataagaaaccatgaacactgctgagctcctactgtgtgccaggctccattctaagtctttatgtgcgctaattaatttgatcctcacattaaccctacaagctgtgtatgattattatcattttatggaagaagaaacagaggcacagagaaactaagtaacttgcccaaggtcacgcagctggtaagtagcagagatagaatttgaacccaagcagtctgacgccaacatcttcaccatgatacactaccaccttgtgaaacaaatcctcaattatctacagctttcctatgtcggagaaaaaggattacccatgagtgtgaaaagagaggcctgtttggataatcagagccagagattcctccctggaaattttaaattcatttattccctaaacattttctgtccacctagtttgtgccaggcattgtgctgggcacagaaagtaatgagaagataaacttagtctctgacttcagggagatagtcaagaacacctccttgggaagcactgacagatcccaggggttgctggctttggctgtgggctgtgttttatttcatcttcacagggcaggttctctattctatgctggaggaaactgaggctcagagagtttaggacactcactcaggatcacacagcacaaggaaggatttgaatagattttgacaccatgctgtcttctactctgccatactgccccccctccactgtgaagttcactccacaagacctgcctcatccccgccggggtctcccctgcccccactccccagtgagagccacctcctagtgctaatcacaccataggctctgcaagtgctgctggtgcctgtccctggctggagggtaccagccttgtttccctcccaacatagtcccaccaagaagtgcttggccccaatgtgtggtctgatgccatctggcttgggggcagggaggtacccaggaagtggtggatcgtattgtcattgttgtctgtgtcttgtattttgtgtatttccacgaacagcctcaggaacgaccagcagtgactggcttccagggctagaggtagctgcaaaaggctattcaatccatccccttgcctctgtgtagggccatgcctgggcccttctggccaggggattctctttcattctctgacggcctccccaggggacactgcccagggtcccacagcacatctgtttctcaggctggcctggggctggggcctcggggttccctaccttctccagggagtacgtcagtggtgctctgtcccgggggctgggctcctcccaggccagaaccacataggcctctcggatctcgctggcatggacattggttggcggtgaggggatggtcacagtatctgaaatcagagtcacccgggaccgagatggttggaccctcagagaccccctaatctcagtgcctcattccatggaagagggaactacacccctacccatcccccagagaggggcagtagttggctccaggtcactcagcaatgctgggcagagccggggctagaacccaggtctcccactgctctggccaggacttttcccaatgtgttccctcctccaggagggccacagccagatgggccacagtgaccccagcactctgactgcctccaactaggccccacctgccctcatcccccacaccctgcactgggacagcttctgcctctttgccagctcatgtcccagagttttgagaactatacaggaggcccagtgtgtgggaggatcccgcgtaccttcaaaagcgtctgtgctgatggtgatcttgtttcccagatcaaaggggatctctaggatgagaagggagcatgggagggtggggggtggcacaggaggagttaggccaggagctaccccacaccagggtctgcgtcctgccccgtcccagtcctggccttgcagccctcgctgtgcaacctcagacaggtgccctccctctggcctcagctttctcaggagtcccaagtggagccctgctgctctcaggccctggcacatgctcttcctcttgggacaagtggagacagagaggaggagggaggtgcctggcgctgggcaccctgccacggtggagcttctagcacacccaagtcagcgtggctcccgagggctgagaggaggccgtgtccccgcactcgagcttaaggacatctgacaggtgctggggtagggtgctccctcagactggtctctcccatggacaggtttggtttctcccattagactagctgtatcttccttctcaggctaggggttcctaaggaccggattgtgtctcctccatcagactggaagttctcgagggctggcctttgtctccttcatcagactagtgtttactgagggctgggctgtgcttcctccaccagactcggggctcctgagggctggattgtctcctgtgtgagacagtcctgagggttccctgactgatgttctagaaagtcgcttaggacctctgtacccacctgtcttcctccgggctgcatcatggtcacccatgacaaccaactctgaggccttggaggggacgctgctgcctaccctgctgatggctctcacccggaaccgatagctctgaccttcgacgaggccttggattgggcaccgacaagtccctccgggggcctcatggcaggcgatccattccccagactcgccctggcacctgttggagacaggccccccctttcagcccctgcccacaatgcacaccttcccaatgtgagcctctacaagggcctttctctgactgggggagcctgcccagctcatctctgccaattaaagttcttctctccaatggaagagcctggctccaacctcgggcccccgggagaccttttcaccatccctgacactgaccagcagcagtgcctttcatggggcatcatcgtgagcctgtgactgtgctgtgccctccacacccagccctcgttttatctccctggcagtcctagggggcacgtgtggtcaccttcactgcacacatggaggatctgtggctcagagagtgacaagacctgcccaaggtcacacagttaggatttacctgagcttgtcccctccctaagttggcatgcattccaggttgaccctccaagcctgggctctctgtaccctcttggtaccattgttccaggcagtacgacagtgcacgttacccttattgttaccagctggttgaggtagtcgtcacatgtgggtccaagtcttgtctccaccactaatgacaaatgtgtctttgagcaaagtcatctccccacatactttggtttccccatctatagaagagggcattagatagtccccctcccctttagagacgggtcattggaaggatggaaagagatgaggcatgcccttagcacggtcatgagcctgtccgtggcagcattagctattttctcaagctgggccttcagagccggccacactggaaaaaggccggaggttctggcctctctacctgtttgcctcctcccttggggtcagtgctattccatctctctctgtcattaggaaggaaactagcccacgaattcactgtgctcagggttcaagcactccccgttttgcccctctgggtcagctctagagggtccacagggcagtggccgactccagcatagaattccagttatcagcatgacaaagacttggaggtgtggatgcccctccattgcccctaaatgacacagcacagcctgtctcctgtccttttctgaggagcgggggtgtgagggttctctgaggtcagacatggggcctcctctttgctgtggctcccaccaccagacagaattctacccctagggcctctgccactcacgaggtcgactcaccgctcaatggtgtaggcagtgatggggttgccccgggtgtcactgggcggggcccaagtcaggatgaggcagtctctgttcacatccaggcatcggacgttcagtggggagcctggggccccggggttctcggcctcggcatctgaaacccgggggtgagagggaggcccttctagtcagtggccatttggtgacaggcccttcccactcccgcccagcatcctcttctcatccatcctccaggggctcagttttgatcttgaggactggggcctgaatattagtcccactacccccatagcagtatctgagggaaggatgacagtaccatttcttgggggcccattttacaccaagtacctgaacaagtggaataattaattccagccccagagcagccttcccctctttggatggggaaactgagtctcctggaggtgagtgagtgacctgcccaaagtcacccagctggtgaagtgacaaagccaggatgtgaacccaggccctaagcagtggccagaatcactccagccccacactcagctcccagcctccctggctccagccaggctaactctcgggccatgtccctttggagggtcataggatgccacggggagtcttggagaccccaacccaaagccctgattttatggtagagaaattgaggccccaagagagcagggtccttgcctaaggttccacagcaaacaaggggcagagccctggtctctgggctcctgctgctaccctgcgcccacccatgccctcacctctcacaagcacgtaggtgctctgttcccggggtccgaagggcgagggcacccggaccatgtagagcccctcgtcctccttgtaggtgcaggacaccttcagggatgcctggcggtctgtgtagaggatcttccgacgtctcgaggacctcagtaggctccctgtggaggggaagtggggggccattgagtttgtggggggtcctggtctcacctgggaaccacagaaactggggggtctggagaccctggctgggcagagagagaggctggtgaggctcagctcaggccttgggtgggggtggtggcctccagggctttgccaaggcaggcagtggagaactctcctttgcagagggcttggggagtagggaagggccagtgcggggctggggctcaatgagggagtgagggtttagggacatagccagtgacaaggtgaggagttgtaggttctctgagggagtaggagcaagagagatgggtccctgtatggggtcaggggactcaaagaaggagggcccgtttgggggaggtgggagctcagtaaagggcctgggtctcactgagagagctggggcctcggtgaggcgggtggaggacgtgtcgtggggtcaggggtcaggtaagggagtgagggctctcgggatgggagcttaggaggtggatggggactcagaagtggagtccagggctcaggggcgggccctgccttgaggccacactgtggggccagctcttctctttgccccatgtgaaggatccgccctccattcagcacctccattctggaagatctacacgtttgggaagacgtctcagccttgttattgcagctgtcagggatcctgatggctcccatactccctgctcccagcaggtgcagcctccctgggctcagagctgggggtgccagaggggcactgtactctgggtccttaggctataggcctagtcatggattgggtaggaggtccagccgtcgtcctcctccctcactgggccacgtcttcctgccttggctctgaccaggcttctcaaggcctcgcctgagacatccccagaggcctcccagcccacgggtcagcaactgtatctgcaccaccaccctgactctgcaaagtccgatgcaactgttgcagcctgccctgagcacttgtggtgccctcctgcctcccgatcttggggctctgttcccattgctttgagtgccctcactcacttttttttttttttttttttgagatggagtcttgctcttgtcccccaggctggagtgcaatggtgccatctcggctcactgcgacctctgcctcctgggttcaagcgattctcctgcctcagcctcccgagtagctagattacaggcacccaccaacatgcctggctaatttttggtatttttagtaaagatggggttttgccatgttggctagacctgaactcttgacctcaggtgatccacccacctcagcctcccagagtgctaggattacaggtgtgagccaccacgcctggcctccctccctcactcttagggaggtaatgatgcatgcaaatggctgagcaggtgcctggtcagtgccagcggctacaattgtgctgatggcttcctccctcctcccaggtggacacagccccctgggctcatgcacatctgcccctaccatttaccccagccctaacccagggcctggcaccccacagatgcttggtggccatttatggggtggcatgatctgaccacacctggctgcactcccgctctcctctgcctcttcagcactttagcacagttggtactggttggggagagtctctgtccgctaggggtcctctctggctctgagttgagctttggaggggccagctctggaggctgggggccaggactgggggtccttaccatctcggaaccactggatgctctcagcatctaacacatcttccgaaaacaagcatgacagggagaagggttccttctcacgagcaaagactggcttcagcaccgaggtgaattccacgctggggccaaacgtcgatcctggcgtgggaatgaaatttggggcagaagtttttgaggcagccagcctggcctgggacttaggagtgaggaaatttctggggcatcccttctcttctgggtcttgactaggagaaggggacctggccttggggtaggaggggaagagacttatctaggtagtggtcagagcagccaaagagcaaacatcccaaggccaagtccgttggtttttctggctttgcctttcaaacccagtttaggtcagagaacagctcagcagctggggacagctctggggtaccctgcggcctttagaagtcaggtgcaggtattaccagctcatagacaaaccccggtggacgtccttttatgggcaggggatggctatattctaaacagggactgtgggggtcggggagcaaagcctgaacaaagaatcccaggtcccgttctcccccagccgacttacttttgaagatctctgaatcgaagccagcatccttccccaggtaagctgaaaaaccaaaggcaaacagagttggagaaggttcagagcccacattcctatgctattttggggacatgggctttggatatgagtttgagtcctggtctgttggtggcttccccttgtggctttgggaaagttcttttacctctctgtgcctcagtttcttcagcagtaaaatgggacagtaattcctacctggagcaaggaacgagcgggttcacatgaatcaagccaccagccatagcctgacacatggcaggttctcaatacatgctggtttcctttccctacccaaacttgcccccaggattatgcactgtcttcacagcggtcaagcccgctcagaggcgcggggatttctggtgggatcagggagagtggtgggggaggggcagcactgagaggcatccaggggctgaagggtgaaatccaaggtaatgttgccacagaccaccagagaatagtaacagcagctctcactcacacagtgctcgccccatgctctgaggattgaacgagccaattaaacacataaacacattgactcattctatcttcacaacagccctgtcagttggtactattattatcctctcaaacagaagagaaaactgaggcacagccgtccagacaacaccccagcagcctgaagctatgacatgacactggtccctggaaaggcccttcctgagcaaggtccagagaagggcaggaggctgcccgagatcacacaggtcagtggaagagtcaggattggaactcagggctcctgtcccccaggccactaaaatcacccaagtggctacggagatgaaagcagagaagagggtggtagtggcggtgagtggagtaggagaagcagagggttggctggagtctggggccaagagcaagcctggtggaccctggagttgccagccttgatggagagagggacagggatctggaaggagtggtgggaaggacgggtgggcagagggaggcagggccccagtccctgaccttgggcttgactctgggcatggactgtggggacagctcaaatttctgcacaagagcttggcctggcagcaggatctgcctcctaagagctatttagggaacaggacagtgggtggagagggctgtgcaggacagtttaacaaggtctgatgagaggcagggagggtggcctgggatccacctgtctactgcccaagacagctgcctcaggagtgtgtgtatgagtgcgcgtgtgtgtatgagtgcacgtgtgtgtgtgtgtgtatgtgtgcacacgtgggcttctctctcccgggggtcctggaactcagggcacggcattcttctgggcccaaaggtgtgacccccttgggcagtgccctgccctggtcatgggaatgggtaccacatgccaaggcttatacgtatcatctcatttaatcaactcgggcatctgagagaggtggtaggattgtaggattctccctttcacagatgaggaaatagaggctcagggaagtgaggtggcttcccagatttacacagccagttggcagcagagccaggatgtgaactcaggtctggctgactcctgagtgtctacctgctttatgctgtgatttcagatgcccatggggtgacctccaggaggggcccaagcccagctggaaaatgtgcaaaaggacccacatggggcagtgggggtcaggtggggagttgctggggtttggcttttgtccctgaggacccctcagcagggttggtggggccagaccaccctcccagaggccctgagatggatcccaacctaagcgcaatccggtgggccaagcatgctctttggcatggcgggcaggtgggttcgccttgaataactgtgtaggttgtgctctgtgcaaagttatcccctgagagagcaacttgggggctaaaattcagtctgttttccatttgccaagccatgtgccctggagtgggagctgcacctgcctgcagaaaaggggcccctttcgctaattcatccattcagttcacacaaaggtgcccaccatgccagtgatgactctacagagagagctgagttcaagtcccagccctgccaccggctggctcaggatggaatcaggtactatcaagggtgtctggcacacagtgaagactcaggagaggtcagttcccttcccatctcccagctgctcttgacaccaacccacagggacaggtgatcctgcctcactcaccttccaccatcagcccaggctgatggaggagactatcgcttgctgtgaaggcccccagggaagcgggagtctccagggctgccctggtcacccaatgccaggctgaacagccttgtgcctatggcccttcctcaggtctcacgcagacccatgtccttgtctgcccagcttgggtttgctgtggcccggagtgcctgttggggttgggaggacttactgcggacgaggactttggcgaaggaggaggcctggccgtgggcgttcttcactcgcacagtgtaagttgctgagtcctcaatggcgcatctgaaaaggagagagggagaagttcctcccaagactgctgggctccatgggaaacacaagtcccctgtgtgggtgggaaaggctggaactaaggaaagcctcacggtgccaggaagagactttggtcattatctctgaaaagctgtgtgttttctggttggccactgcacctttccatgcttcggtgtcctctgaaaaactggggacacgacaccacctaaaccgtctcaggagaaagtgctttaaaaatatgacatgccacattgcagttattgctgactgtggaggatcagagaggttaagtgactttcccagagtcacagagcaaatggaactcaactcagcttcaaacaaggatcctggagcgggagcctcctcctttctcagagagcagcagacaaacttggtcaaggcaggctgcaatctggatagaactgagccagacacccaggtgttcccagtcttaggtgtgggtctcaccaccaaccaggccaaccctgtcatgttcccagtggaagcctgggccagctccatcccaggggcaccctggtgacagagaggaggtggtcggatgtggcacctctggccccattagcaagcagaggccccttggtgcctcctttttgcccctggtcactcagcacaggaacccctcttgcttccagggccagtcctgcctgccccggaggtccccctgggcctgcgcaccttccttgactgtggagtccatggggcacctcccttatatggtcagatatttatgtctccccacttctgaagggtaagatgagtgttctgcttatctttgtgtctctgaggcctgggttggttgaggtggagggtttggtgtttgggaaacaacccagatagagagaaatggctcacaccaggccctgtcgcatagtagctgtacaagagccttaactttctgagcctgtttcatcacctgcgacatggggtgcttccctcaagcatggtggcagggattatggatcgtatgtgaaaagcacccagcacagggcctggcacctgggaggaactcagcgtgtggcagctgatatgaatgatgagtgacacaggccttggggaggactgcactcttatattcccgtgtggcctcccagcatgcatcctgcctcttccctcaaaaccatgcttaggacgcaccatctcctgaaaggctgaactctctcccatgtcactgcttcccctcacatgtgtatgtttgggtacataagcacatgtgtgagcactgtgtatgtgcatgtatgcatatgtgtgtgcacaggtgcatatgtgtgcatattatggtatttttctctcccccacaaggagccttcccagcatgcctagttcagcatccagtcctcacggccagcctctgagtccaaatttctcaccgtgtatctcaaggcatcggaatcacatggtgggtgtgtgtgttaaatattaattcctgggctccattccagacctgcttaatctgaatctctgggggtggggggagggtctgtcctgtcccaggaatcggtattttgaccagcaccctagagacttctgaaggaggtgaacttgggcctcagctccgaggaagggtttgggatcctgctctggcctcggcggtggcagggtctggggtcataggtctctccaggtctccagtctcacctcctaatctccagggacagcagcccgtagttgttggtgattcggtattttccggcacgaaagaggcggggatcaatccgtgtgtcatttttgtacctgtggggacatagcggtctgtggcaggcagggtggttctaagcgggaggggtctggagcctctcggatggggattccagctgcaggtttttgttttgttttgtttttttgagacggagttttgctttgtcacccaggctggagcgcagtagtacaatctcagctcactgcaacctccgcctcttgggttcaagcagttctccctgcctcagcctcctgagtagctgggattacagacgccttccaccacgcccggctaatttttgtatttctagtagagacggagtttccccatgttggctaggctggtctcgaattcctgacctcaggtgatccgcccgcctcagcctcctaaagtgctaagattataggcgtgaaccaccgcgcctggcctccagttgcagttttgtgttgcttacttgcctgtgcgattggagcagcacttacgccactctgagcctcagttgtcctgactcgtgaaatggcggtatgagaacactcgcctcacagggctgctgtgacaattaaatgggatgggcttataaagcctttcccctgtgcccacacaccgcaggtgctcaagggtttatttcccttctgggggcagagaagagggagcctgtaattaagggcagctgcccctccccctaccaagccatccccaggggcaccctaggaccaggccccagcttttcccttccctccgaaggggcttgccgtggaaggaaccccagacccctgccgctcttcccaacccctgaggatggctattcttcattttggctctcattacaatagccggaggagctttcaaaaatctccatgtccaggccgggcacggtggctcacgcctgtaatcccagcactttgggaggctgaggcgggcggatcacgaggtcaggagctcgagactatcctggctaacactgtgaaaccccgtttctcctaaaaatacaaaaacattagtcgggcgtggtggcgggcgcctgtagtcccagctactcgggaggttgaggcagcagaatgacatgaacccagggggcggagcttgcaatgagcagagatcgcgccactgcactccagcctgggcaacagagcgagactccgtctcaaaaaaaaaaaaaaaggaaaaaatctccatgttcagtttttgaacatacggctgtgggaatttgtatcggaaactgctaattattctccaatagccattctcgggggaaacagaatttacccacgggccacccaatatatgacggatctccttgcctctctttctgctcggtgtggccatatgacttagcattgtcaacagcaagcggggacaagagtcatgtggctgctcctgatgacaccctttgccccctttcacatcattgttccctctgtccttggcaggaacagggaggtgccggcggctgtctcacatgccgaagttcagggctgcctctccagtagtgatgtggagaagctcagtccctggggaatctgtgcagcaggtctgtgccgtctgcatccagacgtttagatggaagaaaacaagcttctagcttatttaagccattaaaaacaaaacaaaactccaggtccaggctgcatcccaaatcaatgaaatcagaatttcgggggggttagaccctaggatcagtatattgataccctgggatcagtattttgaaaatcccctggtgaggtcgtatgtggtggctcatgcctgtaatcccaacactttgggaggccaaggctggaggattgcttgaggccaggagtttaagatcagcctgggcaacatagcaagaccccatctttacaaaatattctttaaaataattagctgggtgtggtggggtgtgcctgtcatcctagctactcaggaggctgaggcaggaggactgcttgaggccaggagtctgaggctgtagcaaaccatgattgtgccactgcactacagcctgggtgatagagcaagaccctgtctcaaaaaaaaaatttgtttttcttaatgtcctctggtgattcccaagggtagtcaagcgattgccctgccctggatgccgccctcattttctgtgaacttgggtcttgttccccgtgttgtgtgaacaggacagtggggtggcctggggtcctggaggcctaaggagtaggggctgaggagtgagggtgagtgacacttaggaggcctggattttgacacagcttgctgtgtgaccttaggcaactccatacccctctctgggcctctgtgtccctgaagccatggaatggagtctcatgggatgaatgcttctctctgccctgtgtgggtggctgaggttgaagaggaggcctcccagagagagggcaccccagcctcagcctgcatccttccctggacctggcctcacccatgccatgtttgtctccagggcaaccaaacacagccacacccacgccccaccatgcagcccccagcctggccccctcctgaaaggagctccgctaaacctcccacagggagggtgttgcctaatctgggtgcccaatctctccagctctccaggcctgggggccagggttaggccccctaccacacacctgtcgggaagattccagacacctcagcctggccagctctgcttttcctggaaaaagcagctgctgtggctctggcatggccgagacagctggagacctcaacgctcacccctccctctctctgggccttagtgtccgcctgtgcagtcagcctgggcaacagaatgagactccatcttaaaaagaaaaaaagattgctttaaaaaaagaaaataagagcaggcatagtggctcatgcctgtattcccagagctttgggagactgagatgggaggactacttgaggccaggagttcgagacagcctgggcaacatagtgagactctgtctacaaaaaaattgaaaagttagccaggtgtgggggcacatgactgtggtcccagctacttgggaggctgaggtaggacgatcgcttgagcccaggaagttgaggctgcagtgagctgtgactgcaccactgcactccagcctggcaacagagtgagaccttatttctaaataataataatgataatcattgaatgaatagacttgcctaacaggtgagctggaatattcctccagccctggggctggacggaacctctggaggtcagtcctggggcaacatgtggccctgcctgatgtgattgatgatggaaaaccagatccaccaagccaggagtgccaggggccacctgagttgcccaggctggaggtggacctgggcttggcttctgccacttgtcaggaatgctcagctccctgttgtggcaacctcgttggcaggggtagaaacaactcccaagaggcttccaagaatgccttcaatgtggtcctcagtgccagggccgcgcagagcttggctgcggggaggacagctgagttgctaacctccacttggcctggccagcgctgggagcagtcctcctagtgggatcagcaacttgcgtgcggggatcgcccagtccccacagcatcccagtgcccagcaaggtacttggcatagtttttggaataaatgccagctgggaatgaccagccctgaggccagctccctcaagatcctttcttgattgctcctggcctgagtgatttctatttctctgtcttctgaagcattgtatgtgctttaaggaaagtaacacttataatggaacaggaattaaaagaaagtaaagaatgtgtaagcaaaaactcagttgtatgtaagaaaacccaatttcccttgaggaagagaaagagctgaagtcctttaaaaattaactgcctgtttttcggtggctagtgacccttatctctccctttcccaggcattgtgaagaccctgtttctctggctgtgcagctgcaaggtcactaggcagataaactcaagttgtaaaacacgttttgccttgaaaagtaagaaatgatgtaatgcgtgtcttaattgaataactgtctttgtttcatgcttctgtaatatgcttccccctgcacagatctccccccgccccacaaaatgcttaaaaggtagcttgactctttgttcatggctcagtcctttggatgttaatccgactgggttggtgcacctaaataattaaataattccttttcaacccctccatctctctgattctttaattatcccacagcagtaataatcactctcctaccctctaggccagctgaaagagttatgcgcttagaggcaggagacctgagtttgaatcctgactcacattggctgtgtgaccttagataagtcacactacctctctgagccttgatatccttacctgtgtaataggcataatggttcctatctcatgaatggccctgatgctcaaatgcaagtgaagttttgggtcagtgtgacgtggattcaaatataagaggctgctgttttcctttgtgttttccattatttgtgcccctgttctctctcctgctagaccataggctgttccctgtcaagatctggctcataggcaacctcttctgagaagccttcctggattctatgggctgaggtagctccttcttccttttcacccagactctttgatctcaaatatcacccacgagtatacttctttgtgtgttgatgtttcttttctgggctaagagttaattccttgaaggtgagattgtgtctggttatttcttttctttttttttgagacagagtcctgttctgtcacccaggctgaagtgcagtggcacaatctcggctcactgcaacctccgcctcccgggttcaagcgattctcttgtctcagcctcccaagtagctgggattacaggcacccgccaccatacccagctaatttttgtatttttagtagagacagggtttcccaagtagctgggactacaggtgcaggccacatgcccagctaatttttaaatttcctgtagagatggggtctcgccagctgcccaagatgttctcaaactcctgggttcaagtggtcctccctccttggcttcccaaagtgctggaggtgggcctgggcttgtttggttatttgtgtgccccagtgcctcagtcaggtcctgggatagatgacaccctcagtaaatatttgttgaaagcccttcctcatcccccagggtactgggcaatgggccttagacccagggggatctcaggaaagagtagcttagccatgtgaatgacacgtctcc

SEQ ID NO: 1295 - DNA, 84259 bp, Homo sapiens
gttgtcacttctgctgcacccgagggtccacaggatcgtgaagtgtctgcagtaaatgacatccaagcgaaggagacagggttttgaatgtcagaccttgaaaccattaccaaaaattctcatgaaagcggcgatgcttaaatcgagtcctaaaattttccatgaataaacgagaaggtattgaaagtgactgtaaaaagtgatgagacatttgccaaagagacttctgaaaatcattgtctttgtttcgtatggatggagtgttaaaagtatcttatatttcatttcttcctttccatcttcacttacatcatcagagggagatgcatttatgcgtaaaataattttttaagtaattgtaacttggcaaattttgttgatgaggtaattctggtgatcggtcttaagtaggctagtgcttttgaagtgttgctgagggcagactgatggtgaggtctttaccaagcctttctgaattacaagccatctgttgctttattccttcaaaagaggagtggcaataaaggccgaattttgttcttagcaataaatagccatattttacatttatctggtattttccttttgcaaagcattttcactggtaggtattatctaacctaaccttcaaacatcccccagaggtgggtggtggtattgtcattttacaaaccaggaaacagggtcatagaggttaagtgttttgctcttggtaggctgccgctaagtggttgccagagcctgagcttaaaaatcttttgacattaaatatggtttactttcctccctaacagctgcaatccagatacagaatgcagtagtaatgatcatatgctagatcttaaaactaaagatgtaaacgtgatgttcagcccaagctgcttcagtaacccacctgctacctaattccagcctttcctacttgccactgctaacgtataccaccaccataatttgtgttaaaaactgggctctgtttgagaggattctgcatgttcatcccagaaacagtgtagtgactgctttgaatattcttacagcatgataactgcagattctgtgagaatccctttgggacctggtgctttaatgcagtagtctgttgagcttcaggttaggcagcttcaaggaaaagaagtattttctttaattaaataatttgtagtgtaagaacattgaacaaagcaatctgatattttccttgtactaggcatgtttcttttgtaataaatcttggaagtttgtgtttgacaaagaacaacatgacttaaggcaactgctcagtgctttggtttcttatttttaccttttaaaagatggagagtgaggttatctgtttcatagggtgttaaagacaataaatctattttaatgcttcatttaataccatattttgttagatattttggtcttttgaaatcatcggcaaaatattggtgttgtttatttgaaaattttgatccctggaatctctggatcagactttgagaaatacgaaatactcttcaaatctatcatccgactcttcttactgtgtcatgtaattatgctaatttttcacatttgtaaggatgataagaatgaaaaaaactgatttcggtgctaaaaaattatgttactaaaagacacaggtttgtgtgtaaatatgccaatggatagttgaaattaatcgttctgccttgttagtttttttgtagttgtagacttctcagtactactgtgtataagtcttaccacttgtcaacctcacttttttctttaaaattaatgtgtaaaaatggaaatctctaagtaaaaagcattaccagttttatgtgtggtggtagaagtatttactcccctctacctacaaaatggtgctacaactgtaccttcatttgatatcaaactaatttgagatttcaaccggttagaaaataaagcaactcattttggagatccaaataaaattctatgacaatatatggaatattgaagaacataaagctgtgttttaagggatgttaaatactaaacgaaactcaacccagagcagcataatgctgagttagcaaatttaaatccaaggcagaaaatgcaagcctaggagtttgttttaatagtattactaatatggtgataattcattgaggtgggaaaaggctttaaacataacagaagacccagaagttccaaggaaaaatctgaaaaatttcagtacataaaaataaaaagcttttttatggcaaagcttaaaaaagaatccttaaatgacaaactgagataaaatacttctatcataagtgattcacgttccagtaagagttttaccctgccagggaagctgaggcaggagaatcgcttgaaccagggagttgcaggttgcagtgagccgagatcgctccactgcactccagcctggggatagagtgagactctgtctaaaaaaaaaaacaaaacaaaacaagaaaaaacttatactcccttaggaaaatgcctaagacaagcaattcacaataaacaaaatgcagatgttcaataagcaagagaaaaagtatttagcccttcctgcagtagcttgattttatgggggaaaaaaaaaagtacctagccttgtttataattaaatactgtcaagaccgcttacggtggctcacgcctataatcccagcactttgggaggctgaggcaggcagattgcttgaggccaggagtttgacaccagcttggccaaatggcacaacccgtgtctaccaaaaaattagccgggtgcagtgactcctgcccatagtcccagctactgtggaggctgaggcacgagaatctctcgaatcggggaggtggaggttgcagtgagccaagatcgcgccactgcactccagcctgggcgatagagcgagactgtctcaaaaaaaaaaaaaaagtcaaaaaaaatttatcagattggtgaagagttcaaagttttattagttttgcaaaggtatttacctttttgaaataggtaaatttatacaattttggaagacttttttttttttttgagacggagtttgctcttgttgcccaggccggagtgcaatggcgtgatctcggctcaccacaacttccacctcccaggttcgggcgattctccggcctcagcctcccgagtagctaggatgattacaggcaagcgccaccacccccggcaaatttttttctatttttagtagagacaggttttctccatgttggtcaggctgttctccaactcccgacctcaggtgatctgcccacatcgtcctcccagagtgctgggattacaggcgtgagccaccgtgcctggcccggaagactcttaatttcagtgtaaaaccatttggcagtatcaactgtcatttacaactgacttctcagtgttttgttttgtttttgagacagtctcactctgtcaccaaggctggagtgcagtggcgtgatctcagcacactgcaacctccacctcccaggttcaagcgattctcctgcctcagcctcccaagtagctgggatgcctggctcgtacaacttttgactcacaatttcaattctagggaattggcctagagagatagtttgcttaaggactatgggcaagcattactggaaataacaaagcaacaaacttaatctaaatatgtattgatacaaatctgttcattgtattaggtctagccatgcaataaagttcttgaaagaaatgagatagctatttttggtgccgaaaaagacttcagaaaacctctgaagtgaaaaaacaaagccgaagtaattatcactggcagaggaatagacagagatttctcaacagtggcagtattgacattttggacaggataattctttgtttgcggatgggagctctcctgtgcactgtaagatttttagcagcatcactatcccctgcccattagatgccagtagcaccttgcacccccacaccccagtgtgacagccaaaactgtccctggatattgccaaatcatggttgagaaccattgggatagacaaatagattagtacttagccttatttataattacatagcccagaaacagacaccaatgtatatatagaaataatgtgtttcagagatagaattgaagtacattgaggtaaatatggactgttgaattaatgatcattttgttacacctttggaaataaattatactagatgtctaccttatgtcaatatatagacagtcacttctaggttgagcagtgtagtgagaccctgtctctgcaaaaataaatatttaaaataatagccatacttggtggtgggtgcctgtagtcctatcttactcaggaggctggggtgagaagatcgcttgggcctaggagttcaaggctgcaagtgagctatgattgcataactgcactccagcctggctgggtgacagagcaagaccctgtctcttaaaaaaaaaaaatagtcatttctaagtgtattcttacctagatgtatatgtaaatatgaaatgcagaactttaaatttttagaaaaaaatatggaatattttatttttccaatcttagattaaggaagaaatccttaaaaatatataaaagcaaatacataatgaagattgataaaccgaatgatattgaggttaaaaacctatgttaatcaaaagatcgcaccactgcactccagcctgggcaacagagcgagactccatcactaaaaaaaaaaaaaaaaaaaaaaggaagtcaaatcttgggtaagggggaactactgtacttacatttacccatttattataaaggcaattacaaaggacacagatgaattaacccgatggaaggagatgtacaaggtgagacaaagaaggagagaagaggagaaggggcgtggagcttcagtgttcagctatctgagagctcacagaactcagtccttttgggcttctatggaagttcattaaataggcaagattgattagatcactagtcattggtttatggactcaagtttcagcttctttcttcccagaagtggcggctgggggtaggaatcaaagttataacccttaatcactgggctgattcccctggctacctagcccccatcctgaagctatctaggggcccccaggcaccagtcatctgattattgtacaaaacagtcatcactccagagattccaaggattttagaagctatgtcagaaaatgggacaaagaccaaatattaatattttttttatgatatcacagatgggaaagacaaactagaaaaacttgctttaactcttcatttaacacctctctgtagggtttggctttttaaaatccatgttcatatatttttgataaaagcatacttattataagtttagtttaaaagcaaaagtttaattttgtgttaatacttagaataccaggttttttttcaacctaaaatgagaatccaatagaaatgttttctttataatttatcaagtataccaacagattaacaacatttcaagacactttgttgtaaacttcattgcggaaggctcccttgggagtaaggtagtagtaacatttatttctgtgcttttccatatttattctgtcaggtattgaaatgtttttccacaggttgctttttgttttagaggtatttcgggtacttggagaattgtaaatattatgttttgtaccctgatttttagtcataagtttccaaaagagggtaagggtatgaatagactttacacataaaagagtgaaacactttgttatgtaacatgtatagtaagtttttattttttcttttgtttttatttgcctgtttttggtaatccaaattgaaaaggcctgaactctttcatgagttgagttcatatatagtttcaaagttcctgaattgatttggatacctgcctctttttggctaccttgaaaactctagtgaactctcttaatcactggagaattggactgagatctctgagttgtgatttcagtaaattctgttctcaaaattttttataaagcagcatttatatacagtcttgattacttgtgcaagtcacttccaaatcctaatgagaaactgtctctggacttttatattttcttagacctacagtttaaataccaagaaaggctttcatgtctaatgtaaaaatgcagtgaaactttgatattattctgcaaaggccatgagaaagatgattactttggagacttgttacttaggatattggtttttaaaatgagagcagattcttcccaaattccataggtaggaacgtgactataaaaggaaaatctatgaaccccatatacctacaaactttgggtaggaattaaaacaaacatatactattcttgaaatgttaactcactattacatcttggggggtgtgattttaatcaggatagagtattgtcagattgttacttgctgggatacatccaaattttgaggttgtagtcttactacattatttgtctatctgatgccttcccctttttttctttgatacatttgcataaagcaaaatggcactttttcactagaaatgtttctaaaacccaaataatttcttcatttgtgtgtagtaaaaacaagcttcaggaaaaaagttattagaattttaaaaattagttataaaattatggcaaagctcatgaatagttactgaagattaatttactactttgtgaatagcaagttgacaaaaataatttacagttcctgcttgactttctcccctctaagtggcataaagtagaactagagttattttgttttggttttgacccaacttagaagatttgttttaaagtttctgaagttttgtctcaggaaaataaggtggttttccatgtagagaatgtaagattacatatggcatctggtaggctgaattaattccattttcttgttaccttccatggaagaagtttctaataaaaaaatcttttcagggccgagcgcagtggctcacgcctataatcgcagtagtttgggaggccgaagcgggtggatcacctgaggtcaggagtttgagaccagcctgaccaacgtggaaaaaccctgtctctactgaaaatgcaaaattagctgggagtggtggtacatacctgtaatcccagcttcttgggaggctgaagcagaagaatcgcttgaacctgggaggcagaggttgcagtgagccaagatcacgccattgcactccagcctgggcaacaggagcgaaactccattaaaaaaaatataaaaaaaaatatatatatatataatatatatatattatttaaatatatatatatttaaaaatatatatattaaaaatatatatatatatttaaatatatatatatttaaaaatatatctattaaaaatatatatatattatttaaatatatatatatttaaaaatatatatattaaaaatatatatatttaaaagagcctgttctgagctcacaactctttgggggattattagtggcccattttcttggggaatcaggtggtttgtatttagaggtttatatgtcttctactttattgtgtccttttgttttccttttcacagatgacttgacattttggcacagaatacattttaaatccctggacagagtcatcacttaaatgaactagcccttgcttatatgtgcagtggattgtgaaatgcgtctactgtaataatatgcaatgtcttgattacctgctgaaataaggtggatagatggatttttattttatttaatatttatttatttatgtattttgagacagggtctcactgtcacccaggctggcatgcagtggtgcgatctcagctaactgcaatgcctcccgggttcaagcgattctcccacctcaaccccctgagtagctgggagtacaggcacgtgctaccaccctggcatatttttatatttttggtagagacagggtttcaccatgttgacatggtcttgaactcctggcctcaagtgatccacccgcctcagcctcccaaagtgctgggattaccattgtgagccaccacacccagccaagatggatttttaatttggagtttgtcactttttctgtactccagggtatggtttctcattgtctgaaacatagattttatttttcaagcaggctatattttgtggttgcctttaaaaacatccagatgtgacagacatttcctaatgaatactaattgtacttattttgtacaaaatattgtagaatccatagatggacagggtaggatctttgctttctgttatagatacatgtgtaatagggtagattatacttagataactgcagactacaatatcaggtgatatatgagtgttaaatgtttcactaagttctgcaggtatgctgaaagaacagtttctatcaaagaaagtaggtttctaggataggtaggatttgaatagtcagggattgggaggttggggacatcattccaagcaaaaagaatgtaaacactgctgtagctatagtggagaaaggaatgtgtttggggaatccaagtctggagcactgatgtgtgtgtgttaggaggaatattactgtaaagcaaattgggttcttgaatgccaggagcaagaatgtagattttagttgatagtaatttcagagccgctgaagtattttgagcagggaatgaagaaaggcaatttggtgatggcttgtaaatggatttggacaagatgagggttttttgagacagactgattgattggtgtcacagaaaagggagatagaggtgttagaagaatttggcaactaattggcaaagtttgagcatgtggggctgggttgggagtatctctaaaagaacaataatggtaccttcaactgaaatagcaaatcacaaggaaaagctgattctagtttaaggcaagtcgagtttcagaactttggagatttgcagttgtaggagtgaaagtaggtgagtattcagatgtcattcccattgttgaaaccttggataataatgtgtttattgtaatcctacttaaaatatgcatttctgtcagagtacaaagaaagatggtgtctatggagtgggggaaggagaattaccattttctaaaaacatgtcttggttttctgagtgttacttttgtaatgtgaagaacaataaaaagagttgactattttaagaaacagattcagcattatacaggaaaaagggaacttggaagatgtttctaagtccgaaggaaactaggaggaaaaaaaatggaattttggaccctttggagaatgctcagagttaaggagtaggaaataagagctggcatgagttcacagtttgaagaaaaggaggaattaagtggaagtataaaacttgaacttgatttcctaaagaatcctttaaaaaaaaatctaaaacttggctgggtgcggtggctcacgcctgtaatcccagcactttgggaggcaaggcgggcggatcacttgacgtcaggagttagagaccagtctggccaacatggtgaaaccccgtctctactaaaaatacaaaaattagctgggcatggtggcaggtgcctgtaatcccagttacttgggaggctggggcaggagaattgcttgagcctgggaggcagaatttgcagtgagctgagattgcaccagtgcactccatcctgggcaacagagtgagactcttgtctcagtcagtcaataataaatgaatctaaaacttaataggaataaatgttttccatttgggttatttttaacccaatttttaaaattaattttaatgattatgaaatgataaaagacatattcttttgagttttaaaacttgttaaaatgtatgtaccactacaaattcatcttgaaaataatttagtaatttggtgccttggacagctacagtgttacttgaaatactttggaaattagaaagtaaggaatgaaattttaaagaataatttagtatgtttggtctgttctcctgaactctgactttacaaaacctttattaccctttaagccttagttgtcttgaggcttaatgttcataactgaaaatattcatatttcctaattaaaggaagaatatcataactcttagtggggaaacattcttacaaatacttcattcaaatgactttttctttctttcttttaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgactaaaacaaaacaaaaacaaaaatggttaaatctccaagtatacatttagttctaaagctatataatatttttccacacaaaggaaaatattggcacacctttaatataataaagcttaacagttattaagtttttcagcaatatcaatagaaaaacttactgccagtaactggaaacagatttatggactgtcttgcatataactagagctaagaaccaggttcaagtaaattattaaagcagccatctgtattatgttcaccaattatagcattaactgagtggaaatgaagagtccttttcaattgtgagtcatagcatgttcattagtgggtcatgatgagcattttaaacattgacaagtacattgtactcaataagggtaagtactgttccattttttgttaggttttattatgtatgtgtgtcctaagtcacaacgtaatttgtactgtgggacagcagccacagttggaaatctactgctagagaactagtccttgagagacagcaaatgaaggtattaggttgctgcaaaagtaatatttacttggaaaaatgtgtggttattgagggcgagggctttctgtacctctacccttgcgagagaaataagcccaggtgtccatccttcagtttctttctttctctgtctctctcttccttcccttccctcccttcctttcctttctttttctttcctttcttttttttttcttttttctttcttttttgagacggcgtcttactctgttgctcaggctggagtgcagtggcacgatctcggctcactgcaacctctgccgcctgggttcaagtgattctcctgcctcagcctcctgagtagctgggattacaggcacctgccatcacacccagctaatttttgtatttttagtagagacggggtttcactatgttggctggccgtggtcttgaactcctgaccttgtgatccaccccacctgggcctcccaaagtgctgggattacaggtgtgagccaccgcgcctggccgcatctttcagtttctgtgcttacagtaatgatgatccgtagtgtctccatacttattatatataagtggaagatttttaatacatgaattagaaagttccaaagtccaaattgaacatttaaatattctttgcctaagctttttgttcccttagtatcttaaatgttaacacctaaaggaattaaggatggagatctaagattaatgggaatttaaaaaattgttttgtaatgtgacacaaaagccttgcttgatgtttatactaagcaaacactacactaaaattttatctgacagtcaagatacactaaaagcaaatctattaacatttaaattaagacagtgaaaatccatttttcttaggaaactactgaatgtccctctgtatgcacttctcagaattggaactcttgattaatgctgctgatgacacagttttgaaggtcacagcagctttgctaagattatattgcatagcaaattcattttattgaaatcgcttataagaaatctattgggctgggcccagtggctcatgcctgtaatcacagcactttgggaggctgaggcaggcagattgaactcaagagttcgagaccagtgtgggcaatatggtgaaaccctatttctagtaaaacaaaaaaaattagccaggcatggtggtggacgcctgtagtcccagctactcgggaggctgaggcaggagaattgcttgaacctgggaggtggaggttgcagtgagctgagattgtgccactgcgctccagcctgggcaacagagcgagactctctctccaaaaaaaagaaaaaagaaaaaaaaatctattggagcttaggacatcctattttactgtttgataatgcagtttatggaaatctttcttcgaataacccttctgtagccaagccatgctatttccatacatcttcagtggtcaaagctgcagttattccaaaatgaatataaagttgtttaatgtccctgagaatttagtggcttttgtttaatgtggcacttttacagtaagcacaggtttttgttttttttttttgagagagtcttacactgtggcccaagctggagtgcagtggtgtgatcttggctcactgtgtgtgatcacacagtggtgtgatcttggctcactacaacctctgcctctcagattcaagtgattctcctgcctcagcctcccaagtagctgggattacaggcgcccaccaccatgcccggctatttttttgtatttttagtagagacagggtttctccacgttggccaggctggttttgaactcctgacctcaactgatctgcctgcctcggcctcccaaaatggtaggattacaggtgtgagccactgtgcccagccaggcaaaggtttttaaagtcttgcaagatctacatgattcctaccctatctcctttccagcccttccccatactgatacaagttatagctttaaaaaaaataattgccactctcctgcttaaaatcctttgggtagtgataaaatctaagcaaaatgctggcatataagagccctcacaatctgggctcactctaccttcccagacttgacttctgcttacactgtgcatcctactttctgccacacttgttcctctggattagccaggcccttctgcagtctgcctttgcttaaggtgtttgtttgtctttctctggcctaactcccagtcatgggtaaacaactgaaatgtcaccttggtataactctctcctgtttcccctcaaagcagacagttgatgtgccctatggtcctggtcatagattcctacttgtataacagcactactatcttggactctgtctgcttatgtgctccaggagggcaggggtcctcgcctgactcactgaatgccttatctaaagtgccaggcacagtgtacctattcatctggtggatggataaagacagggactgtcttggttcttcctgtgtagccttagtaacttgtacctttcctgacatggcaggggctccaaaacatctgttgcaaacaatgtatatctaaaagacctctataaaaataattagaatgtaaaactgttaacagaatggaggttgagaaaatgactttgcaagtagcaattaacttgccaactcataattagcagtagattagaggattgtgtattttttaaatgtggtttaaatcttttcagcttgcagatgctagattttcctaagctctgcaactaactgaagaacaagtattgatgaagccttcacagttcttttttttttttttttgagatgtattttcacttttgtcttccaggctagagtgcaatggtgtggtctctgctcactgcaacctccgcctcccaggttcaagcgattctcctgcctcagcctcctgagtagctggcattacgggcatccgccatgacgcctggctaatttttgtatttttagtagagacaggatttcaccatgttggccaggctggtctcgagcacctgacctcaggtgatccgcctgccttggcctcccaaagtgctgggattacagatgtgagccaccatgcctggccagcctttatagttcttaaacagtctacatttaaaaacaccttgaaattttgtcttgcaaatatatagctaaagtcaacagctataatcttacataagattaaggaaatataaaaaacttacttggatacactgttggcaactacttcctgtaagctggctgctgtcaaaataccagtttcttttctctagtgtccttttagttccccaaaaaattggctgggtgtggtagctcacgcctgtaatcctagcactttgggaggctgaggtcaggagtttgagaccagcctggccaacatggcaaaaccccatctctactaaaaatacaaaaattaactgagtgtggtggcatgtgcctatagttccagctacttgggaggctgaggcaggagaattgcttgaacccaggaggcggagattgcagtgagccaagatcactccactgcactccagcctgggcaacagagcaagatggtctcaaaaaaaaaaaaaaaaaaaaagatttagaaatactgtctcatcactgaatttgcaagtacttacatttctttattttttaaaattttctttatttctttagagacaggggtctccctatgttgcctgagctgatcttgaactcctgagctcaagcagtcttcccaagtagctggaatacaggcgcaggccaccatgcctggctgcttcagttttaaagactttgtcagctcaagcatgttaataaaggaaaagaacctttcaaacatatttttatagaataattcttcactgttcttatctggcttatcttctaatactcttttcctgttaaaaactactgaaaaaaaagatggtgcatatgcaatgaatagtcttaaaagcaacaacctattttgttttcttttttacccctcatgaagacacagtaccaattagtttttgtgaatgtgttataagtatgcccaattgtctgaattggtaaatcatataagactgatataatctagattaatttaaattatctgtttgtgcaaacaaaagaaattggattatgtacccattaaaatgatataaccaccttctcctgtttgttacctttacagctctttgacagatgggtaatagcccctcttttcacttgtgctatatatatatcaccatttaaaagatgattctgatctgctgcttttttaggaaataaaacgtgctaaagtcccaccccctttgattggaaaaagggggtaggaaaaaaggggtttgtccttaagatcacttatccttttgttctgaggcttaaagaaatgtgttatttcttagatttatagaggctgtcaaatcatttaaatccaaaatattctgctaaggctttcttgttaccaaagagtagcaggaagctgcagtgagaatggaacttaaaccaggtatgcaaattcctccaaatcactgcattaatatggtggtcttgaacctgaacttcacttggattttgcaaaattttaattctgtcccttgcgttaattttataagtggcatctggtggttaactaatgattttgaagaccatgaaagcaaaatactcacattatatggcagggttcatttctgtcttttaagcagtgcccactttcccacttctttttggtaggaaatgcagttcttatatattttgatccagcatgtgtacttttgactccacaccaaggtgcatctagttaagcaaagaaagtgtctcgtaaggggtttacatttttaaaaattttttatgaccattatctaatatataacctctaaatgataaaccgtgattcagcttccaaaatggcacagttatttcaacagaaaacagttctaagaaaagcacaagataaaatcttgaattgcatcttaaataccttctaagactcacttctattccttttttctgctaacattgttggtgtgcagcatgctttaaaaaaaagacctaaaccttaaatacaattgtataacaacatgaaaacatttaagttaaacagtttttttttcagttttcaaaatctttttcgctatgcatgtagtgaggtttgcataagttaaacaaatttctatctctactgaatgtgaaactggttttgaatattttttaataaagaattacacattttgcaaacatcgtacttttaatcaaatattttgttttcctgactgcccaaggaaatgaatgtgatttctccagaatggctcagtcttgactttcctaaagtccatggtataaggagagccttgacagggtttagataaaagttttagcttttcaccttattatttttttgagacggagtctcactctgtctccaaggctggagtacagtagcacaatctcggctcactgcaacctctgcctcccgggttcaaacaattctcgtgcctcaggctcctgagtagctgggactacaggcaagtgccaccaccacacccagctaattttttgtattttttttttttttttgagactgagtttcgcccttgttgcccaggctggagtgcaatggcgtgatcttggctcacagcaacctctgcctcctgggttcaagcaattctcctgccacagcctcctaagtagctaggattacaggcatgtgccaccatgcccagataactttgtatttttagtagagatgtggtttctccatgttggtcaggttggtcttgaacttctgacctcaggtgatccgcccacctcggcctcccaaagtgctgggaatacaggcgtgagccaccgcgcccggcctcaccttgttttaagaggcaacggattctaaaattcttatactaaaccaatataaattgttgcactgtacaaagtgctgtagaattaagccattataaagacactgtgtaaacaaaattctgaacagattttgaaacttggaagtgtgatgtgcttagtcaagaccccttgtttagctaagtactcgtaactacaacctcctgagttatattctggcatctcattttctaagtgcttagacatagcaaacttctaaattgaaaaaaatcatttgcatatgtttttccattaataacccccaaagatcttctggaaaacataattgttgaggttgagcatgctgttttaaaatacttgttcacttaaagtttgaagtcaaatttctttctccagctttcctttttgtttggtatggtttaatatgaaacaaagttctgaaaacaaacttacctgtctcaatcattaatttttcactaggaattgacttcaaaacttccaaattagcttcagttttcagtgagcttaaaaaaaagtgtatatttattttaaaaggcagcaattaacgaataccttttttcgtatcacaacttgtctaaaatgctacaaaaccaacccaaaaccctataacactttgttttcagtatactttggaaagtatttgcacacctccatacttcaacaatccagattaacatctattttaacccaatctgccttccggggatgcaattttccatgcttattagttggtttccaatagcgttctatatcagtctaagtaaaatttaactttttaaaagaattcatctgcttctgagtaatttgcgtaacttagaggtgcttctaaggctgtaaacgttcatttcctgaattttccatttttagcccaagacagattcttcactctactttagcagaattatgtatctgcacccttgccatggtttctttgtaggatgaactctattccttgaatctggcgttggcctcaagacttgctatggctgcctgtggcagcctctatcagccaaaacccagctgactcaaagatccatgaatgcaaacataaatgcttcctgtaatgtggcagtgaggtttgggatggtgtagcatataatgtgatgacaactaatactgttcttatattactttaaaaacacaatttctctaatcacaaatttattttaaattactttttagagcagttttaggtttacagcaataaaaagtacagagattccccaaccatatgctcccactctcaaaattctacaccatagtggtaggtacgtttatcattgatgaacctaccttgacacaaaactgtcacccaaaacccacagtttacatcagggttcacttggtttcatgtgttctgtgggtctggacaaatatgcaatgacacgtatctaccattgtggtatcatactgaatagtttcacggtcttaaaaatctatggtccgcctattcatccctccttccctctaaccccttatcttttgacagtctccatagttttgccttttccagactgtcacatagtttgaattacacagtatgtagtctttttcaggctgccttctttcacttgcaaatacacattaaaatcccatgtttttcatgcttgatagttcatttcttttggcactgaataatattccactggacataccacagtttatccattcacctactgaggaacatcttggttgcttccttatgtagcatttttaatttcagcatttgttattacaaagaatttaagatacacattaaattaggtaatatggacctctcatatagttatcacccagccccatcaatcaacacatggccaatccagttccatccacttacccctattcctctcctgtattatcttaaaaggaaattccagatggacagttttaatatttatttcagcatttaattcaggatgtttcaacatgtatctctgagcataaggattcttgtttaagaaaaacccaaatcttctagtattcaaatttccagttgtctcagtggcatacattctaagtttgattaaattaggacacaaatgagaggcccacacattgcaattggtcattgtcttctgaagtctcaacttattaaaatctcctgcatcttttcccccttcaaatttatctgttgaagaaaccaagctgttcacgctgtggagtgccctagtcttgattttgctgatttcatctgcgttgcagtttaacaggttcctctgccctctgtatttccttctttcttcttctttttttttttttttgagatggagtctcactctgttgcccaggctggagtgcgttggcaaaatcccggcgagctgcaacatccacctcccaggttcaagcgattctcctgcctcagcctcccaagtagctgggactacaggtgcctgccaccacgcccggctcatttttgtatttttagtagagaggggggtttcaccatgttggccaggctggtctcgaacttcttacctcaggcgatccacctgccttggcctcccaaagtgctgggattacaggcacaatccaccgtgaccagcctgctctctttatttcttatagaagatctcgagtaccatctacaggctggataggatttgggttggattttttgtggggaagactatttcacaggtggtggtgtgatctttcatccacaggcatatatctggtggtatttttgtgatctaaggcagccatggatgcccaatgcataattcaccaggagctagaaaatgctgatataattctatcagccctttacttattagagtacttccataaaaagaaaattctctatgtctactacttgattgctcaaatatatgtagtttgtataaaaaaaatatgtatctttctgtcaagtgttgattccctagcttcgtccaatggtgctattactttaacatcaccatttatttataatctttaaggagctcttattcttttatgttcttttagcattctgttcatatttcatgtctgtaacatctcaaatcccactatgttgggtcgcactggggttagtttttctatttatcttggccttttttctttcatgcttctggttcacctcattcgtctggtggtccttggatatccatttatattttgggaggttgctagtgttgcgtttcctttgcttttgtgaaagcaggcctgttttactgccagttctcttctcctagtggggattcttagtgggaccttcttgtgggagtgggtatattatgaaacttcatttaaaggtaagagtatagggagctaattgttaggctcatggttctctaaatgcttttctttggggattgatgtaagcactccaagccctagtcctcaccatacagttttttcaattttcttaagaaaacccccacccccggcccctgtgtaaatgtttactgcttttgtcctctatgcacaggagtggatatgggagtgagatcttttctctatataggccctcaattaatcatcatttctagtccgatttcacactaattctaggcccaaagcccccctattggattttgctagacttgctcccatctcttctgaggccccttagtggtataatctaagctttctctttcagtttcacctgtcttcagaaatctacagaacagacggagtctctcactatcacctgggctggagtgcaatggtgcaatctcggctcactgcatcctctgcctcccgggttcacacaattctcctgcctcagcctcccaagtagctgagattacaggcgcacaccaccacacccagctaattttttttatttttagtagagacagggcttcactatgttggccagactggtctcgaactcctgacctcgtcatctgcctgcctcagcctcctgaagtgctaggattacaggcatgagccactgcgcctggcctctttttttttttttttttttaatttaagagatgggggtctcattatgttgcccagactggttacgcctatagctctagctactgaggatgctgtggcaggaccatcacttgaactcctgagctcacccaactacagaacatttcttagcaaaactctggccctttttctttgctattacagattctttcctttttcagtatctataattttattttagtaggattttaggaggggtgggtgagatgtcattagtttgacattaagtagcaattagtgctctctagaaaaacaaaattcttattttcagccagcttggtcaatacagttattttctaaaatatattgatgtgcttggtatggatagtatatttagaacttttcactaaattttcagattatttgtatttttgatctcactaaatcatgtctgattaacttaatattcttctgtgtctattctatgactgtaaaatttgcccaaatatatatactaataaacattttaaatacaagccagtatttctatttaataaggcttcccatttagtgatgagcaactacacgattctgaagtcaagtttgaaatacatcttcccattttctttttttttgagatggagtctcactctgtcgcccaggctggagttcagtgggtgatctcggctctctgcaagctccgcctcccgggttcacgccattctcctgcctcagcctcccgagtagctgggactacaggcgcccgccaccacacccggctaatttttttgtatttttagtagagacagggtttcactttgtcagccaggatggtctcgatctcttgacattgtgatccgcccacctcagcctcccaaagtgctgggattacaggtgtgagtcactgcgcccggcccccatgttctttttttttttgagacacagtctggtctgttgcccaggctggagtgcagtggcatgatttcggctcactgaaacctccgcctcctgggttcaaacgattctcctgcctcagcctcccgagtagctgggactacaggtgcccaccaccatgcccagctaatttttgtatttttagtagagatggggtttcaccatattggccaggctggtcttgaactcctgaccttgtgaaccacccaccttagcctcccaaagtgctgggattacaggcgtgagccacaatgcctggccatcttcccattttcttgggggaaaaattctaatttaacttttaggaaccaaagactttatgtaatatgctactataagtggattaagttatcattcctcagagactcagattaagatgataatgaattagatttgaaaataagaatataaacatccactttaataaatgactaacctattaattctgaagctaatattaatgtaggagaaaagaatcttttgtgattagcttaaactaacatcctaatgaactcaagatcatttagaaatatctaagacaggagccaggtacggtggctcatgcctgtaatccaagcactctgggaggcagaggcaggtggatagcttgagctcagaagtttgagaccagcctgggcaacatggtgaaaccccatctctacaaaaagtacagacattagccaagcatggtgataggagcttgtggtctcagctattatacttgggaggatcgcctgagcccaggaggtcggggctacagtaagtcgtccagcctgagaggcagagtgagaccctgtctcaaaaaaaaaaaacaacaactaagaattatggttttaagttggtaaaataaagatcttctacccccttctcttaaaaaaaaaaaaacaaaaccaaacttacagggagaaaaccaggatttttttaaatgaaactaggagacatatgttaccccaaatcacaacatatagctgaaagtggacagagaaatgataaaagaccagtgtttaagtgccaagtaacttaaatgctatgtgcctggaaagaaagacaaacaaacctagaagtagatacagtccctagaaagtggagtaaggcagggactgaaatggagattctttgagaaaactccaagagaagatggggttcctaggttatgtatctgtgacttggtgcagagaaagaggtgctgggtctcaagacaatccacatcagaaacagctggagaacaacaagcacagaggagtacaggcgtcaggcacaggcctgagcatggagactggggcagcccactaaacagtgagatcctctaacccatcctgctccaaaatactgtcagggacatttacaaaccccttccctccactgttccccacttttccagcagagaacacaggatccctttctggagaaactgaaccaacccagaaaaagatctctacaaactgacatttgggaatccctagcaaaaagtcagttggccatctgagcctgccagttgctggaatgccttctagagagcttccaaatggcttttttttttctttttttaaatagacagtgaaggactgcctgacatttgaagaaagtttccatcatcacagagaccaaaggaaagaagaaaaggtgactgtgaggaaacaaatgcaggaagacaagcagaaagtaactttaaactataattcatgtctttagagagatgagaagacactgcagtataaaaatagagtattcagaaattgaaaacaaaagttgaagtaaatttcataaaaagggttacaaaatatagcactttttttggaaggagggaaacaatggaaatagaataaaaagaatacgagttatcagtctagtatgcccaagaaaagaacagaagagaaaaatcaaattccaaggacgggtaaagatgtgccccccactggaagggctaatgaaaaagcaacaccaggcgtgatgaaaaccatcaacacacaccttcgtgaaatttcacatcagagatgaaaaactaaaacctttcacaagagaagaaaactaggtcacaggtaaaggattaggaatcagagtagcaacttttcatcaacactggaacctactgatgggacagtataaattctcaatgaaaatgatttctgatcttgaattttattcaagagaactatccattgaaagtggggggctgggtgtggtggctcacacctgtaatcccagcactttgggaggccgagacgggcagatcacgaggtcaggaggtcgagaccatcccggctaacacagtgaatccctgtctctactaaaaatacaaaaacaaaaaaaatagccaggtgtagtggcgggcacctgtaatcccagctactcgggaagctgaggcaggagaatggcgtgaacccgggaggcggagcctgcagtgagccaagatcgcgccactgcactccagcctgggcgactgagtgagagtccctctcaaaaaaaaaaaaaaaaaagtggggttctctcccctttcattaactatccaggctaacttgtaagaggaagagcagaaaaaaaattcattttcaaaatgggaagatgtatttcaaacttgacttcagaatcgtgtagttgctcatcactaaatgggaaaccttattaaatagaaatactggcttgtatttaaaagaaacttaattcccatgaaaacatcctcagaggatgttatagaatgtgttccactaaaacaaacacgcaaggaatacatgggatctaaaaataggaactagtccaaattgaaacacatggaagggtctgcaactgacggaactattagattatctacataggtttgctcatgtggtatactgtgcttaacatttcttttcttgtactactttttgttttcctggattaacctccctcatatttttatttacttggctttcttaaacttgaagcccagcctgggcacatagcaagaccctgtctcaactaaaaatttaaaaaatagccaggtgtggtggcatgcaccagtaataccagctactcaggaggctgaggtgggagggttgcttgagcctgggaggtcaaggctgcagagttgtgatcacgccactgcattccagcttgggctacagagcaagcaagtccctatctttaaaaagaaaccaaaaaacaaaaaacttgaaaccctctcatacttggcatagcactgtgaaattatatatttatataggcataataaggaaacaacatttatatagacataataatgaaaacattgagtatgcatataaccaaaaattctgaaataacgacattgagagtgatatgcagagaatggaggtaggggattagtacgggatataagaactaatgtgctcatataccccaatgagaatagacaaaggggatgaatcaagagacaatagtatatggatattatttagaaatatggtgacaaatagcaaaattattgctgctacaaaagctgacttggggtaaggtcatgctggggggactctgatatttgttcatatctgttagtactacttgactttttaatctctatgcatatattcccttgcatattaattaattttaaagttaattaaaccattaatttaaatatgaaagcatcttagacatttaaactctgaactctagagcaaatacataattccatgattctatttccctagattttagtcaaaaataatgcaattggaaacataataattttaagggtatgagacaatgaagaaggacagaaactcctatactattttgcaactgatttaataggctacactgacatcctgtgaaaagtcactggtagaagctcttacatatgtgacaaaaccaacccagagacctagctgtgctagctgactgtactgagtgtgtgaagtttagtgtggtacaacagcagaaagatcacagagtgagaagccagaggacatgggttctcatacttggagaaactctatacctgtttcctaatttctttgagcctcggtttctttgactgcagagatgtatgactgtcacagaataaaccgttcgtccatagtcagatatgacgtgtatatgtatacataatgctgtgaacacatgttttcaagggatcaaatgacctgagaataaattggattaccagagaaagccagctgcagatctcaacacaaaattgttttccattattagaacataatgtagtagtctataactttcgagctttaacttttaatagtaatgtactgtttaatttcttaataaataattactgaaattcccagcaaagatcaatgcaaacacacacaaactttaatgaaaataaatcttcatcagcaattcactgtaagacaatttaagaaatctgcttaaataaaagttaaaaaccaaagcaacctaagaacgtaccaaccattaaatcctatataaagatccaagtcaatcaaagcagctgctgcttccttggtaccatcaaatgaatgcacctggggacatacaggtataagtttattattataataattactctttaaaattctaagtgacattaataagactttgtaggcaaaaatatagatccctgtaagtttttggacctcagggtttcaaaggtggtagtcgctataatttttattttcatattatttttcacaattacaacctgtcatcatctccagtgacatgatgcaaaacgttagctgccgagaatttctctctttagagtggcagtgttgctgtctctgcactagcattagtgcagaagctccaggaaggggtttaggaatagatatattcttaggcaaaaacatgaggaaagcttagtaattttatggcactatttaaaagaatttttaaaatactgatgaattttctgttagaggatacttttttttttttttttgagatggagttttgctcttgttgcccaggctggggtgcaatggcgcgatcttggctcactgcaacctccacctccctgcttcaagagattctcctgcctcagcctcctgagtagctgggattacaagcatgcgccaccacgcctggctaattttgtattttttttttttttagtagagatggggtttctccatgttggtcaggctggtcttgaactcccgacctcaggtgattcgcccgcctcggcctcccaaaatgctgggattacagaggtgagccaccgcgcctggccgaggatacttttttgtggaagagaaattacttttaagaggcaaggctgggccaggcgcaatggctcacgcctgtaaccccagcactttgggaggctgaggctggtggatcacctgaggttgggagttcgagaccagcctgaccaatgtggagaaaacccatctctactaaaaacacaaaattagctgggcatggtggcgcatgcttgtaatcccaactactcgggaggctgaggcaggagaattgcttgaacctggaaggcggaggttgcgttgagctgagatcacatcattacactccagcctgggcaacaagagtaaaactctgtctcaaaaacaaaaacaaaacaaaaaaagagacaaggctgaagaaattcttataaatgggtgagactgttgcttaaaaagcataaactgtaatctcagcaatttgggaggccgaggtaggcagatcacaaggtcaggagatcagcgaaactgtctcaaaaaaaaaaaaaaaagcataaaccattatataatcaataatatcagcttagcaagcagaagggattgagatgctatttctctccttcaaagatataggggtcaagacatagttttcatagtttggatgtatttatataatcaaaaacaacatataacaacagccctcctttaaaaagtaggttcacctaaacaagtgacatcacattactactgagtccagagagcctgaatacactatggataacatatttctcaacaataaagaagcctgcattacacagctgcctgcattattctttccttcaccatttccagctgactagaaaagatgccctccattaatatcgaaatcattttaaaagtgactcctcataaaccatttcagaaaactagttattaattatttggcaatttcttttttggtaaaagtcaaacatttaggttggatttgttgttgcttttgttaattttaaaaactattaatagaacccaagtaaattcttatttagaaataggctgggcacagtggctcccatctgtaatcccagcactttgggaggccgaggcaggtggatcgcttgaggtcaggagttcaagacccacctggccaacatgatgaaaccctgtctctactgaaaatacaaaaattagccaggcgtggtggtgcgtgcctgtagccccagctactcgggaggctgaggcaaaagaattgcttgaacttggaagacagaagttgtggtgagccaagatcgtgctattgcactccagcctgggtgacagagcaaggctctgtctcaaaaaaaaaaaaaaaaaaaaaagaaaaagaaaaaaagaaaagaaataaagcaaatgggctgagaggtagagtctgaaggttaggataaataccactaataatcccaacggcattagttaaaactaaaacccctctcaattcttaagtacagttcctacaggataaattacagagtaagtaaaaacaggaaaaaattacagagttagtacaaacaggaaaaaagtgcacagtaatattaacattacagcaatgcaggatgcatacatattactagtagtatagatgaggcagaggttgaacttagagaatacgcataaaactgtcaacgtcaggccgcatgggaatgcaagtgcttggtgctatttcctctttccttagcaggcatagtgtaactgtgatttaatctacctggattacagttcttttgctagacacagtcactcactgagtcactctcctgaaattgcatatgaatatatgtatatctgagcatttttctaaggcaggtttccaaaggagtccatgatcgaagagactaaaaatcatggctgggcaaggtggctcatgcctgtaatcctagcactttgggaggctgatggggggaggatcatgaggtcaagagatcgagaccatcctggccaacatggtgaaaccccgtctctactaaaaatacaaaaattagctggacgtggtggtgtgcacctgtagtcccaggtacttgggaggctgaggcaggagaattgcttgaacccaggtgacggaggttgcagtgagctgagattgtgccactccactccagcctggtgacagagcgagactccatctcaaaaaaaaaaaaatcactgccatagatatcggaggtatgtggttagcagatagtatttatgggaaatgtctccagaataatgactaaaatggctatatcagagaagtgtttagtgcagaatgcaaattacagaaaggagaatgactctctagatcagaatagtaggtgaatacagcggacaagaaatgagaaaggcaaacctaaaacaaatggtaaaatatttcaaaacataaaaattagtttatatttgctcaaaatttggatggaagaacattaaagaacagctgacagaagagacgaagaatatcatgcacagcattaggatgtgtagaattcaagggccaggcacagtggctcacacctgtaatcccaacactttgggaagccagggtgggcagattgcttgagtttaggagttcgagatcagcctaggcaacatagtaaaacttcatctctacaaaatatacaaaaaaattagctggccatggtggcacatgcctgtagtcccagctacttgggaggctgaggatggcttgatcccggggaagcagaggttgcagtgagctgagattgtgccactgcacttcagcctggatgacagagccagaccctttcttaataaccaaaaaaaaaaaaaaacaaaaaacacacacaaaaaacaaaaaaaatttcacagggttttcttgtgaatggaattctgtacgcattcttgtactttgaacaaaggaactgtaattaaaactgatttgtgtttatgccacacctggtccataaattcaacagtaaatttacatgtctttcaaaggatgggaaaagaagctcctaattctattgaattctatctaattcctatgtttttctttgttattcctttttaaaaaaaatttaaatgttgacatctgaattaggggccatccttaataaccaagatgctttgtgtgtcacataaatgttaagtatcccttatcccaagtgtgtgggaccaaaagtgtttcatatttcagattttttcagattttggaatatctgcatatacataaaaagaaatctttgggaagggactcaagtctaaacatgaaattcatttatgtttcacatacaccttataccacaccctgaaggtaaatattttaaataattttgtgcgtgaaacaaaatttgtgtacaatgaataatcagaaagcaaaggtgtcattatctcatgccagtgcttaaaaaggttcagattttggagcattttgtacttgggagtattttggatttttggattagagatgttcaacctgtattaaaaatgactattttatacttaccactccccctacacaccgatctctatttcttttcattatgtctgtgaattaaaaacaaagaacttttagcaaatagcttgatttctacaaaattcttaagttctgaatgagactttggttttaactcacccaaaaattcagcatgtgagtttcgacaatgaagaaacattggtaattttgtttgttctgacagttcaaactgtttttcaaaatatctgcataatgcaaaaaaaaaaaattctcattacaaattgtattttagcatgaggaaggtaatgatgtcaaaagagcttttaaattaaaggtatttaattctctagaaattacaggacaaaaatcatgaatatttaaagcacatcaggcttatcaaagggcttttataacttacaacttctggaaagaaatacttcattttctgggcttacaaaattatctgggccctttaattttcagaaagtaacaccactggccccttgccactgggagcaccatcagtgggagtcaactcaccaagcgagaagcccaggagagcttcatactgcatgctaatctattccattttgcaaccagttttttatgtgctgttataaaagaagttattgccactgggcaaaatgaacaaggtttccctcaaaaatgaaatctaagtatttgctaaacagcaaataactcaattatgctattaaaaaaagaaaattacatgataaagtggtagccctgaatatcttaaagagtacttgataagaaggtttttccaagtaccagataccattgtctcatttgatcctcaaaataacctgagtataaaagctggtgtcagagaggtgtagtactttgtccaagataacaatacctggcatggccaacttggaacagaacttcactgctctaattccaagtcccagcctaaacgacaaaaacctgttacgttttcaagaagcttccttctggtcccggagtataatgacaatattcagaggatacaacgaatgttcattctgtttgtcttttcacttcaacacagtgctcccccttgttctcacaaatggtaggttcaactgaatcaggataacaggtggcttattattttcttaaatgtgcttacctcttctaagcactttaatttggggaaacaatttctctgtttaacttaagcctctcttgctatatttttctatatcatatttcctgatgtgcaggactattttaccccctttgctctcttgaaaatgctaaattttaaaattagaaatagaaatgtacttcttaagaagcagtcttcaggccgggcgtggtggctcacacctgtaatgccagcactttgggaggccaaggcgggtggatcactcaagggcaggagttcaagaccagcctggccagcatggtgaaacctcgtctctactaaatatacaaaaattagccggcatgttggcacatgcctgtaatcccagctattcggcaggcatgagaatctcttgaacccagggtcagaggttgcagtgagctgagattgtaccactgcactccagcctgggtgagagagcaacattctgtctcaaaaaaaaaaaaaaaaattaaaaattaaaaaaatagaaatagtcttcctaaaataggtcgtctatgtctgtattaccaaatgtttgggttttaaaatctccttttcagattctgctgggttagaataagcaaaaatattttcctttcattaacaaagtgctgaaattttgcagtgtaggaaatattaacgacaacttggacaaaaagagattttgataatataaccagtcactatttccataacctctaaagtaaaccaaatgtcagcagttaagtgtgcactagtcattatgtcaactttactaatatatttggctctgactacacacagcaggcggtactcttcattgtgtgcactgctccacgctgtactggttattttttccacacacaattccatggaccaaaccacatgaccaagctacaaattcacagtatctaatggtcggatggaaaattagcttcctataggaatgtaggcaaaagtacagtttatgaaaataacagaggccagctgggtgtgtggttcaggcctgtaatcccagcactttgggaggctgaggtgggtggattgcttgagctcaggagttcgagaccaacctgggcaacatggtgaaaccccatctctacaaaaaatacaagaattagccaggtgtggtagcatatgcctacagtctcagttcttgggaggctgaggtgggaggattgcttgagcctggcgaggtcaaggctgcggtgagccatgatcacaccactgcactccagcttggatgacagagtgagaccctgtctcaaagaaaaaagaaaaagaaaataacagaagcccaagcaatgggcccacagaattttacataattcaagaaaagaaaggtccctgaagtcatgctagctacgtatcataaagaagccatgtggtaaaaaaaattattcctaatgatacaaattgaggataactagtactgaacatcaaacgactattatctttagagaagaaaaacccgccatggtaactagaaataactgtataagttacagggtaggaattggcatctattaagagacttctctgcctgttttactcacttattatttttttaaagttcataaatgaaaataattttccacttgagttatttgctcatcttagtgaagcttctgattttattactgcttcttacagttgaggtttaactatctaacgacaagagctggaaaagttcagcttcaggagcagttgttattaattaggatcaaggcaaatccaaaaagcccagtgagtttcatgggtatacctcaacacaagtagtaatccctcctctgtaagctgcttgatggcaacatggcctcaattgctcatctctagggtcccctaaatccccaaaggattgttttaaaatcttcttgttgtagtttttaagacctgcacagtgttaacattttaaagccccaagaaaaatgcccaaagcaaattcctcctacccaagagaacagagctctaaattgcaacaaggaaaggagtgtagcataaggccaggaaattgaaaatacagggtatggcttaaaggataaactttccataagtagatcaggcctttccttgttttcactctttgcttctctttcttagtctttaaaaaatactttttccagaaaaggtctaggtactaaaacaagaaaaaagtattaaaaaaaaaaacttttaaaagttccaaacaaaaacaatagctagcatcttcctttagggtggtaattatttctagtatgaggaatgtaacaacagccatgattgtgcacatactctgcatgactcatgtcactatgggctttatgtgccttatgttaagaaaggtaggcagcaatctccccattttaaaggggatgcacaaagggatgaagtgacaccaaaggcagttgtaaatctcacccaaagatctgctgattccaaagctcatccttttaacatggtcatacaccgccttcacttaccattatttttcagacactacatctattgtatattaatttttctgtcttgccccctaattttctatttttcttttctcatacatctcctttttcctgactacatatttacttaaaaacaaatcatggccgggtgcagtggctcatgcctgtaaccctagcactttgggaggccgtggtgggcggatcacttgaggtctggagttcgaaaccagcctggccaacatggtgaaactctgtctctactaaaaatacaaaaaaattagccaggcatgctgatgggcacctgtaatcccagctacttgggaggctgaggcaggagaattgcttgaacctgggaggtggaggttgcagtgatctgagattgcaccactgcactccagcctgggggacagagtgagactccatctcaaaaaacaaacaaacaaacaaacaaacacaatcatacactggttgttccagatggtagaaaagtgcagaccaaaatctgaagtcttccaaaaataaacccaatagtgaaagctgaattataggctttttatccatgctgctcaaagggaataaaaaagaaaagaaccttccctctgtattaaatattcaacagacatttactaagtgcctaccatgtgctgagagtactgtgctaagtgctatggaactgtcacatgagtaagacttggtgtgtgcctttgaggaactcaaagacacctgtctgttgcggggaggaagggataatgaaaacccatttctgtacaacatggtaagtgctgaaacaagtagagtgctgtgtatacaaaacagattgcatgctgtgagtatatgcgaggggaaaaggagtgaggggcagagaatgtgggtatttgtttccttaacaataatcaaaatgtgattgttactagtgtgtcttttttttttcttttgagcggaatctttctctgttgcccgggctggagtccaatgtcacgatcttggctcactgcaacctcctcctccccagttcaagcaattctcctgcctcagcctcccaagtagctgggattacaggtgctcgccaccacgcctggctagtttttgtttttagtagagacggggtttcaccatgttggtaaggctggtcttgaactcctgatctcaggtgatcggcctgccttggcctcccaaagtgctggaattataggcatgaaccaccgcacccggctgtttttttaaccaagtcatttgatgttttattattaaaattttaaaaatctcaagtagaactgcctatcttatcaaaatttcctcctactttgtcattagcttatccactctggaagaagccagtgtcatatgctgtcaccttagagcatcccccagaaagtcagtccttccctctgctgttcacatactttagtaagcacttccaacctattttaattatttatgtcctctcttggaaaaagtcttattcttctttgtatcatgctgaggaggcacttggtaatcatttactgaatgtagtttgaacctctctattagcaattaacgcttggcatgtgagttcaagcacaagctgtgatatgcatattctaagatcagacgctattctgatgatggtgaagaatcttcagaacagttaaattaaactgatactgtcaatgttttcgattaatcccaaaagtgagtttaaagtattgaggttgcattttagaatcagttctaactcattttggatgaaaagtcatatgggcaaaaaaacacggggactctgccattgcccttgcttgtcataacacagtctattagacttacaaggcttatcctgaccaaaaccagacatgaaagttgaggaatatgatatctgggcttaacctaaagaactattaaagagaactgtttttctatttcaatgtgaacacgagaacttttaaggttaagtgagctggcctacataatattcgacagaggtatagggcttcagtaaccctgctagtaaccacatgaatgtccctgaaaggcacagcaaatcagcaaataatataccacaaactaaacagttctacaagggatgtacaaatgagcgacctaaaagagagagtaggtatccacagagcattacgttaacccatcctattctacttggttatagatcttcacacttcagaactttggagcttgaggtctagggtatgacagactccactagcagatctgctcctccccaaagtgattttcaaccagggggtacatatcagaatcccatttgtggggagcagggagggaagcgggaggaagtacactttcctcatgcgtaatttaaaaaaatcccttcaggccatcaagtcactggcttaatcatatgatcatatcaccatatgacaaaattattaattgttaaacattatgatatagctggatggtatcttaagagagaatctgatcctaattcttctttgtgtataagaaactaaggaggacagaggattgtttattcttaaaggtctctagggacagatattctaccttattcatatttctgcatactatgagctctcagcagtggctggcacacagtactccataaatatttgttcaatggatgaataaattaaccccctttagaagctcagtctaatgttttatcattttcataattaagatgtttttgaaattcaacaaaatgcttacgttttaaattcagactgtgacctaaattttcttttcaatctataacactcacccaccagtatgatgacaggagctccaaatttagctccaggcaatgggttacaggaagtcctgcagggtcgtgagctttggagttttctcagaagccaccattcaacatggctcctattaaaggaatctcacagttccaaactagcaatattcaatgcccagcaagagtaaaataagcttttctagctttggtgattgatcctataatacttttgtgggttttttcttgctggttttttttagagacggagtctccttatgttgctcaggctggtctggaactcttgagctcaagcaattctcctgcctctgcctctcaaacagctgcgactacagacgcaggctgctgtgcctggcttgtaatacacttttaatatcctttgctcttaaattatatctcccaatttgggaggccgaggcgggtggatcatttgaggtcaggagtttgagaccagcttgaccaatatggtgaaacccaatttttactaaaaacataaaaattagccgggcatggtggcacatgcctgtaatcccagctactcgggaggctgaggcaggagactcatttgaacccaggaggtggaggttgcggtgagctgagatcacgcctctgcactccagcctgggcgacagagagactctgtctcaaaaaacaaaacaaaacaatcacattccccaaaataatttaattcattccattggaactgttcacgtatgaatgcgtctgttaaacaagcaaacagaaaatgtaaaatctctatcatgtaaaactcatccctaatttctaccattacaataaaattaaatggttaatcaaccagggaactatgtgcttccatcccttatgaattacatgcaagtatgcatggaatttgtttcacttacttttgatatacaaagggaaaaacaaaaatatcctcatgcttaatccaactatactctcacctgatacaagatattttaaaaatcactcatgattttacaataatttgtaaagccaacaaatttccttacttgagttgagtatctttgggacaaaactgcagtcggtcaaaatctttaaaaagataaagaagaataattactcctaacttatacagaacaaattacttattttcaaacaatgtcactctaagaggcgaggctggcactcaccaagtccgcattctcctattgccacaactttccctttattgttttcagcaagatttagcaactcctttaagtaaagatcagggttattcttttcaaattcaccacatcttgtaggatgacatccaactgtactgaaaaacatacctaacagaaaataatgtcttaggattattttcaaagtattttctcatatttatatttattatgatatttagaggatatcaagtaatttcaactggttttcaacaatggcaataaattactcaaattataagaactgcattatgttaatcatatgacaatttttagaatacctaaacaaagtaggagatgaatatgaaaattgctttaatgtattaataaaataattcaactttttctaaagcttggcatttagggctgtagaatgcaaagtgaaatttttttttttttttgagacagggtgccactgtgtcacccaggctggagtgcagtggtgctatcacagcttactgcagccttgacctcctgggctcaagcgatcctcccacctcagcctcccacgtaactggggctacatacgcatgccaccacacctggctaatttttaatttttttttttttggtagagacagggtttcgctacgttgcccaggctggtctcgaactcctgagctcaagcgatccacctgcctggcctcccaaagtgctgggattacaggcctgagccaccatgaccagcactgattttatcttttatattcaccattcatgtgactatcttgattggtatatttttgtttgtttaacacctattcctccattattgattcatgtatttaatatagcaataaaaatgtattcccttaaacaggttaatagtgggggcgatttaaagtggtggaaagggggatttgtttttctagcaagtaaatgaggttcacttattcggaggagactctgacagcttgacttgcatagaatacaaatgagaagtcaaaaacactttttgaatggcttagctgagcccgaaccatgggaaaggtatcaagctttcctcaggctctcatgtagatgtttagaaaaaaaggaagcagcacttttaaagctgtaagaacagaagttacatggagaggagtggaagagggctggtaatggaggtgggagaactttaaaaagcatagctgtttggggatgaaaagtaaggataaaatgttcttatatatttcaaaaactccctggaagatagtctatctttaatcactaacaaaaagtgtcaatggggtgggtgaggtggcttacgcctgtaatcccagcactttgggagggcaagccgggcagatcacgaggtcaggagttcaagaccagcctgaccaacatggtgaaaccccgtctctactaaagatacaaaaattagctgggtgtggtggcacacgcctgtaatcccagctactcaggaggctgaggcaggagaatcacttgtacccaggaggcagaggttgccgtgagccgagatcgtgccattgcactccagcctgggtgatagaacaagactgtctcaaaaaaaaaaaaaaaaagaaaaagtgtgaatggatcctaaaagacaagtgtggattttagagagatttccataaaaatatagcttttagtaagttttcatacataaaggaaacacatcagtattttaaaatacaaaatttaaaaattatgtggaatgtttaattcctcagtgtctagcacgtaagataatgcaaaaaaaagtgaaattcgtgaatgccagataaatgaggttttacctaactaggattcctttaataatcagtcttaaaacttttaagattttaaacaaatgcaaaatgtatgaacataaagcaaggatatgagagattatatagtgttattatttgcattcctggtaccttgcacagtatctggtccatctagtaaaaatttaataaaatggcccttcacagcttaagttaaaaaagagtaaataaaaagcaactcgtatcttaaacacgttaaaacacacacatgaattccacatcaaaaacacctgaggttggctgggcacggtggctcacgcctgtaatcccagcgctttgggaggccgaggcaggcggatcacgaggtcaggagatcaagacccatcttggctaacacagtgaaaccccttctctactaaaaatacaaaaaattagctgggcatggtggcaggcacctgtagtcccagctacatgggaggctgaggcaggagaatggcatgaaccagggaggtggcgcgcgcagtgagccgagattgcgccactgcactctagcctgggcgacagagtgagactctatctcaaaaaaaaaaaaaaaaaaaaaaaaaaaaaaaggccgggtgcagtggctcacgcctgtaatcccagcactttgggaggctgaggcgggtggatcacgaggtcaggagatcgagaccatcctggctaacatggtgaaaccccgtctctactaaaaatacaaaaaattagcctggcgtggtggcgggcgcctgtagtcccagctacccgggaggctgaggcaggagaatggtgtgaacctgggaggtggagtttgcagtgagccgagatcgcaccactgcacttcagcctgggtaacagagtgagactccgtctcaaaaaaaaaaaaaaaacacacctgaggttaaactgtgtacctggagaactttattctcattagctgaaatcttaaaataatcttcattgagcagtatgaaacagttttataaacatctgatataccaatgagtactttgaattttgtcatcttaatcatgtcccatttaaatcagtccattttcctattgtttccagtcatgatccattgtattgtacctgaagcagttttcagaaagacttcttcaaaattacttaattcattttttttttggtaaaagaaatatgaggataccatttgtttgtgccaaatgcagtgcatctttactgtcttgtagatttccacctgtaatcataaactgaaatagaaagaaaataaaataagctgactttaatagggcagcaataacagtttcctaaacatgccttcctaccacttccttattccagaatgctctttcctctgtgactgccacacacctaccctttaaaattcagctgggagattacctcctatgcagagtagtgcctgactacacctcagggatgtatgtatgtgtgtgtgcatgtagaggtgcagaattcatcactagactctgttaaaatgtatttatatacccacctttcctattagacaatgcattccttgaggacagagatcaggtgttatgaaagcgtgaataacgaaatcaatgattcaatagtgttgattgattcaacagttctccaggtgtagtctggtaactcccagtaggtatgtgaagtcaaaactattttcctaacaataataagacactttctgtctttttcactctcactctactgcaagtgtccacaaggtattcaagaagctacacgatgtttgacaccaccagagactgactacagaaaaagatatgaaaattcagcaggcttctagtaacacagtcattagagatttgaaaaaacatacaactgtactcatgttgctaatttttttgttctggaatatacttatttttcataaaaatatgctatttatgttatccagtagtttcttattttaaaaggaatatttaaaatattttgttttaatttttaatatagtatgtatcagtaggtaagactcacacaaacaaaagctctttgggggtcctcaataataaagaatgtgaagtggttttgagagcaaaaggtttgagaatcagtgagttaatgcatgctaatgaattctctgtaggaaaacgtatggcttttggcaaataagcatacttctgcatagacccattagagtccgctcagtaattagaatgccatctttcctaatctgttaaaatgaaaatgtcactaaagagttatgtgttgatagtgagagcactgaagcagtgctgcgtaaggggcgccttcttctgaagacgtgattcaagtataatgatgtatatttttgtaaagcatacttcaaaagtctcactaaaatgaattcattctaggtacaacttagggagaaaacacaaaacgaaggtagaattgcaaatgataaatagatattttcatatagctatttaaatctttaatatgattagctattgcatatccattccggaaacatagccataattaaatccttgactatctgtaaagcagaagatgtaaggcagggcgcagtggctcacgcctataatcccagcactttgggaggctgaggcagatggatcacccgtggtcaggagtttgagaccatcctggccaacatggcgaaaccccgtctctactgaaaatacaaaaattagccaggcgtggtggcaggcccctgtagtcccagctacttgggaggctgaggcaggagaatcacttgaacccgggaggcagaggttgcagtgagccgagatcgtgccactgcactccagcctgggggacagagcgagactcgcctccagaaaaaaaaaaaaagactaataaaaatattgggaaaactttcttgttactaacatacctaaaactttaatactagaacagatgcctacatccagtatttaaattacgtaaaatactaaccaagtatactttttattttacctacaactttactaaatagttgaaaaaaacggcaagacaagagggcatcatctcctctcccagtgtataaaataacgatgatgggcctggcgcggtggctcaagcctgtaatcccagcactttgggaagccaaggctggcagatcacgaagtcaggagatcgagaccatcctggccaacgtggtgaaaccccgtctctactaaaaatacaaaaaaattagccgggtgtggtggcgggcgcctgtagtcccagctactcgggaggctgaggcaggagaatggcgtgaacccgggaggcagagcttgcagtgagccgagatcatgccactgcactccagtctgggtgacagagcgagactccgtctcaaaaaaaaaaaaaaaaaaaaaagataacgatgatgatgatctcatggtggtggcttccatcatacacataatgaaggttgtttatgccaggtataataccaaatgctttacactcaatattttatttagccttcataacaactctattaattaagtactattatcattctcattttacagatgagaaaactgaagtctagtgagataaaagactccaggttataaagctatgaaaaatgaagtaggggctggataccacgtttgttatgccctaactatgcttttaactactacactataaatgcaaggtattgaattaaatttcagtttggaaccatgtccaagtaaaaatcacttcagttctgtcattcctaagtgtgtgtgtgtgaataaacattaagattactcatggctaacacatgaaaatttaggagcctagtatttcagagtctgcagaaaagcattgtttaaagtgatttaccaagcagagtgactataatgagaaattaatgtaacttttatcttttcatattatttgtgaataataacaaataaaagtttagagttggagtctgcaaactcatttagtcagcagtgtcactttccaaaacaagttattcatcttggaggtagcagctaccaagtgtcctggtagcatagtatggaatttaaccttatttcttagtgtatgtgtgggctagctctctgttttaaagctaatttaaagaaatatctattcatttgcttagtagaactctctaaaaagccgtaggcattttattactgtaaaaatgaaagttttactccattatttaaatggtatgcccaaactataaatagctacacttggtgtcaggtacatgtatttttgattattgcttaattctgacaaatgctaaattatattataaaattgattaaaagttgcctcttaagcctggtaattcacataggtttaaaaaattttttttcaaggagcttttgccatttatcatatataaaaacaatacatgagatttgtgtaacttaaattgctatgaacagagtattttgatattttgtttcaattaactttctaatatcacaagtagacaatatgtaccccaactgtggcattggtttgttcctttctattctgcaaaattttaactaaaatttagttaaaaaatgaattttaaaaatctcaaaaataacaaaatggatgttacctttttaacaccaatctcgacagctctccctattacatcctgtaagtcatctgtaaaagataaactctgtattatgaaaacctggcagacaaaaatttgacttttttttttagcttctgtgcaaatggctatttgaagttttatatttgaaattataaacttctacaggtaagaagaccttaattaaactttattataaatgttcatgatcatggtttatcaataaatgtgtttcactttgtttacaggtttatccaaaatgcataatgagttctttttttttgagacggagtttcgttcttgttgcccaggctggagtgcaatggtgtggtctcggctcactgcaacttccacctcctgggttcaagtgattctcgtgccttagcctcccaagtagctgggattacaggtgcatgtcaccatgcccagctaattttattgtatttttagtagagatggggtttcaccatgttggccaggctggtctcgaactcctgacctcaggtgatccacttgcctcagcctcccaaagtgctgggattacaggcatgagccactgcgcccagccaggagttctttattatttcaattttaagagcggattatgttgcccaggctgctcttgaactcctgagctcaggcaatcctcctgcctcagactcccaaagtgctgagattacaggtgtgagccacaagactcagcttgaattatgcttttcaagatctcctgaggcagaaaatttgtcttcataggaaactattcgccttaataaaggaaatatttaccttgatgcttttgaacccccctataaattcctctgaacatagggtcagtcaagttgataccaatatctgtagaaagcaaaagtcactgattaattattgagtctctacatgaaacttgtacttaaataaaaagcttctgttactaaactttttgttcacacactcatctactcaaacaatatccaagtgcctaccacttgtcaactactgtgctagaaacatgggatacaaagatgaataggatataattcctgctttcaagaaactcaccgcagaactggtaaggcagatccattatcagacaattatgaaatattagaagtaaacactggtactatgggacacagaagaggaacacccaacctagtctggtggctggctcagaagaggcttccagaaagaagtcatcattgaactgaatcttaaaggatgagtgactgttatccagtggaagagaggtaactgcacaaagaggaagcagcgggagcaaagccttcaagatgggaaagagcacagtgcttgtaaagagctacaggctgttctggctgctggagagaagaacaattggccctctgtatctctgggatctggatctgcagattcagccaaccacaggtcgattgaaaatattagaaaataaaaataacaacacaacaataaaaaataatataaataaaagcacagtaaggtataaaaaccatttacatagcatttacatcaaattaggtattttaagtaatctagacatgatttaaagcatacatgaggatatgcacaggttacaggcaaacaccaagccattttatgtaagggttttggtatctgcaggaggttctggaaccagtctcctgccgatactgagggaagacagtgtaaggaagggagaggtcagaagacaccagactcagttatggtacagacacttgtttttaaaatactggatgcaacagaaagctctgttctgctgtagaatataagggaacatggggaacaacaagatatgaagtcagactgtgactggtcacaggcaagaaaaaaaaatgcctcccttattgaaaatacacataatttagcttttagcaggaggagaatctcaaaatttgcggtggtggtaggcagctgattaccaacagactccctacattatttctgccaagtttcagcttcttggtatgttctcattctaatttctgccaagttggtccccaggagtgtctgctccaccaataagacacaccttgaaagtgaatgggagtttagaaaatttaagagacagtgaagagagtattccaggcatttgaaacaataggggaaaaagtaaaatgcagaaaactacaaagatatttgggcactaacatgtcaacaaagatgggtgggatgtggtaccctttaaaagggctattaacatataaacatcatctaatactatacatacaatatagaagtttggtggaatggcccaatccaaagaattactatctagtttctttataagtaagtacaggaaattagataaatggggcagactgagaaaggaaacccagggaagaggggagaggcctttctgcctaaaataatccttcagagaggtttagtctagggtcaccgatcatcactgatcattaggaaaacagaaatggtctgtatctcttctagaccatttcccctttgtgcagtgttaagcaaacaattattcataacacttgtcaaagactctgaggaagcctttattcaagagagactactgacagaagggaaggttttgcagaagggggagggactgggctcaattttgaatacaaggacaagtgaggatttattgccaccaagtagaatggggatcaacagatgaaaaattactaagaggaaacatcaaaggtgagggaagattctgggtttactcaacttgatggatttttgctgaaggcaggccagagtgtcaggatattctgcttgaggatttgagatctgggatgggggaaatgagggatgagaaaggtctataggtcctggctgatgaggaaagcaggtcctacgtcccagtatagtctctgggtttatctgggcagacagaaatgcaggaagactccttcaaaagtcccttgacccaagtgcagtgagaagcacttaaaggccatgcagatgtagacagtggtaatcacagctgaccacccaccatccttccacactttagcatcatcctaatcttttttttatttttctttttaagacagagtctcaccctatcgcccaggctacagtgcagtggcacaatctcagctcactgcaacctccacctcccgggttcaagcaattctcctgtctcagcctcccaagtagctgggattataggcgcccaccaccacacccagctaattttttgtatttttagtagagacagggttttgccatgttggacaggctggtctcgaactcctgacctcaggagctccacccaccttggcctcccaaaatgctgggattacaggcatgaggcaccacgcccagccagtcttagtaaattcttgtaccctcgcactgctggcccagatagtcacagctcacccgcaacaaataagtgagtctttctgagcctcagttttctcactagtagggtggacataaactttctccttccagcaacaaaatgtggctcaaaaccaaaaacaaatatgaaagcattttgcaaattaaaagtcttattagcatgtaattattgggaacactgttattacaaacactgtaacatgccaacaacaaatggaatttgaatcagctttagccatactgtcataccaccttaagtggttaaggctcccgatccaagaatgcattatcaaatagccaaatgtgagtcaatatgttttgaacattaagactcatgatgtaatcatgaaaacaaagccactcaaaatcctatttatttaatttgttcaaaatgttcttatctatgttaagggatagtgagaaacaaaaaccttggatctgagaaatgcaagcacctttaaatgatcaggcccagaaaggcatttaaaatgttcacagcagtccaagctcactcccctttgagctacataattacttcttgaagccgcttgctatgtgggctctagactgacgccaagtggccctaaaatgccatacaccctatagttcaacaatacatagccaatcactaaccaatgttatttctgtaaaccaatgagaatccctgattaaccatttttgtaaccgcgccccaccttttgatttgtcctttaaaaatttgagcctctcttttgttctctggagcactccccaaggcaacttggaagtgtgtcctgggctgcagtcctcaactgttgtgcttgaataaactctgtaaactagattctgacctttttggttatttgaggttgacaatagtatcttttaaattaaaagtctctattagacataagcctattggcatgtaaactcaaacaaactagacaaatactgtatgaaaaccaatgtctagccagatccagctaaagatagtaagtagcttgaaaagctaagaaagtaagagatacgggtgggagggaatgataggaacaaaaacaaggcaaagtggaaaattgctacttctcattaggggagaaaactgaaggattcatacattcagtagcatgtcaccctatatagatcagtaatgtttctttttcattaattttcttcaaatagctggcttgaaaagcagcacctactttattatttaagagttcttcaaatattgacttttcgttttcaaaacaaagtaagagtagaaaacggcactgtttgtaaccaggagaaaaccacaactcttaagttgaagcctcagttattgggctcactgaatcgtgtcacatcactgtcacctatgatctaggaatacaaagggacagcaaataaggcacaatttgttttttagatattgctagtctttagatataaccccgagtttatagcaaatacgggggattagagaacaagctcaatgacactactatttagcaaacagacaaagccaggagacagactttctgtagggtgttgacttaaaatcacgagatctatacattagggaagaactttatttcttttattgacgtgcaacctgcaggctgggaagcagagcctttggctgagaacaaaagcaaccatttcaaaggaagaagtggggaacaggagttttacactaaatgggctggctaacgtacatatttaacaggttataggaggagctatgtatattcatgaaaggtggattcatgcgtgtatgataagcaaacatacatgttacacaaaccccatgttcactttggggtggagacttaacattaaaatgcagtaaaattaagctttatatgtcaaaaggtgcacagcctgagtaaaccagccagaactagtctgtgactggtggtcacttgtcaggaaggaatgcgcggtgaaactggtcagctgtcatgtcaaaaccacaaaaaaggaggggagtctggctgtggtgtcaggtggttggctgaagtcagcagaggagtgagtcttgtttctgttccagggctggtttctatttaacgcttacaaaaaaagtctggtatcggttagtgaggaagggggtgtactgaggtgtgaccaaactctcatctaatcatggctggaaaacttagctttcagagtttttctggggtctccttggccaaggtagtgtccattcagtcagtcgggtggggcaggggggtgcttagaaatttacttttatttcatgtttccccattttagccacgatctgctgcaagcagcaccaatagccaaatctttattttgtcccatgtcattgccagggtggtgtggctatctgtcccagatccatccctacgatagccaattggacatcctagatcaaccaggaatagagagatggcaggccctcactaacccgtaaggtataagagatataagagccaaaaggaatggctacaaaattaacttgcctgtaagttctacgcactgagccatcataattctggttttaacaggggacttcttgcagtcctattataagtaatttaaatgttaagaaagaaagtatgatggagactatgaatatgacaaacacttagcagtttgaaagggatttcccaggccagttggaagccaactaaatagatcattgagaggattagtagttcatagctcttgtaaccatttaaggttgtttggatagtctttctctaacagtgtcttttttttttgagatggagtctcgctctgtcacccaggctggagtacagtggtgccatctcggctcactgcaagctccacctcccaggttcacgccattcccctgcctcggcctcccaagtagctgagactacaggcgcctgccgccacacccggctaattttttgtatttttagtagagacggggtttcaccatgttagccaggatggtctcgatctcctgaccttgtgatcctcccgcctcggcctcccagagtgctgggatcacaggggtgagccactgcgcccggcctctaacagtttctatttcacctgaagtacttatgtaacaggaggtatgggccaaacaactccttgtttggctaggagaaaatctacggcaactttattatctagtactacttgagccaaggagtttagagacttttgttgagctacaaggctttttgcagtgtctgcagctatcttgaggtgggaaattaaagaaaaataaaattaaaaagatagagaaataagttttcctgtattagactgacttgtcccagaggcggcaacaggcacaacccagacccaggaaaagtcttgataatggtatctaatgtgctgtggagactctcccagcactccctcaacataaggagaagaaaaacaaattttcctttgctttatggtatgagtttatagattcttgttctctgtaactagtaacttcaagtattctgttttatctaagaagtacaacaaaggtcacgagaagcctgagtaggcctgaactacagctgcctgggccccacagtgaaggttatgggataagcccgtgcctaggcaaacctagataacggacacctgggttgcttggcaatggtcatgagcaatcctgagtctgtcctgcctctgtatccctgctttcacaccactgtaagcttgcttcaagctagcccacacccttttgtgaagtgtgtataaaagtcaagtgctgtctttgtttcgggctcagtctttggacctgagtctgctgggcctgagtgcactcaataaaagattctcctgtttcaacccgaggtctctcatactcctaaatcccgcaacaatgtgactaatagtggcaaagacttttcaaatcatatccttattgacataaatcccaacactcggaattaatattcccaggatgctttgatctgtatcaccttcacaccctgccaacacagaccttttagtttaataatggagagaaagggggtccttctgtaagtttgtgtaaggatacggggggttacaaaatatctcagcaagcatgaaccttctaactgtaggctgccgaggcaacagtgtgcccaaagctgtgcaggtggatcagaccttatgccacatacaaacacacagcctgaatggggggcacaagtgatactcctgaggatgtcttaattagcagatgtattcatgcggagtgctgacatcaccaaactaaactatgggccatttctcttgcaagctttccagaatccactcacttattttaaatgtaaatattgtgggcactgtagggatatatttttaactttatttatctgatgtagatgacacttgtctatccagtagttcataggtcaagaaggtcccatggtaggccgggtgcagtggctcatgtctgtaatcccagcactctgggaggccaaggcaggtggattacttgaggtcaggagtttaagaccagcctggccaacacagtgaaatccagtctctactaaaaatacaaaaattagttgggcatggtggcaggtgcctgtaatcccagctcttgggatgctgaggcaggagaatcgcttgaacccgggaggcggaggttatagtgagctgagatctcaccactgcactccagcctgggtaacaggccaagactcagtctcaaaaaaaaaccataaaaaacccaaagaacaacaacaacaaagaaggtcccatggtaaagaatgggtttccaatgttaaaaacacaggacacatcaaaacaaggggtgacaatatctgggctttgaaggaattggacctggaaaatcaacagggaaaggggttggtctgggtaagtggtgacattagggacatctgagcagtcagtgacagatattaccaatggcacatatctattatgaatggatcaaggaagttgttggcaaatccagcaatccaataggtttccttctactagcaacatgtgggacagcttaactaaagtgttatcatgccattctctgcattgagacaagacagagggacaattgcaaagagagggaaaggtgacagtgcaggtatgagtaaaaggaatggagggaacagccatttaacaattcagaaaactgaaccaagggaaaaaccataaatcccatacaaatccaaggggattatctgacaaacttaagggactgtccttaagtaagagaacatctcactacaggaacaaagcaatgatgtcctcaggagtgggggtcataagccctgctcagttctgataaagacaagaagaggaagcacacaggtagctaaacatcgaagttatctagcagaaaggcatggaacaaattctattagtttagatagaggcaaattattaaatgagacccagtgtctttgaatacagtcctggccctgggtctcatgaaagcagtttatgttgactattgcctttttctgggtctaaagatgaggctctggttaactgaagtctcgtgtagagactggcaccaacttccaagattcagcaagggttgttgttttcagatgagacatgtgcgaccaggagtcaatctctataacttagcagcacaaggattaattaatagcacccatccagtaggctggatgaagtattttaactgatgtctcttccactacttgtcatcaccaagctggaggtggtaatactggagtttatggcctgttgggaagctgtaaaaagattctacaacttgcagtgactgatctttatagctttaacaagcccctggcaataagcctaaagttccctcctgtcatttggcaggagaaaatatttcctggtctaagtgcacagaccaaccagtaacaatttcaaaaggggagagctgacatttactggtgggaatggactgcagaatcagtaatgctaatgggagagctttaggcaaggacaggttaagtttctgtaactttcgccagctcgctttcaatgatcccattagactgttcaactagcccagaggactgggggtaataggcacagtgaaagtgctgtaaaagggcagatttaaaaaacttgttctagtatttggcaggtaaaatgagtgcctctgtcgctgtggaattcagtgggaacaccctagataggaatggtttttctcaagcagcattttggccaccaccatagctgttgcttgtttacaggtgaaagacctacctcaatgagaatacatcgtcaaccattagaagaacaaaatttaatctgtgggatggtggtaactaaatgaaatcaagttgtcacatggttaagggaccctaggggagaggaaattgtcctggagggagcttcaggagttcacctgggttatactgagggtagatattgcaaagtttacatagcggtggggcaagagctggagagagccaccatacagtagtactgtctaccccactgaatcattttgtctggattctaatgggttagattatgtatgaaggttgtttgtctttgcagggtgctgggtaggactggatgtccatttggaccttcctgtaattttgtctggggattgcaagcgcaattttgtttcatccatttccctcttccagactccaagactgtcttttgtgaaaataagtctggaaaggtcttcagatggggaggggagcaaggaagaaggaagagcaagggggggaggaggaggaggaggaggaggagtgggttgagtacaactcgggaaggagccacatgctgggtggcagctttagctgctgcatccactaggtggttgccttcgctgtcttctgtcttgtcagagaaatgtccttcgactatgataacggctagggctcaatgagcctgaatggcatctaagagaaacaaaacagtctttgtttttgtttttttctgagacagagtctcactctgtcgcccgggctggagtgcagtggtgcaatctcagctcactgcagcctccacctcccaggctcaagtgattctcctgcctcagcctcccacatagctgggattacaggtgcatgccaccacgtctggctaatttttgtgttttttatagagacgaggtttcaccatgttggtcaggctggtctcaaactcctgacctcaagtgatccacctgcctcggcttcccaaagtgctaggattacaggcgtgagccactgcacctggcctagtctttgttcttaataggttgtccagaggaagtaaaaaatcctctttgtttctagagcatgccaaaatcatgggcaactccaaagacatacgtgctgtctgcataaatattaaccgtttcaccccaggccagtaggcaggcccaagtgaggggatgctaattctgctcgttgggcagatcgggcagttggctgggggcctgattcaatgattcccatcacagagaccaccacataggctgcataatggaagccagcagaatttttgagaaaggatccattagtgggtaagggggtctcccttaagtctatatgaggtgagagaaaagtgtctgtaaagacaacacagtctttgggtgcgttaatctcttattaaaggcaaaacggggccaggtgtagtggctcatgcctgtaatcccagcactttaggaggccgaggtgggcagatgacgaggtcaggagatcgagaccgtcctggctaacacggtaaaaccccgtctctactaaaaatacaaaacattagccgggcgtggtggcaggcgcctgtagtcccagctactcaggaggctgaggcaggagaatggtgtgaatccgggaggtggagcttgcagtgagccaagatggcgccactgcactacagcctgggcgacagagtgagactctgtctcaaaaaaaaaaaacgcaaaatggtagctacattaaggaggttacagtaaattatggttaggttagaagaggagaaaagtatctcataggaggtcaatcaactggcttaaagatgctgagtgaggggacaggtgcaaagggcctaaattgaatgagaaacatatacaacgagaggggatcccaggagtaattttttggtagccttgatgaggcctgagggggtggcaactgccctcagtacaggaaggaatgccttgtgaaactggtcagctgtcatggtgaaactgcaaaaaaggaggggagctggtcccaatgtcaggcagttggctgaagtcagcagaggagcaagtcttccaatctttgtttttccagggctggtttctgttcaacttgtaggaaaaaagtctggtattggttagtaaggaaggagaccaggaccaacccctcatcttgtcatgtttgggaatcttagtttttcatgtttttctggggtctacttggtcgaggggggttctgttcagccagtttagggggcttagaattttatttttatttcacaggcacaaccagcacagctgctttggtaagtcagtgacattaaaaaaagaaatgtgtggcagggcgcgatggctcacgcctataatcccagcactttgggaggctgaggcaggaggatcacgaggtcaggagatcgagaccatcctggctaacacagtgaaaccccgtctctactaaaaatacaaaaaattagccgggcgtggtagtgggcgcctgtagtcccagctactcgggaggctgaggcaggagaatggcgtgaacctgggaggcggagcttgcagtgagcccagactgcaccactacactccagcctgggcaacagagcgagactccgtctcaaaaaaaaaaaaaaaaaaaaaaaaaaaaaaaaaagaaatgcgctagagcaagggattggtaaactaaggcccacaagccactgcctacttttgtttgcctctaagctaagaatgactttacatttttaaatagttgaagaaaatcaaaagaatattttgtgacacatcaaaattataagaacttcaagtttcagtgaccgtaagttttactggaacatagccacacctatttacatactgtctatcacctgcttttgaatgacaaggtgtgagataggaaaaaatgcaaactgctttctcctacagtattctcatactcacaatactctgaattttttgtttgtttgttttaagtagagatggggtctcactttgttgcccaggctggtcttgaactcccgggctcaagcagtcctcccaccttggcctcccaaagtgcttggattacaggcgtgaggattcacttctgacgtcaggtatgtgtggggtttcctctcccaacaaccaattctctgacaccagctgggtgacctataatttaactcaattctcacactatctacctggatataacatcagaccgcagaggtcaagggctcagtcccacaagactctccccatttcagataccaattacaagcagtaggttcccaggttacccacaacttgtctaacttggctacaataagaggttcccacaacccccttctcaggtttgatcatttgctagagcagctcacggaactcaggaaagcactttacttattacccattcattgtaaaaagatgccattcaaaaacggccaggtggaagagacacatagagacatgtatgggtttttatagaggcttcaccatgtaggtatgattgattaaatcactggccattagtgaacaactcaaccttcagtttctctccccttccccagaagtgggagtgggtgggagggactgaaacttccaactctctaatcacatgatgggttttcctaggcaaacccccatcctgaggctatccaggagcccccagccatcagtcatcttagcagcatacaaaaagacacttagcacttaggagattccaagggtttcaggagttgtgcacaaagaaatgggagcagagaacacacacgtatttactattacatcacagtacacaaaagggcagagttgaatagctgcaatagagatcacgtggccctcaaagtctaaaatatttactatatggccctttaaggaaaaagtttgcaaacctctgcacttgattcaaaaatttaaggaacaaccaaatgtgtggctctaaatgggataccattttggacatgaccaccaagggacatttttggaacaacaggaaaaatttgagtatgattttggtactagttaagatgaacatttcctgaaatggaaaggtggagactgtgattgaaaaaagcagagcacaaaagagtagcctcagtatgatcttattttgtttggtatgcctacagaagatctggaaagatagacatggtggtgttatgtgtgatttggaggaactgtattaatctgcttttgcattgctataaaggaatacctgagactgggtgatttataaagaaaagaggtgtatttggctcatggttctgcaggttgtacaagatgcatgacaccaacatctgcttttgggaggatctcagtaagcttccaatcctggtggaaagggaaggggagccagtgtgaactcattaccacagggaggccatcaagcctttcatgagggatccacccccatgagatggatgttgggaagtgacccaaacacctcccactggaccacctcaacattggagagcaaattttaacatgagatttggaggggacaaatatctaaactatatcaggaatggaatatgatgtttttattttcactgttgtttgtattttgcattttcttcttgcacagatatttctcattttttggtgtactatgtagtctaagatcaatgcagtagagattctggcatataatagttacaggtagaagtatttttgagagtggaagagtttgtaaataacacccagggaatagaattccacttgtggagacagaaaagagagtataagctgggctaaagaaattctcatgctggccagtggctccacgtgtaatcccagaactttgggaggcggaggtggaaggactgcttaaggccagcaattcaagaccagcctgagcaacatagcaggacacagtggtctacaaaaaaaaattagcctggtatggtggtgagcacctctagtctcagctacttgggaggatgaggcaggaagatcacttgagcctaggaggtcaatgctggagccatgatctaagccactgtactccagcctaggtgacagagcaagaccctgtctcaaaacaaacaaaaacccccactgttggggtatagttctaaggggcagccacttgttatgcaagtagaaaagagagaaatgtagaaagaattacaatggtcagctgtcttaaaccaaaatctaaggtaattttcataaaatgggttcaatttttcatgcaattgtcccatgtgaagcttgttccagggatttaatatgatgtttttcaaaatattgttcagaactcattattaggctaagaaattagtctagcgattcatgggcagaattttttaaatgacacaaactgaaagattaaatatcagagtaagtcatataccaaggatagaatgcataatatgatctcatttctgtttcaaaaggaaaaaaaaaaaccttgatatgttgtatttttatgaatctgtataacaatctattaaaaaattagggaaggctatacttcaaacttttaatatggttactttaggagagtggggctaaaggaaaccatacagaaaaaaatttatttcaattatttattccaataaagtcaccttctttaagaagtcttttcttgcttattttatctgatgctaatccctttactaattttcttatcaccttagcactaaagccactcattcatactttcccaaacagtcattgtactacgcccctaggaaaaaaatataaataccataccagtatctgccttaagagtttgatctagtgggaaaggcatactcatatttaattataaataatgtggtataagttttaaggagtgagtaggcagacaggcaacagggtagttggtaggcagaggaatattttggccccaaactgccactctaaaaccttgtcagaggtaacaaacagcatgcacaagtgtttatagagcagcccagggatgggctagaaaagtgggcaggactggaccacagaagggctttgtatggtgtgtaagcatttaggctatcctgaggagcgtaaatgaaagatttgaagcaaaagaaacatttagctgatttgatttttagatacaccaaaatggagtctacatggaggatggatttaagacattaacttgaggcaggaatttggttgtataacataaacacacttttaaaaagttatgtggcctttctttacggagtacttcatggctctttattccatctccctcatcaattatatcaaaggttaggatggaaaggctaagacacggcaatgtcttatttgacaacccctccccaaacccctactccaggctttcccacagcaatttcaaaacctttttcctggcacttaacatattctcccctgcatttgcttttgactgtacagtacataggtcttaggtctccagtctgaaaactgcaccactagattttacagttccacaggacttagcacaacgtctttgaaaaaaaaaaatactgcttaaataactctcagatctaaatgtataatcctaatctcttgattgccagaccacattcccaattgcccagatatctctacctggatgtcctataattatctcaaacttaacctaatccaaatggacctgggtacctctcttcaccgccaaactagtcatgcttccatttcatatttaagtacttttccaaaccctgagtcatctttgttcactctctactaccggccatgaacactcagctgctaaatgctgcacacatctcttccatttctctctcttttccattaccctagtttaagctcttgaaatgcttccctacctctccctatttcccacaaaacctacataatagctatcaggattaccttgctaaagcagaggtgtgatcactgtcatttcccaccttcaggtagctggaaaccccacaaaacgaggatcatgcccatttaaatcccgcagcattctccctctcgttctactgatgccgactggatcattgtacttgccaagtacagtttgtttttctccccattacttgtgttttctagtttctccaccagatggtgatgacagtacaactgggagctttgtgccctgtgttcctaggccagtgccaggcccacttgaggcgctcactaactatgatatgaacgaatgaatgcttgagtgaattggtccccagaagcggtcagcctctccgccaaggcagaggggaagggccgggaggtgcacgtgggatgaatggaaacatagtgattggcctttttggagttttcttcttaaaaaactgaatacattacagatgttgaaaacagcacaaaaatcataactgtacggcttgttaatttttacaaataaatacaccctcgtgaatccagaacctagatcaagaaccagagcattaccagcacccagaaacctccccgcgccctcctccactgagcggccctttcaacccttacaatgccggagggcgcaattcctgggtcctgtgaccttggtgaccgacgcccgggacaagtcagaaagacccaagggcgtggaaaacgctcctcttaccgataaacttgaagcgactcatgactgcgcatggaggacctccccagcggaagcggaagtggccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagaggtaagggatggggacccaggactcggggaggtgaccctcggggccccatggaggtggagaggcccctgggtacctggaggttcaaggacttcgggaacggaattggaaggtggcctctcgcttcacagaatcctatggtagacccgggttcaaatccaggcttcgccacttatggccgggagaccttgtagagttgcttgtcgggtctgggcgtcagctttttgtttagtaaaacggacgcacgaccagcgcagagggtcgcaggaaaattaagtgaaataaaggaaagtgcctaaaattgtaattgtcatgggtccagcgctcgctcaatcgttttcttcacgatcttctcctttccaatattaacagcaataaactatgcattattttcttcagtctgcaaaactctaggagttaggaattatcttaagcttattttacagataagaagatgagcacagctggtaacttgcgcaaggtgatagagtttctaagtgtctgagccagggttaaaatttaggtctttctccaaagcatcatcattctcccacccctcccattagcttttctctttttagcttcatctagtccttttcattacctttacatctttttcacctcttacataattctctttcgacctctatccgtctgagactagtctgagaacatagtgttaaaatgtgtagattttaatcacctaaattcattgcagggtgggctaacaacccaagatgtgtgagtgcctcgcctccactccagtcttacgactctccaaacgtagttttataagaaggccttctgggaaaaaaactctatggaaaatggagtaggcctggaagaattacagagggtaccctcgaagcccagattgcatatatgtgactattagaaaatcactgacatacttctcttgatttggcaggaagatggccaagtacaatgtgatgggattgttagtttcttccttgagttttccttatttatttattgatttgacagaatttgcaattcagattctatgctctatgctaaatatataaatgttagtaaatccatttttgagcagcagcagctcacggattagtggggaaaatggacatgtaaacaaatcgatgatgaaggaagttgagccatcagggattcaggtatcccaacacaaatggtaaatgtttgaggtgatgaatatccaaattaccctgatttgatcattatacattatatggatgtattaaaatatcacatgtaccccataaataggtacaataattatgtgtcaaaaaaagttaaacatgaaaaaaagaattcaagcaatactgaactatagctgggaatactaaagtccatagttctagaggaaaatgatataaactagctactatgacagttatggctcagcattttttagatctgacattctttctcaatccttgccttaatttcttcctccatttgccctcattgtgctgttctctgtggttccatcctaggcatactgtgttgttgtatgtactcgggcagcctcatttagtgctgtcaccacctgcgctcatttgtctctagagctgtagttcgaattgcttgttagatcacgactgttggctgggcatgatggctcacgcctataatcccagtactttgggaggctgaggtgagtggatcacctgaggccaggagttcaacagcctggcctacatgtgaaaccgcgtctctactaaaaatacaaaaattagccaggcgtggtggtgggtgcctgtaatcccagctactcatgaggctgaggcagaagaaccgcttgaacctgggaggcagaggctgcagtgagccgagatagccccattgcactccagcctgggcgacaagagtgaaactttgtctcaaaaaataataataaaaaaaaaattgaaaagatcaccaaccgttctctcaatctccatttatctaaattctttgaaatcaaacttgttttcctgtcactccccattctgactcttttcccaaattccctgcctccgctaatggtattattagtaattcagttactgagctttaagtctcagaattgttctcaagtatttgctccttattcctttgccaataacacacatactcatacaccatgtataattagacactggtttttataaattctctttccagtatgatattagtaactgacattatttaacacttgggatgtaccaggcactttttaaagtgtgtttatcttattgactgtttatgacaaccttaagatatacacactgttattgccactgttttacagaggaggaacccgtggcctagaagactttttttgtttgtttttttgttagacggagtttcgcttatgttgcccaggctggagtgcagtggcgcgatcttggctcaccgcaagttccgtctcccgggttcaagcaattctcctgcctcagtctcccgagtagctgggattacaggcatgcgccaccacgcctggctaatttttgtatttttagtagagacggggttttgccatgttggccaggctggtcttgaactcctgacctcaggtgacctccacctcagcctcccaaagtgctgggattacaggcgtgagccaccgtgcctggcctttttgttgttgttgttgttgtttttttttgagatgaagtctcgctcttgtcccccaggctggagtgcaaatggcacaatctcgactcactgcaacctctgcctcccgggttcaagctattctcctgccttggcccccagagtagctgggattacaggtgcctgccaccacgcccggctagtttttgtatttttagctgagacgggatttcaccatgttggccaggctggtgtagaactcctcacctcagatgatccccctgccttggcctcccaaagtgctgggattacaggcgtgagccaccatgcccggcctcatttttgtatttttagtagagacggggtttctccatgttgatcaggcttgtcttgaactccagacctcaggtgatccacacgccttggcctcccaacgtgctgggattacaggtgtgagccaccgcacctgaccagaagacagtaacttaccccaagttacacagctagtagtggcagagctaagattcaggcccatacagtctgactggagagcctattctcataacttggaagtctcaatgtctcccctgtctcctgtcaccatcacagctccgtactttcaggccctcgtcagctgtgtcctagattattgtcaaaacctcctaactgatctttgcccagtttctttagaacttgactttaacttgcctaagtttatgcagctagtgtcagagtcaggatacaaacctagctctgtatgagctaagcaatactgtttctgccaagtaacacctttcttattcatctttgtatctccagaatttagcatagtgactagcacaagatagaaggaaatggaagttgtcattcaatgaatgttgaatgatcctgcagaggttatagcttttctcttgcgaatgctcttttctttttttttttttttttttttgtttaaatcctcattccattgttggatgtaagaggagaaaaatggttagggtatatatttaatacagtatttttttgctgctgctgtttggtgggctgtagaggaagcagccatgatgatacggctgctccattgggagggttggggtaggtccactgcccatccagaaggtatcagaagtgcagcctcctgtcagacagcaacactgaccacgtgagtaggtaacatttctaatcttcaaaatcattttggtttaagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtaggtgagaattatgatgactgccttctgagaaatagactttgtttcttcagtcccacacctcagcctcagaaatcacttgcccttcaaggggtagctaggagacttatttcctgacagttgtcagatgcaggcctacctcattttattgcattttgttttattgtgcttggcagatattgtattttcacagattgaaagtttgtggcaaccccgtgctgagcaagtctgtgggcaccatttttccaacagcatgtgctcactccctgtctctgtttctcagtttggcaattcttgcaatatttcaaacttttttttattattactctatctacacacagttgtggtgaactgtgatcagtcacctttgatgttactattgtcattgttttggggcacaaaaaaaccatgcccacataagacagcagacttaatcgataaatgtgcgtgtgctgactgtttcaccgaccaatagttcctccgcctctatccctctcctcagggttccctattccctaagacgcagcaacagtgaaattaggacaattaacgaccataccatagcctctaagtgttcaagtgaaaggaagagttacatgtctctcactttaaatccgttacacgtctcttcctttaaatcaaaagctagaaatgattaagcttagtgaggaaggcatgttgaaagccaaggtgggtagaaagcaaggccttttccgctggttagccaagttgtgaatgcaaaggaaattaaaggtttttttaaggaaattaaaagtgctgctccactaaacacacaaatgataagtgaaactgtcttattgctgatatggagaaagttttagtggttgggacaaaagatcaaaccagccacgacattcccttaagccaaagcctaatccaaagcaagtctttaactcttcatttctatgaaggctgagagagatgaggaagctgcagaaaaaaagttggaagctaatagaggttggtccatgaggtttaaggaaaaaagccatctctgtaacacagatgtgcaaggtgaagcaacaagtgctgatggaaaagctgcagcaaattattacacaaaatctggctaagatagttgatgaaggtggctatacttaacaacagattttcagtggagatgaagtagcctttttttggaataagataccatgtagaactttcataccttgagagaaatcaatgcttggcttcaaaacttcaaggataggctgactctcttgttagggactaatgcagttggtggttttaagttgaagccattgttcatttgccattctgaaaatcctgaggcccttaagaattatgctaaacctactctgcctgtgccctagaaatggaataacaaagcctgaattacagcaaatctgtatacaacatggtttactgaatcttttaagcccattgttgagacctgctaccatgtctgctaacacaacatccattctgcagcccatggatcaaggagtaatttccacttgcaagttttattatttaagaaatatattttgcatagttatagttgccatagatagtgattcctctgatggatttgggcaaagtaaaattttctggaaagaattcaccattctaaatgccattgaggatatttatgattcatgggaagagatcaaaatatcagctttaacggggttggaagaagttgattccaacccttgtgggtgattttgaagggctcaagacttcagcagaagaagtaactgcagaagttgtggaaatagcaagagagccagaatagaagctgatcctgagaatatgactgaattgctgtaatctcatgataaatcttgagcagatgaagagttgcttcttatggatgaatacgaaagtggtttcttgagatggagtctcctggtgaagtttttgtgaacattgatgataacaaaggacttcgcatagcacatcaacttagttgattaagcagtagcagggtttgagaggattgactccaattttgcaagaagttcttctgtgggtaaaatgctatcaaatggcatcacatgctatagaagtgtttggtgtaaggaagagtcagttgatgtcgcaaacctcgttattttaggaaattgccaaagccactccagcctttggcaatcatcaccctgattagtcaccagccatcaacattgatataatactctccaccagtaaaaagattggttttctgatggctcagatgattgttggcagtttttatcaataacgtatttcttttgtttttgtttgggagatggtctccctctgttgcccaggctggagtgcaatagcatgatcatagctcactgcagcctggatcccctgggctcaagcaatcctcctgtcctagccaaccaagtagctaagaaaacagaggcacaacaccacacctagctaatttattttattttttgtagagatggaatcttgctatgttgtccaggctggtctggaactcctaccctcatagaatctccctgcctcagccttcaaagggctgggactaaaggcaggagccacctcacccaaccaataatgtatttttaaattatgtcttttttttggtggagggggacagagttttgcccaggctggagtgcaatggcacaatctcggctcaccgcaacctccacctcccaggttcaagcgattctcctacctcagtctcccaagtagctgggattacaggcatgtaccactatgcctggctagttttgtatttttagtagagacagcgtttctccatgttggtcaggctggtctcgaactcctgacctcaggtgatccgcctgcctcagcttcccaaagtgctgggattacaggcgtgagccactgcacctggcctaaattatgtacattttttatgtatattatgtgaggtttgccacatcaattgacttttccttttgatagcattttacccacagaagaacttctttcaaaatgggaatcaatcctctcaaaccctgccactgctttatcaactaagttgatgtactgttcaaagtcctttgttatcagttaatcaatattcacaaaatcttcaccaggaggactccatctcaacagacatcataatgctgttggacactttatagtatagtataaacaaaacttttatatgcactgggaaaccaaaaacattttgtgacttgctttattgtgatatttgctatattgcagcggtctggaaccaaacccccagtatctctaaggtgtgcctgtactgtttcttaggtgtcagttttctctctctgagacgtcattaagacttttctttctacattcagatttaaggtcgtacagtatactttttgctataacaaagttcattttggactttaaagttaaccaacttggattggtgcttaatatttctgagatactctaattaagagttccaagtaagataagactactctggatatttagagaaggcaggtaggggaggaatgaagccagttctccttggactgatgatggtgctatttttcagcacagtctttgactctaaggtgttttcctttatctttgcttcctacttatcctctgctgttccttgcttagagttagaaacagtctggtagttgcagtggttataaaaatatatcttgatctttgtcttacatctcctgagcaggccctgtcagggataggtaaatgtgtcctgtggattgataccatgatttcctctcctgacaggtcccagaatggtgcttagatgactggcatccttctgagaaggcaatgtatcctgattactttgccaagagagaacagtggaagaaactgcggagggaaagctgggaacgagaggtgcgttctacttgtacttcgttattccttagctatgtagatggagtgaagttttgctccccacaagcagaggtccagattccagccatgacagttactctgggcccttgcttctcagatatactttagtatctaagtgtatcaatttaacatttataatcaccttacaagtaagttaaagtgcattccctggtcgttttggctttgtctttgattttgcttcagatctccttctctttagtcctttgtctgacttttttgccttcttgctatactttccctcaacctgcctctccactattttcttaggcatttttcagtcatgttaggatggtcagttatatttttaaaagctcaatcttgctgtagtgtgaagaatatattggagaggggaagaggagaagcagagagacccttctaggattattgcagaagtttagtcaaaaggttgtcatgactaacactagggtggatgaagtggatatggaaggaaattgactcaggacatcatttggagggatgtgacgactgactggatgttgagggtgggtgagggatggggaggaatcaagaatggtttctggggcagggtgcggtggctcacacctataatcccagcactttgggaggccaaagtgggtgatagcttgaggtcaggagttcatgacgaccagcctgactaacatggtgaaaccccatctctactaaaagtacaaataattagctgggcgtgggggctgtgcacctgtaatcccagctacttgggaggctaaggcaggagaattgcttgaatcccaggaggtggaggttgcaatgagctgacatcgcgccactgcattccagcctgggcgacagagcaagactccatcccaaaagaaaaaaaaaagagagaatggtttctgggttttaagctttaacatctggagtttggtgatgtttactgagatagggaagattggggaagggggcacaggtgtcagagcagcaatcgagaattcattttggaagtgtgaagttttgagaatcctgtgagacatcaagtgcagatgtcagaagccaacttcagatgtggaaatctggaactcccaggagagatttggcctagaaacagaaacgtgggagttttcagttttaaaagccatggagagatgtatggaatccttaggagagagtatagagaaaaaagaaaaggaaaaaggattctttgtgcattataattgggcaaaagattgtatataaatacatttgggttagaagttttgaagatgacagacttgtgtgatagcttcctttttttagtgaaataagaggaaaagcccagaatgagtgggtgcagcatatttggagaatgtggacaagatgtgatagtcatgaggcgaggaagagcttgctggagagtagtaggatggccaggtggcaaaggcccatttgaggttgggaataatcagtgggtaatgactccgatttgctcccatatcttttttctctttagcaatactaagctgtatgagcacaggcctgagggtatatggttcggtttgtctgttgctcagagagtgacaagggacttgaggttattcgaaaggaagctgttgtcatgatggaatctaagctgaatttaaaaaaaaacaaagtcaagccagtgggggcagatgcagagagggaaggccaagttgggaggatctgtgaattggtagtctgagtttcaaggaggcatttaaacaaatgagtgggaaagggagagtgtggttggatagtgggatatttgaattcatgatttggaagttgtgctggttctggtgataacactgaggatattgacctttggaagtgtttggccaagggggacccgaaggaagggcactgtggccaaagggggcagtgttttgtcagaaatgtctcaccgtttagaagcttgaagtatatgcatggtgagccgcaggtgcattctgcaattgatcactgggataacatcaaacaattcctcctttacacatcccatcacttcaacactattaagcagcacgtgtgactggaggcccagggcagccacaatccagaatgggtgatcttctgttaggacatttatcttggccataactagaactggaggtagtagggcagcacttggcagaactgagcatatttttacatgtaattttgtgatttatttttgttcttggttgctaggaagggggcttagaattaacatccccagcatattatgaactgaggtttcttaatggtgcttttggagaacacttagctgagacacaacaataaatgtttttctggtcagtgggtgggggctgtgacaaggagaattggaatgatagttgtcatttttctgtctgcagaataagaggaggtccagataatgaggtgatgaaaaggggtagggggaagaataggaagggtaggctttgctatttaaaagaatgggaaaacccttaaggagacttttctaaaagtgtggatatgaaaataaagcaggtatatgtaaaaaacacttttcaatattgtgatcagatagtgtgtaatgtcagtgacacaccatagacataaagctgacccttcactgcagcagacagatttttatagtcaattagattcctttggtaatgattccttccttgcctccttctaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtctctggtatgactgacgttcttctaagaattactgtgatgccaagtgactgtgccactgtcattgttttatcaatcgtgcatgtaaagaaaatgacaggacatgtagtcagtcagctgtgttctctgcaataaatcactgatagcatatgttaccagtaaggaaaaactgaggcagaaccagattgaggcgaacaaactctcaagtcaaaggcctaattagctgtggtaactagaaggaataaacaaagccaagaacagaaatactgaggatttaaaaataacctttttggttttctaaagatttcactaatggaacttagtttttattagaagaacaactctccctaagaagtacatagtcaacaaataagcatggaatttgtggagttctgtcaggggtggaggtttgatggttggggttaaatggtccaatctgggataaaactttgtggcgcttattttagaagcagttttccagctttgcttctgctaccgtagcttggattgtctgcggactcaaaggtaagggaataacagaactccttaaatgtttcagaagctttgtttttgttttttaaagataaagcagtttttaaaactttcaacccaaaacagctgcttttagttcttgatccctcattagctagaactgttttcaaatagtttcaggcaactaatgatcttatagccatcacaaaaatattttgtcacttttctacgtaagctcaatttgagtcccagtccatcttctaacatttgactaagacctcaaactgaattgtaacaagacttgaaatacaggacttttttaatctagtggttctttatttataacgtaggctgaagcaattgttacaatgtaggagggagacacattacacaattgttatttatacaagtttagaacaaaaaactgcacagggagaggtcaactctcagtacaaactagcaactaaagcacaataatttactgttagaaacgatttctttctttttagctgtgacactgcttttacaatatgcaaaaacacaagcagaactacccaaggtgtgttgtcacattctttctacattgaatttggcaacattttatttattcagattatactaacgtttaaaaactaaacaagtgaaaagctgtaccaaggtacagttacatccatttatttcaaaggtttaaaataccacttttatctattgtgattaccttgcagcgatttctgcttttgcaaaaaccatctcaagcatcatatgcacaatgcatcagctacttttagtcatcaagattggtgggctaaaccacaggcactactgttgtttatattctgtaaaaggagcttgtttttcaaagaaaaaagcttaaatagtttctaataatcatgcctttgctttaaagccgtaacataaaatgtccttgagcaatcgcagcagtgttcaatgttaatatatagaacaatgaccatacggtacgttactctcacatccaatgcagttatgtgttaaagcataagattaggtaattgagggttagagccaacaggaatctgcagggtgtatgaaacccaccaaactcctcctctgccttgagagggttcggtcagaaatgtgccctgttatgacctgactgctaagggacttgcttgctttcttaaacactattgtcttcaaatgtgatccctttaaatctacaaatctctgttggctttaggggatgggcagtataacaaatttaacttccacttagaaaagacaaatcttttccaaaaaacatttacccagaatacaaaaaaaggacagtatagtggtcagattcccagtgacaataaacaaatcctcctctcttcaatgtttactgtaaagccagttaactgccatttatttgaaagaagaaaagaaaaacaagcccccagattggtaaacacattggcaagttgctagactccaagctggctacccttgtcaaatctgttcgagttttttcaaaatacttgggctttttaacgcacccagcctgctgggcacagttaagtaaaaggcatttactataatctaagaattccctgctattatcatttttaaatgttttcacatttttaaaactgccttacccttttggatgtatttggattccataaaggtgagtacaatcaacgagaaactgaagtgggagattctacgactgcccagaggcagcagcatgcatggggctggttgtgggtgctgtgtgcagtccagaggaatcatgggagaaaggaagtcaagtccttaaacaccctacagaaacaaacactgcaatccagtatggcttattcggatgcatttaccatgaagctaccagaagaaattcaacctacgaggctactcttaaatgtaacaggatcggctatgttgacgatgtacccctcccatggccctccccccaatcccaacacagtctaccatttccagatttacttcactctgaatattgctcatcaattgttactcctgctcttttcatccagaacatagtatatttaaatgaagattttacctcttacccatttagtttgtacattaaaataacttgcatttgcttctaagctagactactacaatgcatctacaaaagcttgtggggaaaaaaaaagaagagtgaagtatagtaaatccttttctaaaattaactacttcgtggttcccctgccccaaccccctttatgcatttaaaattttacaaagacttgtaaaaaagttaaatggaatttggcaccttcagaaaaatcaaaagggaaactaagattaaaatgtgcagaaagaaaattgtcaatatttacaaattaaaagatcaagattatgtcagttacataggttggttttaattcttatctaaaggtgtcgagtactttcaaaagagctatattccgagttgcctacaaaatcttttgttttattatagagtggaatggatcaagacaaattaggttttattaatgaaacagttcattccccaccggcgcatttcttgtgaacctaagaaaagcgaggggctgagcgatcgtttgtcgtggtcttcttcagtttcacgccccttcggatggcgttcagcatgtcttctccttgtggagtatcccttgggctcaggtctgcagggtcactctctggaatctggcctggggagacagtggcacttgggggttcccgttcctggtcttcagcttcactttctggaattgcctgtctgtgctcctcagggatactgggcttcgggcctggaagtggagggttaacggaagcttggccgctccacattgaggagggcatgctggtgacaccttgggggccctcacccacagatggcgactcagggctgtgctccccccgctcttctggcccatctggaggggctggcaacacccctgggaggtctgggacggttggggtcttgacagggatcacgggtgtcttgatggggatgggaccagctccaatggttccccggcggacagaaggcttggtggaaggggtccgtcggatagttgcaacccctggagtgaccatagcaggtcccagggtggtggggaggccagcagttgaggctggacgcttggcttggaacatccgtcggtaggactggctgatgtcgctgtttcttggaatggtggaggacttgtcgaactcctgctgatctgcctcctggtcaccacttacagagaaataatcataatctgaaactgattataggatttgattagacatattcaagacagcagctgtgcttttttgattcttctgggctgggaggacaaaaggcacgcaaggcagggtacacacacagtctcatcccaagcttcccccaggcttctctaccatcttcagaaagcctcaccaactaagaactccgtggcagggatctttgctttgttcactgatgtgtcccaagtacctagaacagtgctggacacggtaggcactcaaatatcgtcaatggggaagaaggtaaagctgctaggctgcagcgaagctacctgcaagcgtctctgggaggaataagggggatgaaagaagacaaattctccagtccagaactcaacgtgaagatcaaacctcaaatagactagcctaggctataacatctccctgataattaactggagaggcaagggctagacaaagaacaaagctactgacagtgagtccctgacaataagggacaaagacagtttccatcagtgtcatgtgctcacttccttgtaagaccaatctcaggatgatgtgggagcttacagattaaacagctcacagccctgattctgaaccaccgtactattgataatttgggctggatagttctttgttatggaggacgtggtggggaggggccgtgctgtgtattctgggatgtttaagcaatatccctgccctgtgcccactagatgccaatagtacccctccagttgtgacaaccagaaatgtctacagacattgccagatgtcccctggggaataaaatcaccctccaataagactcactgtcttagaggttttgaatgatgaatggcatagcttttggtcaattatcatagatatattctagctgttagattttcatcttgcctgacttgtgtgtgcagtggacttgaggatgaaggaggcaggtttgatagaggatttggctggaataggttaagaacttgggcattacactctaacacacttaggttcaaactccagttctacttattggttgtgtgaatatgagcgagttattgagccttaatttccacttctgtaaaataggggtgaaaatacctaccccataagtggctgtaaagattaaatgagaaaataaccataaagtgtgtagtgcaaagtgctaaaacaaaaatgaagctattcctttgagacagggtctcattttgttgcccaggctggagtgcagtgatgcagtcatggatcactgcagcctcgacttcccaggctcaagcagtcctcccacctcagcctccagagtagctgggaccacaggtgtgtgctgctacacctggctaatttttgtattttctgtagagacaagagttttgccatgtttcccagactggtctcgaacttctgcagctcaagcaatctgctcacctcaaagtcccaaaatgttgagattacaggcgtaagccactgccctggcctgaagctattcttattacagcacatgtctccattcaaattggagactgctgtatatgatgctgcaaaacgcaaaaagctgtgaaagtccagatccctttatttattattatttttttttgagacagagtcttgctctgtcacccgggctggagtgcagtggcgcgatctcagctcactgcaagctctgcctcctgggttcacgccattctcctgcctcagcctcctgagtagctgggactacaggcgcctgccaccacgcccggctaatttttttgtatttttagtagagatggggtttcaccatgttagccaggatagtctcgatctcctgacctcgtgatccacctgccttggcctcccaaagtgctgggattacaggcgtgagccactgcgcccgaccccagatccctttcttatatggcagctacctgacaactacagatgagctccccaaagcattcccagatgacgaaaacaatcctgacacctgttagttagcgagtggtgggttgtggttaaaatggaccagcagttttctatctcctcacctggtgctgctcagaaagcctaagtgcacaccccaggctgcctcgtaccttgggaagggatggtgtcctcagagcagcagggggtggttgtctgggtgctgtagccgctggagcactgaagcgagtcccggctgctcctctgggtgtccagctgcaggccccgagacagggccagggccagctcctcacaagcctccatctcctcaccaggctgcaggttggaggagagaaatacacaggttgctttagggggggggctcaacagcactcctgttctgcccccgtgagcactacatgtctgtggggccagggggctattgacttgcttgggtcccactctgaccctagaaagttctgcctctctcattcccacacaaggtttttttcccagggactttgctgtagagcaggaagtcagggaatggagcccaggtccctccagctgcaaggctgccttggccccccagttgctggccagaatgtgatccccagccaggctgaggtggccccaaccagctactgagaacaagagcatcaccctggtggcagccgatacagtcatgctccgtggtctctgagcctcctcagctgctgcaggtgggccgctggcggtagtgggtcctcccccgttggggtccggttctcgcttctctttgcggcgctgcagggtgttcaccagaggctggtcatagggcccaggcttagcccagtcctatgcaaaacaagtgcggtcaggagccagggcctctgcctccactggagggctgcggggaccccatagacagctccccagagaaggcagctggtccccttaaggggaacctccggctgggacaagccacaggccctctgcatgccctctccaggctctaaagggcaaggaatggaaaccctttgggagccccctgtgtacctcccttttcctcgtctctgcccaaagattaaaaaccctcacccaccaggtggcagcaggagacccggcagccacctaacaggtgaccggtgtaagctaaggggacccaccagtgggcagtacatcgtgcttctcctgtctgaagggaccagcgctccttaacaacccagatggcttcccgttaggggaatggccaccagcgagcactaaagcaacatcagcccttctccctccattcccaggaaaccagcctcaaagggcatggcaggctccctgccctctcaagccctcagaaggaaaggaaggcgcccaggggcagtagaaagattccgagaagccttgagaggcccacaccgcctgtgagggctaaagtcaaaacctgcttaaaacgctggcagccaaggggcctacttttcaaattagggtcctcctctcaaaagagagcagattatcctcctggaggagcattgatcggacttgctaggggatcattttcaaagttcgtctttatattaaagcaaacatgtttgaacactcaagactaaaactaaagtctgcgtgtactgttaagttcaacatgatcaccccaaacctgctttgggttatggttctgttaccacagcccagcagggagctcattagggaaaatgggaaacatggccagaaggaaagtcccccctaaaccccctagaagctctgatcatgctgacaccctcaggtggcccccgggagggaccaacccatagatttcaacttgatgcaaaactgggcctttggacttggaattgccgctgcctgcggtgcacactgcactgccgtccatcagggattgaccaaagtcccctgaaggaagaccctcagccccagctacctgtggaaattgctgtcttagagctgccggctgctttctgcttctcccccaatgggagtttcctgagggagaggcattatggggaagaaggcagagtgtgaaaggaaggggatgaggggatagtcggggtgagggggttggaacagaagaggggtgagcacagaggcaatgacggggagaggaggagggggagagacacaaaccttccagctagggatctgagatgacgggaacatgccgggcccaatggtgtaataatgagcgtagtctggaaggtggacagaggtgacccgagggagcaggcgggaggcaggcaggcaatgagggaaaaggcctgcacccgtgggccccacgtgggactcacttgataaactatagtgagaaaacccgttagacaactggaaacaaacaaaaaaagggggggggaaggaaaaaaaattaatataacaggatgagtgcggagatacaaaatggcattgacattcaagggaggggaaacctgaatatttataaataaaacaaacattggggctctgctgctcacggatgatctgtgatgcaagagaaaagagccggggtgcaaagaatgcacatgagtttgacagcaaataagcatctatgtttgacctacgttttagaagtttggaaattgatcagtgccctcaatttgtggccttgtcaatggtttttgataatgtaactaatgaagcctcatttaatggtgatagtgatttgctcatttcattatgcaaatttaaaaattccaaagcatcttcaaatgaatctgttcattctaggtttccaaaatcatcgcattgctcaggagcacattctcaatcaagggcaggggggtgggggtgcaaactaaaaagcggaaaagcacacagcctctgacacagtgacatggctcatccaacggtctggtgggtggctcgggaagggagggaggaggatggacaggcacgcaacacctggtctgggagaaagccttcacacctccaaattccccataccccttcctctcccttgagacaaccatgtggtcattgtccagcagccaggcactcattctagaaaatgccctcagccttgtcccaccctctgtccccaagaggagccccactcttggtgtcgattctgagcttccaggttgccgcggctgtgagggctgtctgagcagcaggcagggggaccagggagagtggggccgctgtggctgccacccgggcggtcaccttctctgtggacacccaggcacccatggtggagcccgagctgacagaggtgggggagctgcactcgctcactgactggcaggtttccgaggcttcggaggaggccgagctggacgagttctgcagcaggggaggggccacacgaggggaccaacagaaaccgagccacacaccaccaaaatataataaataaaaaaaggaatggggatgggagtggggaagggcacacacagagagaaagagacagacatatacacagaagaggggaggatgagagaagcagagggttagggttacttttcccccaaagttgcatccatgcagaggctttcgagcccttgaaaagaagcgtgcgacccggccagccctaggtcactagactgtgggtccccaaggacacggatttgtgtgtcttttgctgggacccagaagcatgcctggcaccgaaatatctggtcatggcattgggacttcgtgctctcttgggtgtttcttcacgtgccacaggcccaggtccccagggaggccccgcctgtcacctctcttatgtgcataggtgttatttattgcatgagggcggaccccagctcgggcttttgctacatgtctgcctggaatggctcgacttcctggagtctcctttcatcaaatgcagcctgtggatccatgaggggtggtttccagctatgaagcctcatcaagacagacttttaggtttctcatcctggagtgtgattttggggtttggggcagtgaagccctctggtcagcacaatgtttctggtggccattgtggggtggaatgaaccatctctggagaggtctcatttgggaaaccatcgctttacactgatctgatggaaccccaggtccctgctggagtcctagtcagccacggcatgcgctcccagtctggcttcctgatgttcagctggggcagggactgttcctatgatctcacctacacccaagtttcttctagttctggacctggcacatggctggtgctcaaaacataatgaatgagtgacaatgatcatctctgtcacgtaagttgggtctcctgggcactgctttgcatccatccaggtacttgctttaaattttttcactgttaactgcaatctctggcttaacctcagtttgtttaaataagctgactcctctctattgtaatttatctgaaagtgttcctgtattcaccatcaaggaggccagaatcatatttctgtccctttcacctacaaaagaaaggtccctacaaa

SEQ ID NO: 1296 - DNA, 899653 bp, Homo sapiens
tacctgaaaatgtggaggtagctttggtactcataatgggcagaggttggaagagttcagagggctcagaagaagacaggaaaacaggcaaagtttggaaatttttagactggttaagtggttgtgaccaaaatgttgagagtgatatgacagtgaaggcctgggtctcaaatataaatgtggaaattattggaaactggagcaaaggtcacatgtgttataccttagcaaagaacttggctgcattgtgtccctgccctagggctcatgggaagttggaacttaagagtgattatttagggtatctggtagaatttctaagcagcaaagtgttcaagaagtggtctggctgcttctaacaacctatgctcagatgttggagcaaaaaaaccttaaagttggaacttatatttaaaagggagcagaatataaaagtttgtaaaatttgcagcctgatagtgtggcagagaaagaaaagcctttttgggagaagaataaaagcaggctatggagcaactgcttaccagagatatttgcataactaaaagagagccaagttctactatccaagacaatgagaaaaagaccttgaaggcattttagagaccttcatggcagcccctcccatcatagccctggaggcttaagagggaagaatagttttgtggacctggcccaggatcctgctgtcctgtacatccttgggacactgctccccacatccagtccactctagctccagcctcagctcagaggatcccaggtatagcttgggccacagcttcagaaggtgcaaaccataaaccttggcagcccccatgttgtgttaagcctgtgggcacacacaagatacaagagtgaataagacttggcaccctctgccaaaatttcacaggatttatggaagagcctgggtgcccaggtagaagcctgctgcaggggtggagccaccacagagaactcccattagggcagggcttagggataagagaggcctcactcagattcctcactgtggagctgtgagaagggggctattaccctccccactgtggcactacctagtgaagctgtgagaaaaaggccactgccctccagacccaagagaatggtagtcccaccagcagcttgtaccctacacctgtaaaagccacaggccctcaacaacctgggagagcaacctctggggctgaaccctgcaaagccacaggggttggaactgacaaggccttgggaaccgccccttgtaccagtgtgccctgaatatgggacatggagtcacaggggattattttggagctttaagatttaatgaccgccctgctgggttttgaactttcatggggtctgtagaccttttcttttggctaatttttcttttgtggaatgaaaatgtttacccagtgcttatttgccaattttatcttgaaaacaactaacttatttttgaatttgcaagcttatagatggaagggacttaccttgtttcagatgagactttggaatttggacttttgagttaacgctgaaatgagttaaagctttgagggactgctgagaatggattattttattttaaaatatgggaaggacattaaatttgagagaccaggggtagagtgatgtagtttgaatatcccctccaaatatcatgttgagatgtaacccctagtgttggaggtggaacttggtggggagttgttttgatcacggggaggggtccctcatgaatggcttcagacattttctgatgataagtgagctcttgctctgagttcacatgagatctggtcatttaaaagtgtgtggcacttccctcctactcttcctatcttgcctgctcctgctttcaccatgtgatgtgtctgcttttgtcatgtgatgtgcctgctctcattttgccttctgccatgattgtaagcttcctgaggcctccctagaagctgagctgatgccacaacttgcttcctgtaatgcctgcagaaccgtcagctaataaaatatctttcctttataaattacccatgttcatgtatttctttataacaatgcaagaatagcctaatacagtagtaaactgggggaaacttagtgaggcctatttgttcagattcctttaggcttttctctgtctttagagataaggatgtgcctttcctctggtcatagagaaggcacttctcataagagggtctcgtgacctggggaaaagtgggaggacagagtctttccagcacctaccattttgcaaatgtattcagcttaaaattattatgccaaggtgccatatcatgaagtagtgtgaatcccatcaacgtggcatgcttacctgtttctgtggcacgactttagctgtacatttgcctactggctgcatttcctaccttggtaccatcctaccattgaagttttccatcattcaaaagtttctctttcttgagagccattcaagaaccttccaataaattatttttttcaacttggccagtctttctgttgtttgagtccagaactgatagagtatgttatgtgagaatacacagatattacagatttatgaaaaatcaagaatgcttaaaatgaagttttatttttatctatttttgaaaacatttaaaaatttttctggtggctaaaaagtgttaaattttcaagactttttggattttattcttttttttaatgtcacccaaagcccgtaactaacaattacagaagatctcaatctttatttttactgtgcatatttagggaatggtaacctattcaaattcagattttattttattattaaacaatttcagcaattgactagaattcatttttaatatcaaagtcacagagaaatggaagttttatatttttcattgcattctgtgatgcaatggaatattgtcatattttcttgagaaaagagtatgatatactattgtagaaatttaattttatatgaacaataatgaaagttttaaagaaagaagaggaatgacaacttggaaaatgtaggataacagcctttattcatatcactaattgtaatatgtactaattgtaaatgtggaaactgaagccccattccagagaagacattgctttttatgatagatccaggcaacaggaaacacacatgcacacacacaccgacacacacaaaagagcctttcttaggagaaaatatacattaatctctttctttcccttcctctttctcttcttttaccctctgtttcttttcttcttccttttcctttctcactttcagtttaaagtgaaatcagcttcccaaagaaaggattagagaaatgggtgcctttttcttcagtttgatcatagtgtcctaaacatccagattaactctaccaggtaattctttttagacagctcttcagaggtcacctaaatcatattttattgtcaaataagtggatggattaatgaatgaatgaatgccacatgaacatttcaggttatctgagaaacgttaaggtcaaccacttttcagtgtaaattaaatctgatttttaaaatttccaaaatcaacaaataacaggttcttcttgaaatgatactagcttgagaatgtgcctcaacataaaaatcaaaaccatttgatattgtttggccatgtccccacacaaatctcattttgaattcccacatattgtgagagggacttggtgggaggtaattgaaccatgggggcaggtctttcccatgctgttctcatgacagtgagtaagtctcatgagatctgatggttttataagcgggagttttccttcacaagttctcttctcttctctgctgccatgtgagatgtgcctttcaccttccaccatgattgtgaggcctccccagccacgtggaactgtaagtctgataaacctctttcttttgtaaattgcccagcctcaggtatgtctttatcagcagtgtgaaaactgactaatatagtaaattagtatcaggagtggagtgctgctgaaaagatacctgaaaatgtggaagtgactttggaactgggtaacaggcaggggttggaatagtttggagggctcagaagaagacaggaaaatgtgggaaagtttggaacttcctagagacttgttgaatggttttgaccaaaatgctgataatgatatggacaataaaatccaggctgaggtggtctcagatggaaatgaataacttgttgggaactggagcaaaggtgactcttgttatgttttagcaaagagatgggtagcattttgcccttgccctagagatgtgtagaactttgaagttgagagaggtgatttaggatatttggaggaagaaatttctaagcagcaaagcattcaacaggtgacttgggtgttgttaaaggcattcagtgttctgttctgttttgttttgtttttgagacagagtctcactttgtcacccaggcaggagtgcagtggcatgatctcagctcactgcaacctctgcctcctgggttcaagcaattcttctgcttcagcctcccaagcagttgagattacaggcatgtgccaccatgcctcactaatttttatatttttagtagagttggggttttatcatgttggccaggttggtctcaaattcgtgacctcaggtgatctgcctgtctcagactcccaaagtgctgagattacaagcatgagccagtgcacctggctggcattcagttttaaaagggaaacagtataaaagtttgaaaaatttacagactgaaaatgtgatagaaaagaaaatcccatttcctgaggagaaattcaagctggctgcagaaaattgcataagtaatgaggagctgaatgtcaccaagacagtggggaatatgtctccagggcacgtcagagacctttgcagcagcccctgccatcacaggcccctaggttttggaggaaaaaaatggttttgtgggcctggcccagggtccctctgctatgtgcagtctaggaacttggtgctctgcctcccagttgctcccaggatgatttaaatgaagccaaggtacagcttgggctgttgcttcagacagtggaagccccaagccttggcagcttccacatggtgttgagcctgtgggtgcatggaagtcaaaaattgaggcttggaaaccaccacctaaatttcagaggatgtatagaaatgcctggatgcccagaatgaagttctcctcatggagaacctctgctagggcagtgcagaaggaaaatgtggagtgagccccacacagagtccctactgggacaccacgtagtggagctgtgagaagtgggccactgtcctccagatcccagaatcataaatccactaacagcttgcaccatgcacctggaaaaggcacagacactcaatgccagctggtgaaagcagccaggaggagggctataccctgcaaagctgcagaggcggagctgcctaaggccatgggagcccacctcttgcatcagcatgacctggatgtgagaaatggagtcaaaggagatcattttggagctttaagacttgaccgcccctgtagtccctttgttctggccaatttcttccacttggaatggctatgcttacccaatgcctgtacttccattgcatctaggaagtaactaacttgcttttgattttactggctgctcataggcagaagagacttgccttgtctcagatgagactttagactgtggacttttgagatagtgctgaaatgagttaagactttgagggactgttgggaaagcatgattggttttgaaatgtgaggacatgagatttgggagggaccaggggtggaatgatatggtttggctgtgtccccacccaagtctcatttggaattcccacggattgtgggagggacttggtgggaggtaattgaatcatgggagcaggtctttcccatgctgttcttgtgatagtgaatgggtctcatgagatctgatggttttataagggggagtttatctgcacaagctcttttctcttgtctgctgccatatgagacgtgcctttcaccttccactgtgattgtgaggcttccccagccacatggaactgtaggtccaaaaaaacctctttcttttgcatattgccctgtctcgggtatatctttatcagcagtgtgaaaactgactaatataccactatacaagttcttacattacctgatgaaagatatctaattgtctattataaaaccataaaagctttgttaatacattttgaaacctgaataatgagagagcaggaattctgaacacacatactagtttatctataaattagaaatatatatgtttccagaaaaaaattgcttattcaaatgtaaaaaaaaaaacccagtctttctccttgtcaacatttaaagttattagacagtaacacatttcaaagcataatttagttgtttatcaacaagaaaaatgtattacaagaaattaatttattccaaatttttttaaaaatctgcttttctccatgtcagtatttacagcaggtgccatcttctgattaattaaatcacaagatgttccttatgctaacgtcttagcaaataaaacttaaacagaaactgttggttgcactgttgtcatttcttcttctactttaaaaaaattattcagaacaccacatggccagcttgcaagcttattttccagatcactgatagcaatgcgattttgtatttgtgtgtgagtatgtgttttgttttgaaaaagacatcagcttgaagcagtttcaaatctctggcaatgatttcttaaggagtatgtcaaaaatgagctattgaacacatttttgccaggtcacttgtcaagtacttggtagggagatgtcaagtttcagggcaaccacaatccacacttatgaaactacttagaaaactatggaagagttctgtggctcttactaggtatttttagaacaatcaagagaattttgttccttagctttagcatattatagtcttcaacgaatattttgtaagttttttttctaagatatggtccccaaattttcttgagaaatccccatgtgcttgaatacttgtttaagcacaattcagaactgcgggaggtctaagtctgctgtgacttagtgtaaagttaactcctttttgaatgtaaaaagtcaaaattgatgaagaaactggcaaattcaaatttccaccaaggaatagcccagtgcttttagcaatccatttgaaatgaaggagggaaaccaccctctttaacattttaaagttttgaaggtgtaatgaaccatgctacctcctgtagtttctaccaaaccaagatgtgtgctaggactgggctcattagcactaagtaggagcagaacactcagttctggctatagcttcttgcaatgtttttatcattatcatagtatttggttgatgaattattgctatctcaactgttacttcatttttcttactgtttttgatataaaattcctgttataccatgaattaaatgcccctgtgacaaaaaaaaaaagactttttctgttaattctttttaacaagtgcccaaaatatattattttttcaacaaggtggattctcgaagcaaggtagttcttgtgactgtttactttctctttcacatgtcctagactattggattatggtttgtgagataaggaagaaaaggagtaattaaaaaacatagattattagatagataggttacttgggtttttttttttttgggtcattaaagtaggcattacattatcaaagctcaaaatgttagcaatgaatttaattcaatggctttaaaaattttacatctcgtctgggagcggtggctcacgcctgtaatcccagcactttaggaggccgagggaagtggatcacttgaggtcaggagttctagaccagactggccaacatggtgaaaccccacctctactaaaaatacaaaacttagccaggtgtggtggcacgtgcctataatcccagctactggggaggctgatgcaggagaatcgcttgaacccaggaggcggaggttgcagtgagccaagatcacaccactgcactccatccagggcaaccgagcaaaactctgaaaaagaaaaaaaaattatgtctcttcattgcagagaagaatttttgctgaaatgaaaaaccactaattacttggaacacacttttacaggttacctgattctgattcttttggagcctctgtatttttcattatatttgaactctttttcaagttgtaaataaataatactaaggcaaaatatttctcgtctacagatatggaaataaattctgaggggtaaagattcaattgaattctcctcctcactctggaagccagttttgcctctattagtacattaatttcaaggtttttgatctataaatgtgtatgttctttaaattatccttttatctggttgtaatgtcttatcaggtccttcattaatgaattaatttattcatttcataagtgtatgaaaatcacactttttatgtttttcaaactaagtggtgatatccataggatttgtattatattcatattttgaaaacaaagtacaaatgtatttcttaggttgcatatcatttaatttctagaattagaatctttctcttgttctactgtcccagcacaaacagatgttcatgttagtatttcaatataaatggcctcaaacaacatcactcagattaaaatcagtattgtgaatttttttaaaagtgtgtatgtattctgatctccatttcccccaaaattctgttgattgcagatgtctgaggaatagtcttagtggattatcccaaacttgacacattttttgcaaaatgctatacaaaaagaagatacatgcgattatgacaagattctccacttggtgtgaccagtctcatacaacccaaggctgtgtgtccaaaggcaactgtactgtgagtttcacgtttccaaagttttagatgacatgtacaatctgattagcctttaaatctcataccctctgcaggtattggaaaatacaaggatgtcataaatatctatatttatatttaaaatgtgcttatatttatataaatatataaataaaaatatgcaaatagttgtctatgaagctagcaatgtgattatatgcttttctttttcctaggtagtctgggactggaaacaaattgggaacatttttcattgcatatttggctcagatctgccacttagttgaagtataatcttcagcaagtgactcaaaatttctgaatctcgttttcaccatcaatacatgacaatagtaatattttctcctttaagtatttgaaagtgttgagaaagccacaatagcaacacttgcaaaagtgctccattgtaaaatgcaaaggagaggtagttgtgaccctttggggaaaactatagttgccacaattgtctctgaaatgaagcatgtttcttagactgaaggaaagccctgggagagattggtctagctttaggatgactgtgggtagagcttctagggagaagaatgaaacgtattcctcttttccttttctctaggaataccggaaagcatgtatttgtttgctaaattgctctctttccaccagtgatatcaattctgaaatacttttgagtaagtttggaattactagaaaaacagtgaatgtaaatgtgaaggtgtatgattcttggaaagttcagagggagtacattgacgggtgtttggatcaaattccactaacttgaatgaattaccttggaaaattatctctacaaattcttacttacatttctgactgtcaggttaaagtgaataattattttctgtataccaagatatgattttgaagcatctatgttttgccctattcttttgagagggaaactagctctgtttcatgtgctggttttccatgtctgatacttgatgtttctgtttctgtgatgtaatttatgcaagatagataagatagatgttgaaaagggaagaaataatgaagctgtgggggaaatcagacatttattagaacatttccagtttttttgtggagggagggctttggtgtatatagatttctcagaatagcaatgatacttatatttcaaaatagcttataaaaccaagcatgaatcttttttatgctttgttgttttatctatcacattgttctcatttattcagttgactatcatagatgaacagatatgggaaagagggcttaaaaaattcatttggcttgagatctcatttgtatattatggtttggtatttacaaactaaaggttctcagccaaataacgtgttttgcttggaaaccaaggtatttttaaggaaattgtatctgaataccttcaggtgcccgttgttttatacccagctgttaagaaattacactctgcctggctcttacaagcgtttgagttttcagttgtttagcctgtaagatcatcaggattttatcaacaggatatttagtctctgttgctaactctgctgtattttaccaggtaaaggttctaaataattaataataaaatgtttccagaaaatttatttttagtttagatgtagttcagctcatcaaaccttttaggaatcagcaacagcaagaaagaatatagtgtggagtcatttgaaactgtagcatctagaatttttaccctgtactgctttagagtaagcagaaagatgagtgtaatacaggaaataaagagaatagcagaaatatcttcaaattattatttcttccttctttctcttaagctaatagagttttaaaatgagtcaaatacatattttaattgataaactgagtttatattcacctattggaaacagtacaacatattttacatcaggttatgaaatatggatgttttactaaaagacaggaagagctttttccagtctttaaagtaaatacatattcaaagaatcttaaggcataccatttattcatattcatatctattgaaatactgtacatccacatacttcaataaatagttaaaaacctgacctctttttaaatcatttctggatttcaaaaaacaatttttattgaaaagattaaataggtaacttttggctgtgtcacaaagctaagcacaatggataaattaacaattgttcagtaaatttgatcattatagatgattgactttgataattcagtttttcagagttttctgacttcaaatgtaggggtatttatatatatatatatttttttttttccctgaattacctgggtaattttctcagttctccagtctactttctagatatagcttaaatgttatgatgaagcattaatttttcagttaagttataaaccccccaaaagtggctttaagtttgaaattctccctctcaaatcttttagtgtctcaaaaacacccacattactataacttgggcagtactttttattatataattgctgcataataggaacttaatggtataataggacttatgtttcaaatgcgatcattgaaaaacgtagttacaccacttgcagttaaactaagaatgcaaatgtgtaagttaactaccctaatactctgattcttccttccctctcatcctttctttcttcctaccttctccccttcctcccttccttccttcattccttccatccttcctttttttccctctttactgcctttccttttcattctttttcttttctctccattctcatttttaaactgctacttatttttctttcttccttctttaaaaaaaaataggggcaacaaaaggagtcccacaagtggaacttgtagaaaatataatcctgaaatgaacagctaacacaaattgttatagattaaaagataaatcaatttataaaactgctattctgaaattgcaacaatcttgtacagtcaggactgataaaatggggtaatcagacattttatatgtccataaatgtaaaatcatctacttgaacattatatgcaatacattcacacaaaaaagcaaatactgtagccttatttgacaatattgaactcataaatactcatgatttcactctgtccgagggcctaaggactaggaatgctgctgtgatacagaaaaacatagtgaatacctcctctatttaaaaatgtcactcaagaaagtctcttctaacataaaggcaaatacatatagctactgagctatgactgtacttctgtcacattctatggtaaaaacaccagactccacaaatttggaatcatgacaacactttgaactaattatttggttcatccatagtttatacctcaatttacctacaaaccttacaaagaggaggtattttaactctaggaaagcggtcactgaataatatgcattcttgatctgtttctttctcccaaacaatggtactgatggttaacattttttgtggtagcaccactatttctagtaagtagattattatggagtgtgccactttaaagctgcaatacaaaataatattttatagtttattcaacaattccacaaagaatatttcttaaaagcaaataaataataaagttaaatgccatatttgttctaaaaactcttttttaatgtatcaatcaaaataatgtcatacatttattacagttagtagatttactagctttatgccttattattgccattttgtggaaagagtatacttatgtcccctcatttaagattcatttttctaattaaaattgatttatgatgtactttgggactaagttttacttgaagaaaaaaaatcacagtttttaagccatccctgctagggcaacatactagatatctcaaatatgtataaccactgcaaaatttcttgtatctaattttattatagggtctttgttgttacaacttgtaaaaggggactatttgtagaaatttaggtgtactgaaattggtaacttcatcaaacctgtaaaatggctttcaaggtgatggcctttctttagtaaagagtgaaaccatcaaactattcctgtaaattaatgttagagtaacagcattttccttcaaaaatgtagttttgcttctttatagtagaaataatttaacattcacaataatttgataattacttatcttaagatattctcatcactggtgttttgtctttatttgatcgcatcttacatatatcatgtaaggaaaaataaaggatggtcttttttgattttacttgtttgcactgaaatggctatatagaaagattttattgaagaattagctattttagagattggtctgctacataccgatatagaatgtttgttataatatattttggaagttttaaaatatataacatgcattccagactatcaactgagtgatactttcagatggaaaatatgcaaaatgctcctgtccacaggagcactgcctctgtcatactaacttagctgccacaaaataaaattaatgatgagcgcttaccaactcttgtaatattaggtgataggactttgtgccctttctgacaaatcatcttaaaatttttggcttggactagtgaaaggaaaagatgctgtattgctaggcaatcctttgagtggactgtgctgtcattttaaagggaatgatttcccacggtggatctaacatttagctacaactaaagaaatcatatggtatatttactatactgttattaaattgtctctcatcacaagaactgagttagtgtggggcaaaattctcaaaccccattgtcagtgcaggaagagatttttacagtccaatagctccttcgttacttagagatagtgtatggtttaacttgatcactctggtttatttttactttcaaattgtaagatttagcaaaacattttatattagttggagacaaagagaaaaatattattgtatgaaggcacacccatgctgaacttacaggaaagagaagcagagctgcacagccagttatattacaaggctcattcctgaaacctgaatatcatgcgagcagaaaaatctagatatgtgttatattttgaagaaataatctgaaggcaatattatttgcttttttatcaaaaaagaaaaaaatgcatctttgtaaatgtggattgactcttattgaaacagggaactgaatgcttgtattgcagccttaaagaatcacatattcactgcaatattcgtttttgtaaactacagcctgcaacctagcagaccatgactgaatgcttttgaaaagttgtagattacaaacatgaaatcacaattaatatcctctaaaagtaatttcagagctttcacgtcttaaaaaaaggacaatgtgtactgcttcacaaggtaatgtagctaatcaaaaaagagtagaattaaagtatttacataatgagcaattctacagaaggcgatcatccccatgtaagcactgctgattatatcccacgctgcttttaacaaactgtaccagattggatccagccatcagcactttcagagaatccttaaaagccttttatgggtctttgaatttattgtagaatggcattcttcaggtagaatatgctggtgaaagaggacagtgtcaacacaaggtaccagcaggagaaaagaacatcagcgctcccggtaattccatactgggctgtacttggagctggaaagaaatggaaaagattaaatcaaaatctaatttgtgtcttccaggatcttgacaataatcaaaaggtagccaggtgcatcggggaaagcactgacattggagtcagacagactgaagttcatatctgattctgctatatgacaacgtgtgggctatgtggctaacttctcagagcttcagttttctcaagggcaaaatgaaaataatagaaataatagaatccacctcacagggctgtggtgagaattggagatgaagcacatacagcatattacatcaactaaacacatgctaagtactcaacagctactaacattattattcctcttatatgtactgtaaatatttgtattaatggacaaatagtcattcatgtgtatatatagctgtgttttattagctaaatactgtactaaatgctaggaaaacaagaatattgtcccttccaaggcctttttttggtgagaaaagatcttcaaacaattataatacagaatattagagttgcatgtgcatacccagtaacacagacaaattgtgcttttaaattgcctgggtaagggagatttcaaatacagttttactaaaggagactatcatgtgggtagaagaaataacatattcgaaggcataataaaaggacagagcaaggtgtgtcgtatagaatataaaggtagatttagtcttgctggaccatgaagtttgaggcccgaagtggagggaattgaaactagacctctagacaggtagaatgacctctactgtaatgaaaaagggactaggtttttatattgaaagacattttgaagaatttggagagttgaatgtatgactacatttatacatcagaaatattacagtcttatatatggggaagttcacatggtacttggctaacagtcatgttgaattttcactgaatacctgaaaattcaccaagtttgggatattattggagtgtttggaatgggtttcactttgtttatgaacagacagttgcctagttgtagtgaattatattgtgttccagaaattaaatgttacagccgtgcttggacttgtttgagactgattctcatttaccataataataataataattgtaataacaaaaaacctgccaatatattttaaccaccttttcttaatgaaacctggatttcaagcactatttcctagtagaaattgaataatgtagtaaagaaatcgactacttcatttctaaatttataactcaaatccaggagcaggtttagtcacactgagtctgaattgccagcagatagttttaatgaaatgttcacaaatgactatattgctacgtaacaagaataataaattctgctgtttacacttccaagaaattaaaggggatgaaagatacattggtccctgcagtgggaagtttccttgacaatgcaattattgattccaggtgagtgggatttgaacactgagactactattttttaataaacaaagagcaaaattaactatttaatgcatgtgtataattacaaatgagttttttaaaaaataaaaagacaaagaaagtaagtctattgttgaacagagagcttttcaatttctgatgtatatgaagtctaatttaaagctatggaactcctcattgtccccttttctagacctagaaaaatattttaaaaatacaaattaatctttatttaatatatgaccttctcaatagtagttatgctagagttgtttttcaagaatgtcaagtgtaataaaacttgtataatggtaaaggaccaaaaatatgtaaagcatataaatggtttcataaataagaaataaaatttaaaagctaagcataaaaagcaaaggtaaattatttttgttatgagaaattaagtagtaacattaaatgggtagattatcaagtcccctcaaaactccttatccatccttgaaaatgcgtttttgggcaatctttcctggacctcctctcattctccaacaaactgagctgaccacctcttttgtgtcatgataccatgaaatatatattatatgttatgtaactatcacactgcattgcaaatatttgtttacatattcatttcttccaacagatttaaactcttctaggtcatttcttattcatctttgtgtttccagacataaaatctggcaaagtgtggtatatagtagatgctcaagaaatgtctaagtaaatgattcaatcaaatgaatgggtcataatcaaaatgagtatttctgtcctacaaaatggaatcttttctgaaggaagccacgtgattataggctagaaaatgtactatagtagtatagtacattcattcattcagcaagttttaattgaactaggtaccaagcactctcctaagtgctgggaatgcagcacttaataagatatgtatgatccttttattacttaattctgccttccccagtgtagctgtatcttcttccactcagcctcctattgtcttaaacttaacaaagatattaccaatagcgtattttaaatttattactttacaattaaaatagcatacgtcttttcactgatgccacaaatttatatacttttttgttgcttgtgaatataatatttatattagtcctgaaataaactagaaactgggggatgaatcgttagcttgcaattgttacaggcagtagactgtggagtaatcgtgaataatcagtacaccaaaacacaaagagcaaagttagtcaccataatgtgagatcagatacctaatgtcaagttacatgtcaccagtcgtactctttaaatatctactgaatatctattatgttcgtggggttgaattaagcctcacataggcaaagatgaataaaaccaatcctttctttcaggaagagcttattctagttggggatataaataaataggtaaatacagaacattagggtatatggaactttaaaaataatatacaaacttgggaggattccctatggcagataagtaatctaggcaacagttacaaatacaattattttttacaaaatacaatgatatacatactttagtacacacatatctcatttttaaaatggtgttataacattccattgttgggggatgccattgttatgcaaccttattcccactgactggcatttattatgtgtggtttgtgtgtgtgtatatgactgttgaactgaattatttgaagaacagggctaatgatactcaagttaagggtctcagtattatttgggtcaatggatcttcttagcaggtcaaattccaatcaactacttgatcttaagaaaatagctgttagctattagaaattagcttcaagactgggctgaaatattacttaggaaaaaaccttcagaaaatcccatatgacaaattaagcattaccgcctttcccctgtattacttagtaactggtaatatacttatacatcttaacctgattaggtcaagaatgtctagaagccaagatatattataaatatcttttatctttgatactgaacatagagtttggtacttaataggtgttcagtaaacgtcagtgcttcacatccatttcccccagttactacaaacctataaggagacaaaataccttgacttcttttttcagagagtatcatcttttccttttgtattttgctgaatctttcttctcattttagtatcaggctcattatactttgacctgtacaggtcagactacctcccttaagtattttgagcaagaagacagatcattaagtggataatataggaagacagcatgtactgaactttataacatcatactcttgccacaaaagacagtcagcatagatgaacccataggtccaagctagaagcctgaattacttagaagatatctagttgagcctctgggatggccagacctgttgaaggatctctgtcaagtttttagttgcctttcaatatcatgctgctatttaccttaagtaaaattaggcagtataggtcatgtgatcagagatgtatctgggctatggcaagggctttagtttcattctgagtgacatgagaagccataggagagtatgattatttttaaaggatcacttggctactcagtagacaatagattgtactaggaaaggcaagagtaaagcctatgttgctcgggtgcagtggttcatgcctgtactcccagcactttgggaggccgaagcaggtggatcacctgaggccaggagttcgagaatagcttggccaacatggcgaaaccccgcctctactaaaaatacaaaaaaatagctgggcatggtgtcacacgcttgtagtcccagctactcaggaagctgaggcactagaatcacttgaacccaggaggtggaggttgcagtgagccgagatcgcgccactgcactccagcctgggtgaaagagtgagactctgtctaaaaaaaaaaagtaaagcctatcctagctcaccttcaagtattccccattgtttattgagtaaagccaaaactttacagcctgggattcaagtattccccattgtctattgagtgaagccaaaactttacagcctggcattcagggacctctgccatctggttctagtcaacttatccagactcacaccgcttcttcactctagtcatacaagccattttctgagcacatagagtgtttcattacctcatgtcctttgtgcatgcaacctccttaagcctagatggccttcttcctattcccctttgcacttattaaagtcctgctcatccttaaacatcaaaaataccagtttttccatgaggccatccccaatctaagaaaaattattagtcttctgcttatacctgacttcagaaatgttttctttcttcttaacttataattagttatatatatgtgatatataactataaacatcttgaagttatggaacattcctccttatatgtgcatctgaatcttatatcaaatgtgttcaattgatgtttactggattggatgtgaaataatattcctaaatatgcatgtgtcaaattcaagaccattttgatagactatcctattttaatagttgttcctgtgatttctcaccctcaaggcaaagtgtgtaatgaaattgttctatttctttcttactacctgcttaattttttttgaggagaagaatgaagaaaagagaagaaaagtttaaattgagaacaagaaagaaaggaggaggataaaggaaacaaaaggttgaagatttaaaactaacagagagaatacgcagccctttaacaatgtattagattgtattatatttaccattttattgaaaaaaaagagaaaataaaatagagtatgtaagggagactgatcctgtttgcagatcagaatttaaaacaaacaacagaacaggctgtcattctttctagttcttagtaaagctaagacattctagtctttaaatatgacattgtatataatatatggactgtagagctggatgacattggttcaagttccaattccatccctttctaactggactaacctaggcaagtttcttaactttgctgagttcagtatcttcatttgcaaatgaggattggtagtatctcaaaagttattacaaagatcaaatgtgttgttatctataaaccacccagtacagcacttaacaaagcataaacactccctcaaggatgatctaaacactcctcattcacttattcctttagcaaattcagtgtgtgctatgtgctaggcactctgaggcaatgagcaaaacagaaatggttcctgttcccacagagctttctgtttaacttgagatgctttgcatggaacaagcatattttacttcacttaatctacacttggttaaatcaatctttctctggtcttgcaaagatgtctttcatttttgcttacaaaaatattaattctctatattttcttgactttgggaggatttttatttaatgcaatttatagctagataattggccagtctcctctgatttgcaatttcttcagagtcagaggatatgacctcttccttttcttctcttttgccaaagagaacagcatggtgagtgaaatttagagaatggcttcatggctgacctaatgacgagtttgtttttagaggatctgtctcaggtatgaagcaaaagtgtccaagctgagtggagtgtaagcctttgagactttttcccgttgtcaacaggaagatccactctgggttttaacatatatcttatatcttttctaattatgattatcactaccaattaccacatctgctgcatattattttctgttttggcagttttcccttgtattgctccagtttgtattttgaggcaacagcaaatgtaactgtgaaatatttagttttggtacaataccaattacttccctagaaatttccttaaattactcaagctttaaactagctttgagtcatgtttttaagatttctgttgcaatcttagagttactaaagctatattaattctgcttctgtaagacaaaactggcctcaacttacattttcctgaggaagcatatacctagtgggaagcaaatgatttacacccaaataacgtttcaagcacaagagggtgattaatgtgtactcaaaatagagaacacatacgtttactgagaaattatacaccattgattagatccaattgacagtgtgatcctgtttcattacatactgtgggaggagtttgctcaaaagataattaaatcctctctgaagcaatatccacccctttccccatgagcagctgcaggagatatccggaggctcagattacacttcccttttttgtatcacttaattttacttaaacactgggtagagattaggagagaaaaagagaagcagatgggatatgcttttccactggtatataaatttggattatagtatctggaagaatcaagcaggtctcacacaggtgacataattatactcctttccattatttctggtgaaatcaaatggtccagatcctaagatgagatgtgctgagttatagatacagcacagacatgctctatcatctcatgtaccacctcacatctgttgcacagcgatttctaggaagagagctttgtctgtgtgaatattgcatgctcctgtactgtagaccctctgtagtctttttctccccctcgactttagggttgaagaatgcccgagtagcatacttgtcatgtggtagggaccaatgtagagattttctgtctgtttgtttactaaacacaccttcattgtgcatgtctcctggagtgcagagaggtaaacataccatggtcctcttttcaattagctctcagtgtggtcgactaacaatttatgattccctactgcagtcaactcctcttgcatttagggaaagaatgtaaaaattggataaatggcttcagattcctgtcagtcagctttcccgtttgtcttctttagaagaagtcaggcaaacaagtgcacactggtgttcttttcttgaattagaggccaaaggtcatagaaaaatttgtatttatatacttattctaacattttgggttttttttttcatttgataaaaaaacaatgtctatcttcaggtagttccatcatttttgacagactgaaacttgataaacataaaaataatcatttttacagaaaatctctctatttttgtgttataaatgatgaggtgaatgggtagagaaatcacaccattcctttcttgctctttttgactagtggcatttttctgccaacttattcttagcgactacagagctatttctctggccgaccagcatccttaagtcccattctgcttgctgaataaccattttgccaaagttcacaatataccctcctatctactcagcatcaattacattaggaattttaaacatatgtttgccttggttattacccacattcagaaatctgcctatttgtagataaatgcttttatcttcatatagccagatgaaactctccaagactattacctctaatttgaggtaaggagaataaggaagcaatcatccaaatataaacaaataccgctatcttttattatccttcctagttgctgaaataaagaagtctcaaagcttgaattgttcatcaatgttttccaaatgttttggatttttttgtttactctattttagaaactcagaagtaatttacatgaatatatagttgctttgtagtgtgttgtcaatacaggttattttgtatgaccctgaatggttctttgaacttggtatggcaactcctaccaggctggtttgcaaatgggtttctatgtaagcgtcttgacatattttggagtgtgtatgtggatgtgtgtgggtgtgtgtatgtgtgttttaaactctggctttgtcgtgtgaaatacatttgcacaaaatacgatacacattgcccttactatacagactttagcttgggcctctagggcatcatttagttgaagaaaagaaggttttacagaaataaaaatagaaatccagctgtgttcttaaggtcagtaatagtcactgccatcagctgtgtcttcactgtgacactgttagtgtggtaaaaacatgggagaaattgcaaaccgaaaacatttttgcaagttgaatgcgtttttatgatcttatacatgtgggtatgtgggtgtgaaattatttaagcttttatgtagggtgtctaaacttggagtttcatgatcaggttttcttgtttactacattttattctttgtatcttttgtgttaggaaggttacctaaactagcttattttctggagtctgcaacatcgttcttttggcattaattaatgatcaagaatttcataagctttgatcatttccatttttttgaatattccatttacctttaaattttgtctgcttgtttgttcttcgatttttccagtgaaatgaaggccagtgattatctggccttgtagttctgatttacttaaattgttccacttgttacactctagattgattttgagttcttctcaatgattctctaatcattaccattatattttggctatttttaaatccttaataaaatccaaaggactttgtatggaatgtaagaccttctgtaaactttctgcaagctactttttcagtcttatacctgatactctgccatactttgcacatgtgtcaccctaggcagaaaactctccattcccaggacacatccaagcctttgctgcacttttgtatttgcagtttgccttcatctgagatgggcttctatgtctgtatgtgttgaaacagtactcgtatatcagtgcccatctcagatgccacctgctcacaaagttagaatctgaaaaaagtctgagtactggggatcagctgttgccatcctttagttttacagatgaggaggtgaggctgacagggatcaaatgatgtgcttaaattagatgcaaaaataagacaaggactcaggtattctgattctctgtgcttccatctctatgtagcttccctgaattattacctaactctggttgaattaatctgccaagtcctcttttctcctacagcttttgcctatacttcatctatattttacctatactttatcactctcatgtgcatcttcttctacagagtctaagtttcttgactctgtaggatcatatttaatttacttttatatgactcatagcatttgatcaagtgtttggtaccatcaaactatttattacagagaatggaagtatagatacattgtttaaatttctgcattgggatgaggttttactatagagctgaagaaaaaagagataggaaagataatattatcaatcaagaattcaggacttggaaatattgactaccactgtaaagtaacgttggttccatctactgaaaagacgaatcttgtcttcttggatgtctctcaagacatcataccataaatatagagttatacctttacaaacatataaacacacacccaagagaactgttaaataactgctcttgtctgtgagttctatttgaatgtgtttgttatggatggaggccatatttcttaacaatcaagcatacgaggtattagcttagcaccctggcacctcagttttctcagttgaacaaaggggataaaattatcccttctagtgttatgataagcaaattagacaactaagtgaagtgtttattgaagtgctgattaaattttcttaaaattgtagctttaaaaaatgtgttagtgtttacacaagaagtaccaatgtaagccctaccttggcccacaaagaaatgttcagttgttggcaggagatcatgtgtatctcagagttctagaaatctgaaacagtaacaatgacaccaacaatatatgtcccttctaaaacagagcttttaaaattcaggtcagaaaactcatccactaaacaaataatgcttaagtatctatacatgctcagtgatcacctgctattccccacgtactattctgtgttccagggtacactttttttttttttttgaggcataccactgtgatgttttactggatagtaatgttgactcttgtgttgagatagacctttctcctagcaaactggagaaaagaagcaagtagtgtttcacagcttaattagttatagttcaatggggaaaaaatgtggtagagaatgcaactttcaaaaacagaaagaaagaaaaatggtaaaccacctgtgcctactttttattattattatttatttattatatatatattttttgagatggagtcttactctgtcgcccaggctggagtgcagtggggcaatctcggctcactgcatcctctgcctctcgggttcacgccattctcctgcctcagcctctcgagtagctgggactacaggtgcccgccaccacggccgtctaattttttgtagttttaatatgtagctcctctaagatcacaatgctctgaacaaaccatagccttttagctccttgggtttacaatccgtgcctcttttacttggaattaccttcttctacttcctcccaattctccctcctctatctgacatatatttctccttaagaagaaatgtaataacttaagaagaaatgtaataacttacatgatcccttccttacttcctccttccttggagcctcattgtaactcacattctctcaaggccttgcttaggtacttgcttcctcacctagatttcgcatttctaaagagccggcatcatattttttcatctttcttttcctcttgtttcttcttcccgacagagtctaacacagtgactacatataataagggcttaataaataattactctttttatttccatatgagataaatttgcaaaatacacttgtttcacacactttttgtattttgccttacatcttctcattacatttctactttagctattgctatgacaactggttgtgtgcagggcaaacaattctaaagtatattctacagggctcctcagagggtccctagtaggatggagtccagttatgcacagctagtaccagttcaatagtgtattattggactggctttcccttcttccctattttatttgttccagtcacccaccagtgttccaaaattccttcccaaaataatcacctacaagcaatttgctcattttaggggcatccagagaaagacaataagcttgtacaaagaaaaggaaaataatacattgtaaatactgtgtctactgcaacttcttatctccctatgctccatggtgctttgcacatagtaggtgcacagaaaattaatttggataaatatatctgttgaaagtaaacagttatctactctctttgccactattcttcctgggtcttgataattctctcagttagtgtcacttttatgagttttgcattaattatactattagcaggcacatactcttaataacaacaacaacaaaaaacccaggtcttaaaatcttaattaaatctgttttttttcctcatagattttatcccaggaatattacccactgttttacactatcatcattttggtttctgctataccagcagcactgcttaatgaaagttttgtctcctcttgtatttcttaaatatttaaaggcactcacggttcttattttttattatgatttcaactataaaatactcctctcctctgcaaccttgaaatgttctttcctcaagactctattgctgcctaagattatccaacttgtaaaacgggaaaatgagaaatagaactgctgtggaaggactttgggggcaggcacaaaaaaatcagatattagggaattctggtccaaagaagagtccagaaaaggatgaaaagaaaaaaaaaaaaagaaaacatgcacagtgatgccagtactgaactcagacactagtcaagatggtaaaaaacagagagaggtgtgcatttttaaaaccattacatcaaaacaccttacctctggctcatttttgtagatattgcaaatttggccatttatattactgtttgaaatcatttttgactataataaaaatagcattccctgcattaataaatgtttcagtttattagcattaagtttacatccatggttccttcaggcacaaaacattaggaaatttttgtcatttcataacacctttattttattaagagatgcctccactttagcagtactttcaattatacttaaccttaatatatacatttaaacatataattggaaaattgatctttgagacttacataagtcaggaaattataatttagaagtaactgatttttacaccagtaatcacattatttattcaacaagtgctatggagtgcctgctatgtgttaggcattgcactcatacatacacaaagatgaacaatacctaattcttagcttttaggactatgtagtcaagtagaaaaaaaacattctacacaagaaaaaaggaaatgatttttacaaaatcatatgttattataattccagggttaaaagaaattttgagggtatctattcacctttgtcaaagcataactaaatcagaatctagttagagaaagacattctaggcttatgtcgttttatagccagaagacactcaagtctggagaggaaagagctagacagagaattaatgtaagtgtctagattttaagtttaatgccttttccagaatattgcactgctcacatgaatttgtttagtattttgcttcatgcttttataacgctcattgcttattaatattaaagtagccaataggaatcttaaaatgtttctaaatataatatgatcaaaataattccatagtctagtaaattatccaaagtctagacacatctttaattagacatttcaaccaataaaatacaaaatgagtttgttctacatacttgctgaaagtaatataattaatttttgaaatatcaaatgttggaaataatttccaagatctatagttaatacatgctttcttcacatctttcataatgtgttcaatttgaacttttttagtacctcaagcatatggagctcataataaatacgtattgatcaaatattagtgatatttgaataatcattatattagaaatctcttatgaatggctaatttatttttgtaagaagaacttggcctagaatcaaaagagtaggcatctacaacatttagctatatgtctagactgtgtcttgattcatcagttgctaaaaggtacacatgaaatcagaaaattagcattcagacatctctgcataaaatttagttgttggtgtttgttttaattttttttccagtgaaggagcagctttggcttactattcaagctcgaggtcagggcttgaaaacttgaaaaatggaaaaaggattaagagaaccttatattcctgaatagcaaaggtatagtttaaaaacaataagtgtgtcaattggttttcacagtaacttctctacttcctagcacactagtatctaagagtaactgctaataaaataagccacatttaaatacatgtgttctaacatacattttccatttcacactaacttcacttatattcacaattaataggaacatttggcatcattctaattgccaaaaaaaaattctaaaattctgtgtttgtttacatgtaagacttaaagaaagcaagcataagaaaagcaaccatacattctgatgtattcttagaaacatatcattataaaaaggtttgggctacataatacataattgcacttgggtgtaattttttaatctttaaattagaaaagacagatgattattttctgccttcaccaaagagagaaaagatgttaaatattaatatctccttgttacacttttttttttttttaagacaaagggatataagaaggatataataagcactgtgaatgttcctgctaatcttcctggaatttcctcctatattaaactatatcttatctatactatttaaactattcttctgatattcttcacatgtgaacgagatgatattttgcaaagtttaagcattgtggcagctacccacttataaagagcagctttatccacttctgaattaggaacaaaaaactcacgaatacaaatgaaggttttcattaagccacattcttgtttattacagagtgacagtaataaattttcaggatttcaatttaacgttaaaaacaaatcccaattcccccatctctttgatgcagctggctgcactatgcataatgtctgatacacaatggcactgtctattgttacagaactggcttatttgtatattgaaagctgcattcaaatttgtatggttcagaatgttcaaagaaatgcacaaattgactactttaatattcctcaatttgtcataatcgtttttgtgtgagtgtttttcttatttaaggctgtcgtaatgtcatttatattctttaaggaagaagcaacaattcttctgaaatctcatagtcgaaagctaaagacaggggcctaggtcaagctcaaagtcacttacaggacgtgaaaatcacctcggatttaatctaggcttagcagctacaggaaaagaactgaagaaaggccttgttttatgttttctgacagtaaaatgaaataaaacgtggaatattatagaaaggattttgtaagtgaaagggagtggttgagaagaggcaaagtgagtgttggaaaggatattgaaacttgaagaaggctggaagaagaggtcaagggaatcctatgactgaaagcagcatcagagacacaaacatactgatcttggagccctgcaaatacatctctttatattgaacattttgagtctttttctattcctaggtgtgtttactaaattatacaagtctgctaataccaattatcctataaatgcccttcttaattcttaaaatacgtattgcacaactgaattgcatttgagtttgttttttaagttatgaaacaggtatcctgagtctgtaaatacagtttatttcctgatcactgagctacaaaaagtacagattcaaaaagcaatttttggctgggccagatgactcacacctgtaatcccaagcactttgggaggctgacgcaggaggatccctagaggccaggagttcgagatcagcctgggcaacaaagcgaaaaatcccatctctacaaaaaataaaaaaaattaaaaagtgatatgtgttggcatatgcctatcatagtagctacttaagaggctgtggtgagaggattgcttgagcccaggaggtcaagactgctgtgagctctaattgcaccttgcactccagcctgggcaacagagcatttcttgaaacaatttcttatctcaagaaaataaaatgaaattttttaaaaagctatttttaaaacatggaaaaaaaacttacaaaatcaagaaaaatgattgtcattattgcatagatactaattagagacaaatgtagttgcatgttgttcatttgaagatattaccttttcatcacttcactggtagagattagaggtccttttccagcatttcaaaaaatgtgggaaaaactagtctcttctacttgccatagataacttactattgcaattcctgaggatacgtaattccactgttaaatacagggtgggatagcaatcacattataattatcaaacttttgggcagggcatataaagaattggccagaatttttttttgttaatctcttcatttaattctttgattatatcattatgaccaactcctcctcacccacccccccttttttttttttcaaaattagttgcattcagaacattttgagtataaagaattaagaccttcaacaaaatactgcagcactgtgagccgcaaatttctataggcgctataggaggggttattaatatccttagactattgtgaatgttggaggagataatgtatgtgcctgtgctttgtaatgtacacatcagtttgtaaaagcaatttgagactaaggcataactgtcagacgctaatagttaggactttaaagaaaaaaaaaaacctttaaaatttgttgtcatttgataaacaaattctcaccattgaatagtaaatctttccatgattaatcaattcaatcaattcaatcatagacataaggttaagtgtaatgacccaaaactaatgtatttgggtaaaataaaattatcttcacctacaggctcagttttatctatttgtaatttgtatgataatatatctgacttacaaaattatctttattattcatttgttcatacatttgtggattcatttaataaatggatttagtatgtacctgtgcacagaattacctcagtgtcacaggagataatgcaccatggtcaatgtggtagaaaaattctaaagatgtctttcctccccagacattcccatcccctggttactcagtcaagcactaatctaagtactttgtgaaagattttgcagatgtaattaaaattccaagttagttgaccttaaaatctggagatgatctgggtgggcctaccccagttacatgaagtcttgtaaaagcaggcagttttctccactggtggcaaaaacccagagattaaaaacccagagaggagttggccttgctgttgctggcttcaaaactgaggggcccccatgtgttaagaaatgcaggtgactttcagaagcagaaagcagccttctgctgacagccaacaagaaaatgaggacctcagtccttccaccacaaggaactggatcctgaaaacacaaatgagctcaaaagtaagtattccctagagcctacagataagaacccagctgagctgacaccttggtttcagctttgtgagaccatatgcagaaaacctagttaagtcatattgcacttcagacttatagacctgaaagtaaatttatgttctttaagccacttgatttctggtaattgtttcatagcaatagaaagcaaatgcaagttaacaatctgtttcatattggggcatgccacataaactgtggaaaggcaggaagggttaaagggacaaaagttagaaattaaaaaaaaaagacatgtcaagatgaaatgactgagcagcacacataatacgtgctcttagcttcaagaagagtatttcacagtgggctggaatattctgagaagttcttcctggagcaggaaggcttaaagcatggaagaggtagtaggcaaggccgaatctctcttatgattccaaataaacctcccattaaacttgtctatctttaatttgagtttttgtttaaactgaaagcagcaacagagatgacactgtatagatgacattatataatcctaagctatatctgttattcatgttttctacaaacctttccccaactataaaaacaacaaaaacaaatgctccagagactccaaggagtcagtgctattattccactgagttggaaggaaataatcatcatccacttataaatccgggattactccaatttcatgctgagccctgaatgagataatacatacatatatgtaatctccatatagagtacagtaagaaagcttgaccagaagacctgtgtgcacccctccacacactttttttaatgtaaaatatctgagtcggaacacttctcaatgaataactaatcctgggaagcatataatcatgttcattttctaactcttttgtggtcaaataataaatacagatgatacagaaaataggaaccatggcaaatttggacaaacgtaatttagagacagtgacagaaagcttagtcaagcttaatgctcacaatccataaagcaaaaatcaggacaaaaaacaccaaacattcccctgaggctcatgattacataagagggtccttcaggtcctttggtttagcacaacctcttcttttcccagcaatcacactcctacagctaaaagatgtctggactacgacactcattatttacagcagttagtgaagctgcaagagtacctacatacatatatgcatacatacacagtgcagaagataatgagtaatgccttagctcatcttatttccccaaacttgtaatttaattatgtttccaatgggagaaaaaggcacacacctccccttaaagaacacttttttatatacaaaaagtaaagtggacgtatttcttttacttgtgccatttctccatttaagctgctatttgctacttatcagcatgaatagaagaatggatgaaatgagcaaaacatagatttttgttgttcctgccatgtaaagttacagcaaataaattgcacagagaaaagaataaatgtagaaataacctaaatctttttatgtagatgaggtaaaaaggcagtctcctttagaattgctcctttagattataatagcaatttatgttaaaagtcacgatgacaaatcagcctgtaatttattttaaaaagtcaaactagcaagatcaagcgtactgtaggtggtatttcatcttatcatattaaaacagtcttcccaaatgtaaaagataatctcaactgctgtgttctgtaagcaagcagaaaattatgtaaatctgatttccttactgtgtgcttactatctctttaaagcttactaaatcatatccagatttgtaaacacaaaagcactggatccaagatatatttgcctttaaacactcagaatgagaaaaggtattttgcagggtgtaattgaaaaattcctatctgttttcaaaagctaacaaatcaacaattatgtgagatttaaaaaaaaatacaaaacatcaccttttaacttattatgggcttaattgcttcctcataatggagtgtgacaatgtgattgcaataagaacagcacctgctttgaaaatcccatatcaaagaaatgccagtaagggagcaggaagctcacacggcagccatgttgaagttcctcttcatctatattttagctttcactgtttcttaccctctgtactttaggtctctttaggctcattgcctgaataactggtgtttgctttgttagctcacctaaaaatgtctgtacctgtatgcatgctcacgttggagatgtcataagcataaaggcacatatatgtagctggatatttctccgagccaaaatttagaaactttcttcttttcaaacacagaaatctcctacatgacccagactgtaatgtgctctgcctgtgtgctagaagacaaacctgtgatccagattgcacagcatgttaaagtcaatagccgtgccaatagcatggactgtcctcatccttcctgtgttctgcagaagtaatactttgatgtcaaagttaaattcactgttattgtgggtttgcatttacctgcatcagtacactccaatctatttggaaatatacatctaatcttaatatatatcttttcacaactaatttcttactttatatattacagcaaggcaggaaatcctttactctttctatgaagagttaaccaagtaataaatcaagttaaaagatatttaaattactagttatgttttagttaagataaatgtatagtatttcctgcacctttaaaaaatgagagtaagaaaaacaaactctcttgttctagttcctggcctatagtaagtagttaaatatttgttaagtgagaatgctattcaatacattcagtaagcaataaaatatacattttggttctttattaaggaattttgccaactgtaaaataacacaatattccattttaattctagcattctagaattttaagtgatagatcgagacaatcacatgagagtaaagaaaggcagtgaatgctgaacttacatatgctatgagccatacaaagagaatgaccagcaaatacagtaggacaaagaataatgagagatgtgctcaaagggagctatgcacctgcacataagacacactgagaggctgataacacactcacacacacacacacatgcatgcacacaaacacacacactgtccttatgcatagcaacatttagaggcacacaaagacacttactgaaagggcagaggaagactgagaattctaattatggcagaaagtgaggtgaatgggaaacagccccagtttatgtgtttataggataataaagactgcaaatgccctcttgtattttcacagcagaaggtaccaacggcagtgccagctctgggtgcttgccttctggctagatgacattaagctgaggtgcatatgtggcctgtgggctgaagatttcacacctgctataaaggcagtctgtgttaagtctcattctaaatagtacctgtgtaatagtagtgttcaaatcaatgtttcacacaaataaaaactcacattcatttatctataaaactgctataatgttaaggcactgagtataagccctaataaattcaaatgctaggcacattatatcaatgtgctgtcagcaaaatgcgtagctgaaagataatgaataatttcatatttcaggacctctggaatctagaacaaaataatcagaatagttgattcttatattcttagacctatcatgtttaagtatgttttaaaaactttgcatatataaatttatttatataaatttattttttattataataaataaatttattttattatataaatttatttactcctcacaacagcctatattattttctccattgtataaatggggaaaactgagatacataaatgttggagcctagatttaacccagtctatgaagttttaaaatctttgttcttaagcactttgcaatgctgcccctcagagataagcaacaaatgtaaaggcttaaaaaatgtttgaataagatccacgattaaaacaatacataaagaaacaaattttaaaactccctttggattttctctaataaaaaggaagaaaagaatactttaaaaatctttatcacctgcaggtagccttttcaaagacttttctttcacaaacaagccagtatgaagttagaagaaaccctggtatgataaatacataattttttagttctttgattaaaaggttacatcttgataactttagagttttttttaatttttttttcataaaccgcattgactagaactgctggtggtactggtacacatacctatatttactttcaatgaacttaaattcctgaaaaagttatttctaaagaaggaacaaactagcatgtagtatttaaatggattattttacatatcaggaacacaaatctctatgtaccatcagcagtttttgttatttttacaaaaggtaaaattaaaacaaaaaaagtccgaaaggttaagtgaagtctaaattacatttcatttcaaattcaaatgctcggtgggggttgcacagtaaaatccttattgataaaagactggcttgaatcaaacttcttttttgctaatagcctgagccaagtcacccagagccagtggtctctgatgcttctagagagtcatccatcagaggctttctccatctgttaggtccagtgcacagtgcattccattttgttctcactctgggacctctccagccagtcctagatccatccatacctcattgttctgcagccagacaaacagtggcaattaaaacattgggtagggatgacatactatggttacggttaagaaggcccttccacttttaaaaatcgctgttttgtgatacttaacattttctcaaaatagtattcagatggaaactttgtgtttgctttcagttcaaagtgcctctgtatgagaaatatttaagagatgtattttgttttaaagtaaaaatatactttatggattacccatacttacttatgaaggattcactgcagggtgagagggaggaggataatttacacttattattcaacaaatgtgttgactgcctactatgttcaaggccttttgccagcccctgcctctcttctcagaaaggtaattatctcctaggacagataagcagaggcagaaataaatgttatataattgaaaagtgccagccttccctcccactgcagagtccctgctcatggcctggtactgcagtatggaagaggagagtatcttcttagaacaattgggcaactcatctttgaacttttgtttctgtttggcaccttctggcaaactatggccattatagctcctggatcctggctcaaagacacgtttcctttctgctcttggctctatggtctcatttagatctcagatcctttctctgtattgcctctataaacctcagtttgacctggcctctgctgggtattgccctaacatatccttcctctgcaattctctgctcttttgcttggggctcaactaggtgactgcaatatgtaatgtgcctttttctctcttgcttttatgtaaaattaaaattcatggttttgattttttaatggtattgaattagttaaagcagtcatactgtatttccactcaaaacccttagattatccagactttccaacattcttacagcatagagttggctataaaacatccacattttagctgggcagtacagaaagtgtataattcacattttactacattttctgaagtggtatgtcttatagcttttttttaaaaaaaaaaagttgtgactctccatataagaattaaaaaaaggcctttttttttttttttttttttgagacggagtctcgctctgtcacccaggctggagtgcagtggcgcgatctcggctcactgcaagctccgcctcccgagttcacgccattctcctgcctcagcctggctcactgcaagctccgtctcccgggttcacgccattctcctgcctcagcctcccgagtagctgggactacaggcgcccaccaccgggcccgactaattttttgtatttttagtagagacagggtttcaccgtggtctcgatctcctgacctcgtgatccgcccacctcggcctcccaaagtgctgggattacaggcgtgagccaccgcgcccggccaaaaaagacttttttttttatgatcttttttttatgaccttttttttatgatcataaaaaaggtcaaaaaaagaccttttttatgatcaggcaataaatatgtattccctggcattgtttagatgtattcaaatcccacaaatactgattgaaaagcaagtaaaaatgtatctggaaataccatgaagatataaatcataaattcagtttatttaacactaaaatacacaaaaaaggacagtttgaataaagtaaaacatggctatagctcccaatttttctagcaaagtgtacaataatggaagaagaaaagagctgaaagatgtctatgcagactaaagctcatctgtaagccctaaaaacagagtgagtatttcgaattgaactcagaaaaagtaaaagtctatagaaattccacacttctaatttggatttatttatctgaaggaaagaggatcaatatttatttatttatttatttatccaatcatccatccatccatccatccatctgtttatccattcattcattcattcattcattcaacagatgtttattaaatataatgtatactgggtaataacccaggtacttcctaggcactagggatatagcaatgaacaaacaaatttcttgctatcatggaatttacattttgggcaaacaaataaacaaataaaacatcaagtagtgatacattctaaaaagacagaataagggactagaaagtgaatgggagggtagggtattcttttatgtatgaaaataaatttagagacttttgcctagagatttaaataaagtaattctttgcatagagatttaaataaagtaatgagatgagctatgaaaatgattaggggaaactgaaattgtggtaggcagagacctggttagtgctaaggccctgaggtaggagcatgcttggtgtgttcaaaagcaacaatgaaaccagaatggctgagcagagtaggagagtccactgagaaaatgattgtaagagatgatgtcgtagatcaagggacaagatcatataggtcccagagggaactttggattttatttttaatgagataggatgctattgagtggttttgagcagaggagtgacatgttctaaatatatcattcaggctctttgtggtagagaacagattaagttaaaggaagatgggaagcaaaagagacaagaatccatagcaatagttctaacagagataatagagcatgtatattagcaattgctcttttttaaagaaattattttattgtatatatttaaggcataaaatgtaatgttttggtatacttatacatagtttttgctatggtttggatgtttgtgttccctccaaaactcatgtaacaactgaaggagtgcaggaaattttacaccaaaatatggctcactggaatcatgagtattttgatttaaaaactgagaggtcagtaggctctagaagggacttttcgcttatctatgtaaagatgagactgaagcaccaaagagaacaattgtttctcttcccctccctgttatttcattatccactaaaggaacgaaggctaaaaatgtaactgcatctgaacacaccctttttaaagataaagactgactccaaggatcatttcaattccaaagataactatttacaaattaatttctgttccttgatccaacaattcatccaggcaatcaattattgccactcaatggaattattattctcccccaccttataacctgttttaccaggatccaagcccccattcttgagcagatatataagctcctggatggtgttggaagaatcctctgtgattctccccatgaacatggcttaatagatttgtatgtcttttttcttattaatctgtcttattgtgagttgatttatcattgaaaccttgggcggccaagggccttgcctcccataaaactttgtctccaatgcaacaatattaagaagtggaaccttttagaatctgcaattatgaggaaggaattctagcaaagagattaacgagttataaaagtgcttgagtggcaggtgtgttcccttttgcccttctgccttctgccatgtgaggatacggcaagaaacaaaatgataataccttgatcttggacttcccagccttgagaactggaagaaataaatttctcttatttataaattgttcagtctcaagtattttattagagcaacatgaatgaactgagataatagtgaaatggttactgtagccaaacaaattaacgtatctatcatctcacatagttacccattagggcattgtttttaaggaatcttcaaactggacaccagttactgtgcttcacactgccccaaaatgtccctggccaataaagaagtatgattcctgaagcacagtgtattagttcattttcacactgctgataaagatatacccgagactgggaagaaaaagaggtttaattggacttacagttccatgtggctgtgaaggcttcggaatcatggcaggaggtgaaaggcactgcttacatggcagcggcaagagaaaatgaggaagatgcaaaagcagaaaccctgataagaccaacagatctcctgagacttaatcactaccacgagaacagtatgaggaaaacagtcctcatgattcaaattatctcccacaacacatgggaattatgggagtacaattcaagatgagatttgggtggggacacagaaccaaaccatatcatacagtgtgtgtgtgtgagagagattatctttctctataagcttcaaagtttattgttactggtagtaaactggtatttctctatgtttcaaaataattttgtaaacaaacagaaacaattgggaatatgttttaccaaaatatacttttaaataccaataattgaagtcacgttgaggttgttaagtcagtaataagctaataagttagaaataagccttgtttcaatggctggtcaaattgtgtttatatgcagttaacctttgaacaatactggttagaattatgtgggtccacttatacatagatttttttttcaataaatatattgagaaagtttttggagatttgcaacagtttgaaaaaactggcagacaaactgtgtagcctagaaatatcaaacaaattaagaaaaaattatgtcatgaatgcatataatatatgaagatactagtctattttgtcatttactactataaaatatagacaaatctattataaaaacttaaactgatgcagactgtgcatagtgctactcagtccagggaaaataaataaatgtaaagatgtggtattaaatgataactacataaaattaacagtggtacatattgtagtactgtaacaattttgtagccacttcctgttgctattgtggtgagcttgagtgatgagtatctgcttaatacactgtgtgatagtaatcatctttgtgtgagaaattcatctctccaataaattgtgtattgcagtaaaaagtgatttctcgaggttcttgtgtttattttaaaccatgtttagtgcaatatcatagtcttgaataacaccattggagtcacaagaagtgccatagtgatgctggaagtgcgtccaagaagtaaacaaaagtcatgacattataagaaaaagtcgaattgcttgatatatatactgcagattgtactgcaactgtggttggctgccacttcaagacaaataatccagtgtaaggatttattgttactatagttaaaaaaacaagggggaggccgggcgcggtggctcacgcctgtaatcccagcactttgggaggccaaggcgggcggatcacgaggtcaggagatcaagaccatcctggctaaaacggtgaaaccccgtctctactaaaaatacaaaaaattagcccggcatagtggcgggcgcctgtagtcccagctactcgggaggctgaggcaggagaatggcgtgaacctgggaggcagagcttgcagtgagccgagattgcgccaatgcactccagcctgggcgacagagccagactccatctcaaacaaacaaacaaacaaacaaaaaaaaaaaaaaaagagggaattattgtatctacatcagcaggggcaaaaacgttgtactttttgcaaaatacctttttatgtcatattgaaaatgcagtttttatgtgggtgcaggccttctataagagagtcatacctttagtctctaatatgattagagaagaattgaagttattacgtgacaattggcaaaaggaaggtgaaggatctaaacctagaggacttaatgccagcaaagggtggtttgataattttagaaagagagttggcataaaaaaatgccaagataacgagagaaacaggttctgccaaccaagaggtagcagacaaattctcaggtgctgttaaggaaatcactaaggagaaaggatatctgtctgtacaggtttttaataagcacaaaagtgctgtattctgaaaaaaaaaaagtcacagagacatttattagtaagaaagagaattgagcagcaagatttaaagcaggaaaggataggctaactccctattttgaatgaatgcagttgggctcatgattaggactgctcttatgtataaagctgccaacccctgagccttgaagggcaaagataaataccagctgctgcccatcttttgactgcacaaaaagaaggcctggacaatgagaacacttttcttggaagaggtgcatcaatgctttgtccctgaagtcaggaagtaccttgcccataaggaactactttttaaaattcttttgatattggccaatacccagaactccatgagttcaacatggaaggcatcagagtggtctgcttcctcctcaatacatttctaactcagtccctacatgtgtggtgggtcatgaggacctttaaagctcactacacacagtactctatgtaaaggattgtcaatgttatggaagagaactccaatagaaagaacatcatgaaaatctagaaggatttcaccactgaagatgctatcattgttgtagaaaaagctgtaaaagtcatcaagtgagaaacaataaattcctgctggaggaaacagtgtccagatgttgtacatgaattcacaggacttacaacagaggcaatcaaggaaataatgaaagagattgtgaatatggcaaaaaaaaaaaaaggtggggtatgaagggtttcaatacaaagatcttggagaaatttaagaactaatagatatcataccagaagaattagcagaagatgacttgatggagatgggtgcttctgaaccagtgccagacaatgaggaagaagatgcagatgaatcagtgccagaaaacaaattgacactagacaatctgccaggaggattctgattatttaagactgttttgatttttgcttgtttgtttgtttttataatattaacccttccatgacacaatcactgaaactaaagcaaatgcaaaagaaagcatttgtaccatatggaaatatttttagagaaatgaaagcagaaaaatcaggcagaaattatgttgtatttctgtaagttacatcaagtgtgtctacctctcctgccttctgttttacctcctccacctgttttgcctctgccacccctgaggcatcaagaataacttattttcccctcctaagcctattcaatgtaaagatgatgagaatgaagacctttatgatgatccacttccactaatagtaactatactttatcattctcatgattttaaaataacattttattttctctagtttattggatgaatagtgtatacaatacatatataaagtatgtgttaatcaactgcttatgtcatcagtaaggcttctagccaatagtaggctattagtagttaagttttttgggagattttcacctgcataggggcttagggcctcttcatgttgttcaagtgccaatgtatattcttacctatgcgttcatagagctttaaatgtaagctataatcataaccctaaaaacactataggcacataacactataggtacctggctcagaaaaaaagaataatttttaagagtatgaattatatttacttgaatataattaattagtaaaaataattataaaatctaatgatttcatttatatgaaatatccagaataggcaacaatatagagacagaaagattagtagttgcttaggaataggtgggatgagaggtttttagggagtgataactaaagggtaaaatgtttcttttataggtaatatgttctaaaattgatgtggtgatggttgcacaactctatgaatttactagaaaccattgacttgtatattttcaatgggtgaattgtatcacatgtaaatgataactcaatacagctattattcaaaaaatgattataaaactaatggatgaagtcttacctatcgtaaataatggccactttgtaaattaatggtgctaaaaaaaaagctaacatatcagcaagtcaagaaattcaggtgcttgtatgctaaatttcttatgaaaatatttacaaacattctactttgcatttagaaatgttatgttcatctatgtatttatattctttacttggaaaaatgtgagtgcggaagaggtcaggttaagcatgagatctttggaaagagggaagggtatcattaattgacttcaccatgaaaattaaatgccttaatttgtgtttgtctaagatacatttaaaagatttgtttgaagtgtcagcagtgctcatgctatatttcaggcaaggagagccctccaggtcagacattgagaaaaagaagtatgattattttcaagtcgaaggagagctatattaaatatgcacttcatgaagcaacactgccttttagtggcctctcaagaactcttattattagcagtatcttctagagagattttctcacaggggctgcatggtttgctagatattgttcttgcatctatttctattagctacagctgctgatctatggtttaaaccagttacctgccaaattacaacgcttgttgagagtttcaacagtaacagatcaattcatgtaaactgtttggatggctttgaggatgtttatgtattctttataagcccttagtcaaagattgctgaagttggtggtgtacaaatgaaaaaataatgggcgttctgatatctggggctggctatgcttaaatttggcaccaataattaatggatcttatgtttcttgtgaaaaagtacattggtacttacatacatatttctagaatctttccttattgtaatgcaagtctatcaaattataatgacacttcaaatgtgatgaatcccagaatcttcattttttttgtatgtcgtgctgaaagctactctgcataataataagctctctaaacaaacataattgccttctcatcccactgaaaagaggaatgaagaaccactttcagggcaataaagagaggttttaggtgttttaggattttttgtttgtttgtttgtttgaagggcattttttaggtcgaaaaagcacttaggcataatagcattttgtatttgtttagtgcaccaaacagagaaaatggccttactaaccttagttatgctgtgatgaactggtctttatccaagctcacaattttggttatcaaagaagcctagtaatcttacacagactatcgaaagtgagatggggccagacattcttgagagagagcacctggccccatttgatgctattatggccagaacctgaatatgctgatctagaaggctggcaagtctcactggccagtgatggcgtggtggaaacctgccctgctcttggtacactcacaggaggagcaagctatactggccagaggcacatgtggacaggtgcttacttaggtgtctgactgaagcatattctttttgccctattctgatcagtaaataactgttcactattcccagtccaaaattcaaaataaaatcaaagctcccccatgatcttttcttggtgagcaaattccccaatccttttttctctaatcttcccttctgattccactttctatcactatttttatccttctccagactactccaaataattgtgttttccaagcagtgtatagggaggggtgtaatagattctgaatagagctctgtatattaaagatcaactcatttacaaatcccaaaactgagaaaggttgtgggaaaagtaaatattcaagaacgagcaaaagtggaaggtgttactagaactcaaatgaaatttcaccgtatgtcctttccttcaataatgtttttgtttgttcgtttttgtttttgagacaggatctgactctctcactcaggctgcagtacagtggtgtgattttggctcactgcaacctctgccttctgggatcaagcagtcctcctaccttagcctccggagtagctgggactacaggcacatgccactaaactcagctaatttttgtattttctgtagagacagagtttgaccatgttgcctaggctggtcttgaactcctggcctccaggaatctacctgccttggcctcccaaaatgctgagattacaggcatgaggcactgtgcctggcataaattttaaaatacatagaagatagacaatacttctcgtcaaaactgattccatatgcttaccttaccatgctttattaaagattctggatgggactctggctgagggattcttgttttcttattttaatcattctactggtctttcttctctctttttctgtatatgcctatatctgtagatatatacatataggcttttatttctctcatatatatatataaataaattttggtctgttcttgtttttcttcagcctcatgtaatttttccttttacagacttccttagcacttgtgttcatttcttaaggaacatagtacttcctgcataattttattgttttattttattatttcattacccatttgtattctatggcttacgaatccattgagaataggtgtcacatatgatcatcattgttttatctttgactaccacaatttgatgtcctagtatgtattaaatgtttccaaatgaataaaagaataagtatcttcacccaaaatatattgtattttattctctaagtaaatcagtacattttgttagtgatgaacactaaaactgatgatttactatgatgtgagaaatactgaattaccagtaaattctataaattctcatgagcattgattcaatttacttgtccaggtataatctgcattcattgccaacaaccatagcctgcaatagagcaataaagtaattgctatttgatgaatatggttttatttggattagagatctatttccaaaacataaattctactaattttcaagacataaaactggcctgtgatatataaacaaaatgttgtaataatcgacatgttgaggtgatttcttgttacttttcttaaatgcagttattatatcacttatggataaggattctattcaggaaaggatactactgattcctttagacatctgccattcaatttggtacaggcatcaacagcatcaacctcagctgggagcttgttagaaaggcctaccatcaggtctcactccaggctgctgaatcaaaatttgcattttaccaagatgtcccaagtgatccaaatgcacattaaagtttgagagacactaccttaggtctttatttctgtcattgaaattaaaattgtcatatttatagaaatgaaagaacaaagtcttgtgtgtctgggtttagatcagtcctataatctcaatcatcttaactaatgcaggtgagtattttagaaagattttgaatattaatgcttccaaatgatcagacccatgaaaatttattggacactcatagatcaaaacaggataaagcaatcaattaaaagacagaatttatagggtgctcacactgtgcagaaatgtaggtgaggcttttggtagtgataaatgacagatgaatttcaaggcacgtccagctgaatagggagacatatgtccaaaacaattatcagtacaaatgaggccaaaatgcacttcttccaggcataatgtgtggccatgtggtgaatcacataaacaatgtgtgagtggtcaacaatcgctccaaagtgaagttatcaactgatgtgaaattagtgtggctggaacagaaaataatttgcacataatctggtgtggtaggttgttatcggccccaatcttttagctttccttcttccatacccttcgccatgtactttttaagggccctcccactgggggcagtatgtatttccctgcctcatgactttgaattagccatgagacttgctttgccaaatgccatgacatagaaatggcaatctgtcatttttgaacctagaccacaaaagaacttggtgaattatgatgatcaagaatgtatctaatgaggctggatgatgagtgattggatcattcagtcttatagacaacagtaatgaagtaaaattttacttttagtgacatgagaaggcatcatcaagggtttttaaaatccctttctgctctgtattatagctatctgagtaaatgttatcacgtatactagattttcagctattagaaaatgggaatttatgttatcatggaatgtttcctgctaagcccaacttggttgtttggtagatacttcaaggggtaactgcagtggtttcatgcattgttaggttatcaagaacactacatggacaagcatttacaaacaaagatagtccaattaggagaggaaaccctgcaaaattatagaagattattttattctcaccatattttgtacttttttattccttgaagatattaatctacattatccaacatttagtactctccatgcttagcacaatgttgacttttgtaaatatatcaattggtagctgaaataggtgaatgtactttgtaaaatgatatttaaaaaatattgctagtgattacatcctataagaacctgaatcataaaaagtatacatgttaggaaacacctttctattactcaccttgaaaaaaaacctctctataaatgcatttgcaaatactaactccacatgttacttgaaaatttaaatatgaaacatttaaaaacacaatggcaaggtagcattcctttttttttttttttttttttttttactggatttcaaatgtttcttctttatcatcaatgaacaacataggaaaacttttccatcgttaaataattggacattttcagccgggtgcggtggctcaagcctgtaataccagcactttgggaggctgaagtgggcagatcacttgaggtcaggagttcgagaccagcctggaaacatggtgaaatccagactctactaaaaatacaaaaattagctgggcgtggcggcatgcgcctgtaatcccagcttctcaggaggctgaggcaggagaatcacctgaacctggatggcggaaattgcagtgagccaagattgtgcaactgcactccagcttgggagacagagtgagactccgtctcaaaaaataaataaataaataaattaatgaattaattaataaaattgaacattttcacatcacatggcaaaatcctaacaacttttttaaagtgcagggaaacaagaattggtcctgttgaaaaagcttaagacaaacaggtgagtgtaattctgagacaacagtagtaatccctctgctggaccttgttttgagagaaggttgctgctgactttgatcgtttgacagaaacaaattgaaggttattgagacaatcatcttcccaaatgtttaagggtctgaattttcagggatatcctgtgctcactttgccccctctgttctagactctagtgtgtttaggttactttgtggatctgtacactcaggctcagccagtggtggaggataagtggagaatgggcagaactgattattctgcctttgagtaatatttgttcaccttgaaccttctggtcaatctaggagtagcatccagaaagatggtaattttaccgatttgtgttcttcattcgctttagctatctaaacattatacttatttatgtatttatcaaatacaggatgattttgtaaatttttttattgctacataatacatgggcatattttggggatacaatgggtgttcattcactctttaagtgcctttataagtctttcctctatcaggaagcctttgttgacctcgctagatcccagtgatccttccgcctcataactgtcgtagccattatttcctgtattacttatttggcacctaaaaatacgttgctatctaatgccttttactttaaattaatatttaaactttttgttatatccactttttttagttatatgttatcttctcagtgaaagggttgctgaggggcagagacagtttcttatatatctttgtgttttcacagtacaagtgcagaatagccatcaaatgattatttcttgatcagatgcatgaatgaatgaatggctttgtaagcactattcattaattctttcattaagttatcaggtactgaggatacaaacatacctgtcctcctaaagctcatattctaattggagaaagctcacatccttgtattttaatcagttgaatatgctttgcctaatgttaacagcttttttataatttgtgagaaacatactttagttttttctaataaacataagtaatgctcatttgatttttacagtttatggaacacaataatctacagccaagtcgtgattaactgaggtccagattttctagatttttcattagcactttcaactgcatcagaggataaaagtgagaagttaatttccatttacattgtaaagaattgttgaaagttgatagagagttgagaaacctagcctaattgatttatatgattctttagcatcacatgtgtgcatcatttatgcatttgattcttgaatcaattattataggtaactaagcattgtgttctacatttacagatctcactaatatgcatagagtaacatctttttctatctttattataattcccatgttttaattgtaggagccataagctccccaaaagtaaagctttgaacttttacatgttttgaagatatggagattgttatgaccagaaaatatttttaaaaaagccttatcatttcagcctattttaaaaggttctgctctgtagtttgcttactatttgcaagtactcaaccccacattagaatgcaaatgcacttttagataatacttaaatgaatgggcatggctatattgcaataaaattttatttattataaacatggaaattataatttccaggagaataatatcccaagtgtgatgggaataatattcagatttccgtttctatgtcatgtcaatatcccatgacacgtgggatatcattcttcttttgatataagaaatccatttaaaaatctaaaaattgtttttagctcaagggccatacaaaaacaagaagtgggtgggctggatacttgtttatttatttacatattttctgtggctacttttctgctactgctgcaaagttaaatctttgcagcaaagttgagtatttgtcagagagactttaatgcttgcaaagccaaaactatttactatttggctcttcaagaaaaactgtcaatccctggtgtagacaacaatatatttccatcaacaagcagtaagtagtcacatgacatgatatataaagtacaatataacacagtttttgtccaaaaggcaacaaactaacattctaacacaataatattcttgaaatcatgaatatatattttgagcaactactatgtgccaagcactattctagacattggagataccacagctcaggcatataaatggacataatctctgttctcatggagtttacattcttgaatgggagcccaataataacacacaaacatgcatacacacaataaataaatgtaatttacagacaaaataacttctacaaatattcctggcttctgagctaaactggaaatgacaaagcagtaacactaatacacttttagggttacccaacaagggttctagcagcctgctcattgaacctctagttggggttaagacttatcatgaggaaaatcttaaatcttgtcttctcagaaactgcaatacatcaaggagaaaataaaaattcaaggtcagaacacaagctcaatgcttttttttttaaaaaaaaaatagcttacactgtcaaaattgtcttaaagcaaagattgtagatagtgggacaatatagttagaaaaatttggaattttctatggagccctagagattaaaaaaaaaaaactccaaatattgttacacttgaagttagttgaggatttaaggcgttagagaaataggctgaggaactataaaaggctgacttagaaatgatgcctgaagatacagtaagtgacctgcttagagtctgacacaactgacacctgagtctcctaactctaataaaattctcaaaacaaaaaaacttcaatctaaactgcagacacctgagaggaaatcaatttatgaagctgggaaaataagacctagaaaatgcatatgactttaaataaaaatagaaagccccaatatgcgtcttcttacgtaccagcaagcaattggcttcctgatgggaacctgcatgggagaaggccagcggtcaagtacaattctgcaatctcagttatgtgacctactggacattcccaaggacatttagtaaatgctctcttgagtgtgatattccggtgctaaagctctgtcacagaatttcctagctttctattataggaattacaaaaagaaagatgaagagactataacatgtctttatgttcaaattcttcaccatattttttacatattaaatcacccttttttaagaaattgtcaaaaggacacaaatgaaaactactattgtttttaaaatagtgaagacatctcagaatataaaatttaaatcacattgctgtagagagttatgagcatggaggacttaatgtggcctttagaacatctatgaccatattagcaaatatgtttcccttttctagtagccatgttgcctcatttgagacgaactcattggaagtcacttaacagaaaaccatgaagaagaggtaataggcatttcaaatcagttgtgtaccaaatagattcctgtttactttgttctgagataaccgtctcagaaaacaaagctaggaggtttcatgttgttttagaagagagaaaaaagctacactttcttaaatgtcatgaaatagtgaattgtttcatagaattatgaaacaagcctctacaattattttgagtaggtaagatgaattatttttgacaagattgacttttaagaattgtgcacaatactattgagaaagggaaataattcaaaactcacaatgttttacatagattatatccctatgaccaatttaagtggaaatttagttagcatgtttagttagattttaattaaagttgacaatattagactgtgtatgctgtgtatgttcataatggaatctggttactcatattcttttacttcattcttctttccgatgtacattttaaattgaaatacattggaaaagtgcataaattggaactctacagcttgataaatgttcacaaaggaaacctgacccaaacccttgaagtcactacgtcccccttctagtaactagcctcatcgataagagtaaccattatgttgacttctattggtgccaatgttttaactttaaataaatagactcaaacaatattgtaacattattttgtgtctggccaactttcatacaatattatgtttgtgaaattcattcatgatgttgtctgtaactggagttcattcattcttattacagtataagtttccactgtataaatataccacaacttctttatctattctactgctgacaggtcctgttaggacccaggccacacagcaggaggtgagcagcaggagaggcagcgggccttactgtctgaactctgcctcctgtcagatcagtggctgcattagattctcataggagcgtggaacctagggatctagggtgagcactcgtcatgagcctctaatgcctctgaacaaccttcgccaagtccttggaaaaattgtaaaaattgtcttccaagaaaccggttcctggtgccaaaaaaaattggggacccttcatgtaatccacccaaagaggtcaaagaactgctaccagagagatctttacaaatgcccattgatataaatcattttccagatcaaaatattccagtgtcttaggatataattcaagcctcttagtcccatatgatgctatgaagaatatggttgctgctttccatgcaattacttcgctttatttgcagttctgtgaacagcaagggagtaaaaatcttctgcacctagagtgactttaccctgatcttttctatctgctggattctactcttcctttaaatctctattcatactttaccatctttgaaaagcctttcctgaccttcctaagtacagttaatttcatcatctgtactgcccagtgtttgaacgtaacttgaatttatctccctgtttatacattttctccctaagggactatgaagcactcgctatgctttcttcatcgtcgtgttcacaatgactagaatgagcttaaccaattgcctagcataattttattgagtgaatgaatgaatgaaatatttttttctgtaagtcctctttcttttcaaagtagtttaaacaaccaaaattttatcatggaaattatttctcctacaataagaaaaaactaaaagaaaaagaattaaaacatacatttgttctggggactggaagaggaaactcttcaatatacttgcatttttaatcctttcacagggttgaatgaaatgggaaagaacaaactgacttaagagaaagactgtataaacttttcttttactgcttgaccaagggaaacacggttttctgatcattgaaaggttatttggaaattttagcgtttggcacctttggtcagtgttaaaaggaaaggatagaaatgaggctgaacggagcttagaagaagagactacttgaagtaccttctctgagagaaaaaaaaaaaagacacagagagagagagcatcattgcttgtgtcctgacagataagagaagttattggtaagaagtggctgaggctgggtgtggtggctcacgcctctaatcccagcactttgggagactgaggtgggtggatcaattgaggtcaggagttcaagaccagcctggccaagatggcaaaaccgcatctctactaaaaatacaaaaattagccgtgcatggtggcatacgcctgtagtcccagcaactcaggaggctgcggcaggagaatcgcttgagcccaggaggtggaggttgcaatgagcagagattgcaccactgcactccagcctgggcgagagagggagactccatctcaaagaaaaaaaaaatgtcgctgagagagattagagaaaattacgcaacattttagaggcagaaagctctgagaacgagcagtaggacaaagtctcccaatagactcagggaaggctgaccacaaacacagtctgacaaaaacacaaagaaggtcaaggtgctcctcaacttagatgtaatttatacaattaggtcaaactgtaccatagtaaacattgtaggtcatgtcaaaaagagctttctggaatctttgatttcagtgacaactgcacgataaaggggcataggataaaatctcattacttctcatttccgcctctttcaagaggcttgtaatatggtttgatgccacgtctttgttaaatttacttcggttgtcaaagaggaacccgaggctgtcattgagatggtatgagagcacattgctttcatactttgtgtacaatttactttgaggcgtgatgacataatctgcactacccataggaagtaatagatacttcctacagtcagtggctccctcaactctgtgaaccctaagctgatcatatcagaattcattttcactattgtaatatctaggttaagagaggtataagagttagtgcaaaagttcaatcattcatatgaaaattttattgtttcacaatataagctagcccaattaaaatggctaacctcacttgatttgacactgtttacactgactaaaactatattcagtggtgcctatatttaaagttttgcaaatttttcacaatcacttttatggaaaagataaaacaaaactgcatttagagctattatttggatagaggggtcagcttattgatgttcaaatctgagcactgaagctacctctaagttttttgatttggaaaacagtccttgttggtagtactaactttaagttacattctgtgaacaattacataatggcagataaagataactataatttcgttttgacaattgaatttaagaagtaaattttaagttcaaattattaaattatgtgctagtgtcatttgagtagcactttaaaagtttataacagaattccatgtacattatatcacttaattctcaacaagttttcaaagaaatctttattatcttcattttatacatggtggaactaaggtttgggaagatttattgatatgctcgaggttacatgatcattaaatggactcagggctcaatctcatgtcttagaacttcaaatcttagaccacattgtttagtatgttcttgtaaggctggatttttataatttttcttggtattctcattgagtgatataagccaggaattttttaatgaataaatttatttttatatttgtcttttattttcaccaattttaagacatttttggaattttatatagattttttttttttttttgagacggagtcttgctctgttgcccaggctagagtgcagcggtccactcttagctcactgcaacctccacctcctgggttcaagcgattatcctgcctcagccacctgagtagctgggattacatgggcgtgccaccacgcctggctaatttttgtatttttagtagagacggggtttcaccatgttggttaggtttgtctcaaactcctgacctcttgatccacccgccacagcctcccaaagtgctgggattacaggtgtgagccaccacacctggcctagaatgttattatttacaagcaaactatctgttattaattcaatgcacagcaaaatctgtggcacagcaatgtgcagtattacaaagtaattgtaactctatcatttaaatcgtaaatactatatataactaaaatataagacacattttttagagggacttctaatacataatattgaaagagatttaatgttaatagtggttatctttggatgttgaaaataagggtaactttggctgggcatggtggctcatgcctgtaatcccagcactttgggaggctgaggcgggcagatctcttgaggtcaggagtttgagactaacctggccaacagggtgaaatcctgtcactactagaaatacgaaaaaaattagctgggcatggtggcgcatgcctgtaatcccaggtacttgggaggctgaggcaggagaatcgcttgaacccaaaacgtagaggttgcagtgagctgagatggcaccactgcactccagcctgggtgcagagcgagactcggtctcagggaaaaaaagaaaaaaaaaaggaaaacaagaaaataagggtaactttttcttttgtttctatacttcccagataatcattaatgattaaatattacttacagtgtgaaaaaaatacacatttttaaaaaaagtggtagcaatagtgtagcctcctcattgtcttccatgtttttaaaatatttgacaggtgtaatctctagagtactggaattcagagaaaggtcatattctaacctcctctcctccagactagtaatcacttttcatttgtcaatcaattacaccagtgggacatttggaagatgcccctccccgtcccagagtacttgggtgctcccttaagtagggcagacaggcttgttcaaaacagaagctttaatatcatcatgtcagaagttcttaaactgctttagcatattctaacaaagttctgaggtttttttactttagctaattctacagtgaaaaaatgatcccaggaaagaaccagtgcaactgagaggcacacagtagtgctacagatttttttttttttttttgagtcaaagttttgctcttgttgcccggactggagtgtagtggcacaatctcggctcactgcaacctccgcctcctgggttcaagtgattctcctgcctcagcctcccgagtagctgggattacaggtgcccgccaccacgcccagataatttttttgtatttttagtagagacagggtttcaccacgttggccaggctggtctcaaactcctaacctcaggtgatccccccacctcagcctcccaaagtgctatgattacaggcatgtaggtggtatcactacttactccacagggactagctgttgaaattgaggccaatactatgcatacagcaatggacagagctctgttcttttccttgaggagactgtgtgaagattatgctaccagttttataaaagcaagtatttaaatttcctctgaaataggatattttaaatctgactaggctcattaaaaatattagataatcctattgtatattcaagtacatattcctgaaaacaatgaatcccaagtggaattttatttttgcacatgtaatcttcactagagcttaaattcttttaggacaggtccatatgttacatacttttgcacccacgccttttcctcaagcaccagtagggattcaaaattaatagctaaattagatgaacaaaattccactataacatcatgagacagtctttcattgcaaatagttgtaattttactatgagacaaagagtagttcctgatacttgataaattgtgccatttgtaaaccccccaacacacatacacacactcacacatatccattcatgattgccattaatctccttttattttatttttgagcatcgaattggagggtttaatctcatatccttagattttcctagtgcagagatgcaaaggtcatcctcaatgatatcactacacattacatttgacagaatatcttaggggttttcttttgctttcacttttaacaagttttcttgttaaagtagtaatctacattgctacaagatttgaaaatgatttctgacttttacaactaaagtgttgaaatttctcatttaatgttctagatacagcaggggcttcaacgggtcaagataaaaggattgtttctagacatgcttagagtgagaaaagattatgtgaagaaagaattcactggaaaaaatatggacttgagtaatcattaaatccatgtccttttctcaaagccaaataaggttcctactgtctccttgatagtgatttggaagcctgtttgggttgacatttcccttattcatttttccttaccataaggttttgctaacatttccaaatacctatgaaattgtgagatttcacagaaataaaagtagttattaatgaagaaaaatttcagccaattcacttaaaatgactaagaaagtgcattaaaagtacagtaattgcaaacaaagaaacaaaaaaaaaccaaaaaaaaaacacaacagataacagtgccacctccaacaacaatgtaacatgtcctaacaacttttataaaaatacatataacagatttatttcagtagcataaacacagaaatagtcctttgacttccaagaagatgaaataatacataggtcatgaatacataagttttatttctatgaccaaaagtatttcactactccaagaagtatttatgaggcaaattactggaagactatggaattaaatttggttttatatagcatctttcatgctccaagcgtctcaatagctttttgaaagtacagaaatgcagtgacagttgaaaactgaagaagctattatacttttaagggcagatgatgtaggtttgaattcagagacgtgttttatggattcagggagcaggatattcttcaactaatcttctacaagttctgtgtcatctttatgttctacctgagttgcaaccaagggcatgcagtggggtcttagtgaaatagctcttttaattatataataaactgtccctggcttgcagggacagggttgcaatattaggtaagctttggatatagcatttgaaactctcaaataccttgtcctgtgataagtaagccataatactcaacatagcatgtttagtgtaaaatgtcattcaatgcccaagatataaataatcttgcatttagtttcataggaaaacaacaacgattagtccaattttttatgccaagacgggcgagaaatagaaaaaccagaaacaaatcagcttatcattgatagaattacaatttttaccagtctggagaaagacctgaaataatgccagcagctttttcaataagatgtagggaaaagaaatacaagcaagtgctattgccctcgatgatattttatactgcagaattgtttgtaactggaaaatattgtttgtgtcagagagaaactcccagggaaatgaaaagctaataaggatcagcatgaactctggaatggttctgagcagattgttcactgatggggaacagtactaaatggagaaagccctacactcagtagtcaaaagattagaaatcagaattctatacaaaagaaataacctctgcccttttcctttactctaaactgagccacaattatgctgcaaatgttagttttttacccacaaacactggtgtctaactgtcccagtggttttacatttttcttctcttcagccataattcatgagctcactttcttatttttgaacttaaatctttttcctagacttaatgtcttcatttctcaagaatattcccagtattaatttattctccacccaccttaacagcaactctctgttcattggcatcaagtgacaatttaaattactcttagtttttgctaacttgaagcatttcctgtgaatttttgttttcaagaaatttttactagagtggattttctgcttttctcctttttagagcttatggtgactttgtctattgtcattagttctggatccaacttttttttttctatttaatttaattctttgtcccattacttgatggaaagattcttggatgtcaataatatctcccacatagatacttatcaaagcaattacctctactgtgacatttttttttcatcttctgacatccaatcatgacatttctttgaaatgcttcttaatttgcttctgagacaaggataatttacaatttatccaaatatccaggtttccttgtggttttaaaaaaatttaccttccactcttacaatgtggatccccatatcctgagttgggtagaaaacactcaagtggaagcatgagaaatggaaagagtataacattttggaccagaaggtccagcttcaggttttggctccatcacttactaattatgtaagcttgaacagatcactcctttctcttgccttgcttagaaaatgactcacaagatgtgcctacctataccacagattgggggataaaatgtaataacaaatgcaaaaagtctttataaactactatagtggacactgaaggttttatcttgcctaggatctttccttaggacaccattttttcccactcataacttgtgggatggccctatccttctccagccctaacctgggggttggcatactccacaggcttggccaggcagatcccacggcgatcactttagggatgggcacagatgtaagtgagcagtaggagtatctacaaaggacttacattttgaatactaattggaaatgattcattgagtccaattacagcattctgaagatgccatccattattttcctctacttagtctccaagaaccagttcttgtacaaatatgtcaatattttctacaattccaggagaaactcagtatttaactcaaaataccaatagtgctgagattaaaaaaccctgcccttgagcctaatatattattcggtacataatacctaccctcccttactcctaagtctctgaataagtattaattgaatgactgaatgactgaatgaatgaatgtaggtgatcagatgaaagtctaatatcattaagcagcttgttcaagttcatcctgtaagctttaagcaaaggtggcacttgaattaagatcttttgactggccaggcacagtggctcacgcctgtaatctcggcactttgggaggatgaggcaggcagatcacaaggtcaggagatcgagaccatcctggccaacatgataaaacaccgtctctactaaaatacaaaaaatcagctgggcgtggtggcacgcacctttagtcccagctactcaggagactgaggcaggggaatcgcttgaacccaggaggcggaggttgcagtgagctgagatcacaccactgcactccagcctggccatcgagcaagactctgtctcaaaaaaaaatcttttgagtatcaggctgttacttttatctgcactttattacatttttatgtctccaagttaaaattcttaatttatgatttatcactgtctaattatatacttgttttcctgtctcctttccatcttctgtgactcataagcccaaagacataagacttcagtttacagtgtatgtttcactgcaatatcatgtgttgctccttagatatgccagttggttcagaatttccaaaatatacagataatcgtaacatgcactttttcaacaaagtcatgcaactgtaattatttctaaatatatgggaataaaaatgatatagagctatataaccaaaatttcaaactatagttaaattagatgacttccaagatttctttaaggtttaaaaatatagttaagtacttgcttaggtacaacaaagagatatgtatgttgagactttaagcaaagaagcactctgaaaaacctggtccacagaagggaataattgctaagttacagtaagggcactttaaaaaatttttttatgtatttatttatttgtttatttctgtagtgatggggtatcactgtattgaccaggctggtctcaaactcctggtctcaagcaattctcttgcctcaacctctcaaactgctaggattgcaacaatgaaccatcacacctggcctcagtaagggtactttcactagaatgaaggatttatcctactgctgtgtccctctttattcatagcactggtagaaagcacattatccagataacaacgcattcccaggtctgctcagactgtaagggtcctgactattttgaaaggcaggtaaatgtactttaatcatttttttcttccccgcaatggctggctcatggccagtcatcatgacatacttgtaggagagttcttatgttgtaattacaccaacttctatggaaagttcagacgcaaagaaaattcaaaaaattccactaatttctcataagacagacataaatcagtacaattagcaccaatggacatgtttttacaattttgccatgtatcgctatacagctaagtcaatttctttttttgatattttctgcacatttctatgcctgcttttccacagttttaaaaatgtttttattctggcatgctggtaatttgagtccagttgggtgaaatgggatgaagaactaacttgtctcagtttgcctgggactttactagctttagtcttgaatgtatcctgttctgggaaggtggttgttgtttactctttgttgcttccgggattggtgtctgtggaaatattattatcttcctctggcttctgagagtcctcacatctcttccttcctttttctctcttcatcaatcagccactgggtcctgggattcttcattcacaaggcatctcacttctaccctttgtctaccacattctccaccccaccccaccagtgattccactctcatgtggtctaaatcctcctccgttctccccactacctggctgccagaataatattcataatgtaccacttcatcttgtcaatcccctgcttaagggctttcaatgatgctttactgcctaaaaggtaaagctaagatccaaagaaaattatcaagcttctacttcaattttcaatattttccctcagctctgtcctacatgaactctgtcacaaagatagatctgcccatgacacccaaacccacttttaattctttcagtcattcatcgcatgtttgttatccttgtatgattcagggattatgcaaggtcctaggaaaaagaggaaacaagagagacagcatctctgttcttatacagattactgtttagcaagttttttattgcgaattcagcgaggacattaacatttttatatgtaaatacttggacctgactttttataaataatttcttttagttcttacagcaacaatgtgaaataagacctattattagttttcctttttctttttcttttcttttttttgagacggagtcttgctctgtcgcccaggctggagtgcagtggatctcggctcactgcaagctccgcctcctgggttcatgccattctcctgcctcagcctcctgagtagctgggattacaggcacccgccaccacgcccagctaatttttttgtatttttagtagagacggggtttcactgtgttagccaggatggtcttgatctcgtgacctcgtgatccgcccaccttggcctcccaaagtgctgggattacaggcgtgagccaccacgcctggccagttttcctattttataagaaaggtaaggctcaaagaagttatgtctctaaaaaaatcacacagatatacaagtcttttatcctagatctatttaactgcaaagtttgagtccttttccttgtaccacattgctactctgaagagctcatttattcattccaagataatgtgaatctcttagctaggctgaatgcaaattccattgctccatcaaggtgtagcctaagacctgactctcagtaagttattgcttactgccattatattctctaaatgttctaaattaccataaactcttattatacataccattcctttgtcattagattaaacattgtcctgttttaacctactgtgtgtttgtgctttgcaaactcacatcacttgtaggctctttgataactagcagaaggctgcagatttaacagtaacctatgtagtgcccactatagttatacttttcacatagcaggtcctaattaaatatttatttttgaatgtcaagttgcattctatttctgtataatttcatttagattgtctctttgctggtcaattttgatatggctttgatcataccagtaatccataagcatcttggaggttgggattccatctctattaactttgtgagtccagttcctttcacagtgtctggcatatatggcacataatacatatccattaagtggatgaatgactgaattaaggaatctgacttcttcatggtaacacaggacatatatttctagatccttctctgaatgttaatcaaatacatctttgacatatatttatattgaacacagcacttggtcatttgttagctaaatgactttaactttttctttatcagctttcatgcctcagtatttcttagtttccatcagttccatgtgtctctgacaaagttatctcccctctgcctctttgatcatgtcaccccattcctcaaaaccttccctgatacacaaatcaaaccaagttccagagtttgagcttcaagttctttatcagttctggccattaaataaataaataaaataataaaataaaataaaattcttgtctcatttattgctttccattgctttaaacatctttctttaagtaaaaattaagttctcccctaccatcttttagtcgatattttggaaaatactattccaacttggggacgacttttcttccaataacagctaacttaactttaaaagaacagctttaagattttctcttccataaagtcttctctaatactcttctaaggaaaaagaaaaaaacaaagtctccctatagattccaagataatgtctcaaatggttcactaatctgagatgagagtgatctcatactttaatttttgttttctccactaatatgaggcttcctgattaaagtttatagttctaagtatgtcacttccacacttaatagactttgaagactttctgctgcccatcaacttgggctggcatttaaatcccctgatgatctagtcctaacttattctttatgtcttacctgccatgccgttatccatgcaaactttcctttgtacccatttaagcttttttttacctttatctctttgctcttactaatccctctgcctacaatggcctccttgtcccatgtcagtaagttcaaatcctgcccatccactaacatccatgctaaaggccgtaactgtgtcctgtcagaacactcaatctgaacatccaaatgatttctttgcacaatttattactttctgcattgtatacttatgcatgaggccatgcctacctgcctccgtgcctagaattcctttagttccttcccatagtgatttccttatcctttgaatattagctcaatcataacttcctcagaatccttctaagaatacccaaatgggtcaaatatcagtactattgacaatcacagtaccatgtatttattcatggtacttgtcacagttgcaatttatgttcatttgtatgattacttcattaatgtctgcttctacttccatatcttttagtgctataaaagtcagcaccatatattttctgtcccttcaaagtacatattactaagtaagcacagaattggtattatagtagataactaatgttagttgaataaatgaatgaacaacacatatttcaggttggaaatttttttctcaaaaaattacatatcgtgaactgtgaattgatcaataccaatagcatttctgtggtgggatagtgttgttgacatcggtccaagtacaagctctgcagtcagactagactgcttcagttgtttcagacattgtttctgtgatatggacgacagggcctgagttaaggtaaggcaaacaagtcacctagggccagggcacaaaatttaagtaggttcttactcacagctctgcaagtgactcccatcttacattttgtaccctaggcagctacgtttcttcaccttggtcttcaagccctgatgggcaattttcttaatctctgtaagccttgctcttctcaattataaaacaaggatcttaaaaactgcatctatcttgtaagattgttttgaatattatatcagataatatgatacttagtgtatcttgtgtaaagggcttctcaataagtattagatattttactcactgtcatcgagcctatgatagggtcctgaggtaatgaactctcaggtaggtttagatggtgtgataaagcagggaaaattttgaagttatctggagaaagatgtcagaaggcactccatagttggaagaaatatatatggacaccaggtacaagacaaagaggagaaaatgccagaaacaaattaatgcttttgcctactttgcaatttgcctgggcctgaacaaaatatattaacgataaaaataaagtggaagggtttttgtttttcttttagctccagttatatacttcaaaaaaaaaacttatcccacatcattgccaaataatttatttttaagcttgctggtctctgaaaataaaatatatctgtcttgtgtttgtcatgtatggtgaactttctactcagggcttacttgtcttctttattattgaaaaactgttgttttattttcaatcaatgggtgttcatccagtgtcacctatttacaatatcaattataaaactctttaatggctaataaacatgattgtcttgttattctcaataaagggaagctgttccaagtctttggccaaattaacaaaaatatcatgaaaattttttgccaatctatgatgtcacagaagttttctttttaaaacatcatacattatcctaatgcatactttttataataatacagatcacttctaaatgattgtctttaagatttgcataattagctaaattaacaccctgaatttggtcatgattgccaaatttgaaggtcttactttcattttcattgaagaagtttgaactcatttattctctttataaagcctgaatgcataatcagtttccaatttgaataagcaaactggccgacaaaattttgcaaattactctaataagttctcttggtatttcccacagaaggctgaacaaatgttgacagaggaacacactgtttgcttatgtctaatcttcccatctgacttatataaatgtcacaaatgaatctcagacatgtgcccaatatcaaatatccatacgatggccctggaaagaggcaatctacatttatggctgatgagaagatggatttttagcttgaaagaaacttattactggggagaggaagtataaatgaatggagagagctatgaagaggttgagagaatacagccaaggtcattttctctttaaatgctgtgaagtaggcattgttataaaggctttgcataactcttatgtaatcttcacaggccccttagtccatgaggaaatgggatcttaaagtggtcagtcaacagctcaagttgccacagtggcagaacaactggcagagtgggattcgaaccctgctctgttatccctgaaattttgattctaattactaaatcatacatgtatttagataaattaatttattaaccattattcttttaaactaggtgttataaaactattagcactgttagagtagtagataattgcatctaaaattttaaataaaatcctcttataagtaaaatcaatgatggaatctaatgcactgagggggaaatagtgtgaaacctctaattgttcctgaagtgggaatggcctaaatttgttagagatgccttttattcttctctgtcaggatagagcaactcttttaagatcaagtaaagattttaaagctggtatttgggaaattcaacagacccttttagaagaagagccctttcatgatagcatgccaggtagagggcaatggagatgcaaagaggaaaatcaagcactaataggtgttctcaaggtagttcccttttgtagtgcaaagcaggccttagaaagcaggaccttgcccagcaggatgaccccctaccagcctggtgactgtgagcatcaggccaatcatagaagaagatacttcaaatgattttaccttgggagtggagggagagaagcttttgtactaaaagccagtgattacactgggagagcagttagaggagccattaagatgtgttgaaaacaataaccccaacaatttctttataagagaatataaaggccactgaaaaataatcttttagatgcagcttcttaaaaacaatcagtcaatcaagtgataaacatgttttggtaccaaatttcatttattattgtgtttctcaaaaggaataattaattagtattggcaaaattaagaagacttagaaagatatgttatggatgtaagtgtgcatagttttgtgtttatagttacatttgataatacgtaactgtacaagaaaatcagaggggaaaggaatagtaagaaaatcggatgaagctagctgtgggtatgctgtaagaacctgggtatttcttttgttcttttactggatcatgcatttactcagcaaatatttatagaatgctacttaggtacatggcactcctctaggcactggggtagtttgggttggttgaacaaagaagagacaaatgtctgttttcatgtaaattacagcacaggttggatgcgagagagcagtaaacataatacttaagtaaattatatacattttatgtaaaagggtgacaaaagctattgggcaaaattattcagtaaaaaggagactgggaaatgcagggaaggggtggaacatttttaaatagggtactgttttgttcattagggagataactacattcttgttcgtcttccaggcacatgacagaattgctctgttgaagttttgcaaggtcaaatgactcactttgtctaatggaacgggaacgaacaatttttttgtgtcacgtttgaacagatacctttgagaagtttatgattctccaagttctctttctcctactgtggcacctactgacaagataaatgtgtagaggttcctgagtctaggggtaaggaaacaagaagcagtgccctgtgcaaccctgatgtaatgtgagcaagaaatgcaaacctgaaaattctgttactgtactattagtgcccatcctgataagtatagaaggtcatagtcaattttaaatagttgctaaaattgtgctgccaatttgtttcttaggctgtagtgaacaagtttcctaggacactgtcttatgcatttcttattgtgagatattgaaagcaaattcatagttcaaaaacaaagcaagtctacatggggacaaaatgatgcagctacatattttgtacaaagctctgtgctagactcttgtcttaaacttctaggaatttacaatctaattagagagaaaggaccccaaatgatactaaaataaataaataaatggagcttatgccagatgaattgtatcgtcaggaatccagagacaaattgatttctcagaactggggcatttcttcatggaaaaggttggagttagactcatctctttcctgggatgctgctgttactttaatatcccagttggatttagtgacatctgcaaaggctccatgtagttaataagattaaaatcaagttttagtcttctgtcaacagcttgctatctagcctcttcattaaggaaagggggaaaaaagtatctgaagtcaaagttgactcagtgttgtatcatcaagtcagggatgcaaaagtgccacatgttgctaggcatgagtaaactgattttaaatattcctcacaatgaataagagaatacggcaaatctgttggatgaggaaagactgcaatggcttttagttgtcattagtaccatggtaagtttaaaagagaaagtaaagtgaactgaaagtaaagataactagagaacatccatcaaatgacagttatgagaaagataaagagaagcaacaaacaatatctaatctaattatagctttatccacatgaataccgttccattttgttttaattttgccaaaaaagctaaagtaataatttaaaaatacctgttaaaaaatggaaaatgaaagattgagtttttattacagattatcctatcctcccaagaatgcagttctgtcgcaaaatttggccatacaaaacctagatgtatatcaattaaagaggtttccccaccataaagcacggaaaatgaggaggacctgtgagccaactcatctgggaaaatatgctttccataattaaatataacatgctgcctcacccctgtgtatgttcttgactagacagagcaattcacacggtgaactgcagcgtcttggtgttgaaggaagtctacacagtggagtcgaatataataacaaactgaaaccttaattagttgaagtaacaaaggcagtggtacacagttatgcaagcgtagagtttggctgttcatttcttcttaagagaatctacatcagttatcttcagaaacgtattaaagattccaggtagagaatagcattgaaatccttcactggatttcttctggaagtctaggatcattctgaggatgcttggatgccatttcagacttttcagaatttataccatttatttcattagatatttcaaattcctgcaccttctgcagtgttaatagaattatagtatacagaatggaaaacaacaattaaaaattagagtttcagtgagaacaacagagataaaaacagcagagtcaggtatttattgagttttactctgtgccagccactacgctagatgctgaagatatagcagtgaatatgacagtctctgccttgatggagcttgcagttttttctgagtggctgctaacttgattctaagttatctccttaattatttcagtatctgagtggtgttgcaatctgcagacaacttgttctttgtccttgtcactatggaaatagttataatcggatactgtatctacccctagtcttctgtaattcattttaacaatgtgcacacatgttgatttggagaaaaagaataacaatcttttgaaaaaatggtgatcctagggctacgaccttttaaaaacttgggtctccatgaacccattaagttggatacaagactcaacttagtataatagacctttttcactcctgttattactagtaccttaaagtctagctttcttactggagtgatgtttggagagagaaagctgcatcacttggtgagtaaactgaaattatataataaatagaatatgcacaaaatggggatgcattgaaggactctgatcatactaatggcatgattgtagctgtactttaggaagatgaatggattagagtagaaaaaaggagaaataccagttagaaaattattatcttggttcatatgacaaataataagtccttggattagagtatatatataaaggatattaggaaaaatgattatggccagtttttaccaaattaatgttagagatgagcattttatgtattctctaatggttaatagtaaactctttggagattgacagacccatgctctatttctgattcctccatttcctagatgtgtgaccacttaaattatttgaatagcagccccctcacctgcaaaatggtgataataatacgcaagtaacacaggcactgaacagaaatatgataatttgtgtgagagagtttatggtgcctggcacacattatgtaggcactaaatgatagcccttagtaaaagaagtaatagtgttgtagcaatattctaaaatgctatattcctaggtataatcaatatccaggacttgaagaatgtgtttagtatatttcattcattcattcggtaaatatttactttctgtatgtcctccttgctggaggccctggacaggcatttacttaacaaaacactcccaaatccctgacctcttgaaatgtatgtgctagtgggagcagatagtttataaaccacgggtataataaataattaaaatatgtggcatgttagaatatgatatgcactatgaaaacaatagagctggggaatggtgatcgagagtactgggaagtgcagcctatatacatgcctggtcagagtaggcctcgttgagaagtcatgattgacaaaaatgaggaaaagagtcatgtggtatttggataaagaatgctgcaagcagagagagtgtgaagcactgaggtggagcatgtttggcttataaccaaggcagtaaggaggctggtgtacatggaggagagtaagcaagggttttgaaaaagggttgcagataagtcttggagatgcagcatgggtagaaacccacaggggtccacggaccataatttcaactgttgatcttgtttaataaaactggatgagagcagagcttaaatccagctctgcagagtggtctaaagattcagagagcatttcacagaagattgtcaactctgtagtataaattgtgggctaaccttaagccggttcttacacagatctggaaagctttctcataattttaatggatttttgtttatgtcatggccagaagatttagcctctgtccattgtcaacatttatgtagcaatgttaaaaacatattcacatacattataaagttaaatgaatgaaaaataaaacaaaattggcctatgttttctcagaagtcatgcattttggctcaaagctgaaggttggattattttgtgaggttagtcagtaagttaaatttagaactagaattttgtgaatgaatcccaaggctgtgttggaagtcttgaagatgtgagagaaatgtgcctgaagtctattcatttgctaaagtagatgtcattgcaaggaaatgaaaaacaaagaaaaaatgaatccccagaaattatgtaatctgcgttatacatgttatctatcatttgtgcttgtatttcaaagtcaaatttcaataatgctttagtaacaatatactaaaggattccttcatttttcagtgtcatacttttttaaaaagaggtttttaatatgagaggaaattttaactagtgaactaattattttaatttgatataatttttctcatttgcatttttgacaattatttatgactattgataattagaggttgtatgtctttcagaatactgtaaacagcagcatagacattagctgaatcattaatttcaactgaggatgaaacattttatacttttgaccttttataaaatattcttctatttgaagcaaattgcttgtcaaaatcatagctatttgcccaattggtatctggcatcgcaaatgagctcttgacttatatatagcacatttaaattctaagtatttggtggtaaccattgaaaatcatcctcataaatcaaacttcattggctttgtatattttaaatggagtcatagagcacattgtaaataataaattgttattacattctagtgaaaaatcctgtgcttttcagcatgcttaattattacatcttttaccatagctaaaggtggaaaacttactttattctccaaagacaagacaataaaatagaggcagataaaagtagattcaaattattcaaaataatattatacaaatataatattaacaacttaaaatgatccaacagtaccgtttgccttttccttaaaccaaatttaatgtctttggggaaagaaatggtatatatatttagatgattattttgatgtttcattggtccttttgatttagtttgttagtttagtcagtagtgctgtgagctgtgtctaactctaactattaatgaattttcttattcataggtgagtcttgcatatctgatgaatccaccagtaaaagtaccactgctgaaatcacgcaaatatatttttttagaccttatcaaccttggcatggaattagatgagcaaaaagctgagttgaattgatgaaaagaatcccaagtcattaattactaatgatggagcttgtaaagtacagcatcactggggaaagcaactgactttcctcatacacattatatttttatctgaatttcaatactgcttaaatatgtacttcattacagggcacaactaaaatagaagggcacctgctaagtcagagccataaaacagatctacagcctgctggcatgtgaaatttctctaatttatattttttatgaaactaccctcacattatgtggttggcagcataaataataaagcatgttactgaagcaattttacatttactgtattagtaagtaaatgcaatggccactcttattctcaaataaaaactacccagccttttcatgaaagatgtttgcaatttccattggcctgtatatgcaataaaaagccataactcatcaaaatttcagctattttctcttaagatagaagagcattttgcttgaacattgaacgtgatattaaatattcaagaaactgaatagagtttaagtactaagtaaaactctcaaattcttttcaactagattgaaaatctgtttgaaccaggtaaaaactgccgctaacctgaagaggtgttcaaaaacatcgtaaagaggttgtacaatatgttcaaagtgctatagttatttgggattgatttttctgaaaagcttgttcctcctttgaaattgattcatgataacagcctccatttgggtcaaacagtatttaaccgcttgtaaattttaattaaatgatttgtcactttgaacacatagtttgtcatcttgcaactaaacgatgtgtctttatcagaaaattactcagagggaaggcatttatctaatttgtcacttggacacccattaagataatttggttgttgcatagggataaaattgaaatttgtaaaatagagcgcaccacttttagtaagcaggatcacattgtaaactattaaaaaaacataatttgctctgtaattaaattctaataaggactttacttctggtcatttttcattaacagatgtttaactttttgagaaaagaaaatcttccagctgaatttagtatctacaggaaaatagggggctgcaaatgaaaagcaataagctgaattaggattatcttggggaaaaagccctttcatcagaagcacttatatcatctcagacccagctgagaccttgtctgcagcctggttaataccatcagagatagcttgggacagagtgaaagggacaacttatgaattactgaggaaatagcagagatcatagatctttctctaaagaagggtatatctggtgaaaatgtagatattaaaatacattaatttttgtgtccccaaattattaaaaaggtagtatgtctctgagaggcttaagtcaagcatgctaagttaattcagtaatcactgtatacaaaagtagagttgatctttttccacactgaaatagtggtgactatcctttgttaatataacccaacaaagagcagatatgttaaccaaaattacaaaatatggacacatgtaattttatttttaaactgaaaagtaaagtctttttagtcttcctactctcagatagtcctgaaaggcttggccatatcaaatgtttgtgtgaaataaagggactgtggtccttattggtcatatcttttttccaaccaaggtctaagtttcttgaagtcaagggccaaacattagatgttagtgttcttctgtagggtctatatactcagaatgcatcagcatcacctgggcagctttcgaagcattctgaggcccagaccctatctttttttttcctactatcgaagttatttattttttgcatgtttattacagatactgacttcacaaaatgcaaccctttgtatgtgttttaggtactttgtagcttaaggagtggtcattgataatatgcctctcgatgttgatgttttatgtgaatgacatgaaacgctattaggctaggacattcctaaaagagttttcataaaacactaatataaacaaagaaaatttagcatcctccttctttaatgatatttatgaattatatacctgtttttagagagaatgtaacttaaggatatatctcttcaatgtatgttcagacttcatatgactactgctacagagagagtttttgagagatgagtgcttttactgcctgatccttgtcaattttatgtgcaggttcaactgttgtgtagtagggccaggccttggtatttttgcattctattttgcagccagggttaagaagcattgaactaacacaggcagtgttcaaacaatgtgtaacaaaaggtgcaaatgtcatacaagttgcgagaaggatctgcttctgttagaagaaccagctatagtcattcagatttaaaattcaacatcctgaatttctttctaactgatatactttaactttccctcacgctaccactaccaacccacccagctgtttatttttctttgatttcccttttgcttctctcctcattttgtttaacatattcaggcacatttactaattgctattgctaacaacttcccagctaatgctgttttctgtctatcaggtatctttttattccattcataaatgctggaaaaatctttataaaacacaattctcatcaagttatattcctgctcaagaatcaattcctacacagcttactagctatattaatgtgatattactattccattgtctttattaacgtaagaagactcttgcacaataaataaattaaatatattgttcattacaggaacacatcagctcttcagtaaaacatcaatggtttatgtcctaagactttttgaactcctcatctcgaaatcctcaaaatattctcttgctatgttcaccaatcttaaattattatattgtgattcttaactaattctaaccaagtcccacatttaaagatgcaccttggctcacgcctgtaatcccagcactttgagaggccttggcggccagatcacctgaggttgggagttcaaaactagcctggccgacatggtgaaaccccatctctactaaaaatacaaaaatcagccaggtgtggtaacacctgcctgtagtcccagttactcaggaggctgaggccagagaatcatttgaacccaggaagcagaagatgcagtaagccacaggactccagcctgggcgacagagtgagactctgtctaaaacaaaacaaaacaaaacaacaacaacaaaaaaaaagacgtacttttaatcaaatgttaggtgctcaataaaatctgaccttaacttccctgcccaaaacaataccaaatcagttaaggcagtctcctatgttacccagaaaagccacagactcagcactgtcttgatcaacagattgtgtcagtgacgtttgaggagccagtattccacagtcccttcttcacaacagaacaacgtcccggtattccttctcagtctggcattcctgaccttccagaggctgaacccagctgtctttcttatcttattctctattcttcccttttacctcccctgtgttccagactttctgggcaaacttctaatctctgcagtcatcaaaagtcttctgatcacatgttgttctctcatactgaaatcccctttcagtttagttttcactagaaccaacatttatgggaaatatacaactaaacatttgagattggatgatctctacgatctctttgagtctttttactttaagatctatcattgagtctgtacaggcagtgatagaaatagtaagagatggaagggatattggctaacataatggaacggtattgattgaaatagaaatatgtctactacaaaattgtctgactggctatcattttttcctaatttggagatatttacaaacttgaattttcacttgtacctttcttccactatttattgataggcctgcctaaatacagccttactgaaatctcgatatatgaactttttgattctccaccctccaggatcatgattttggtgtaaaagatgaaattcaattgggctactgggacttgtgtctcataaagacatattgattttttcttagtactccaagatattttagggacttgaaaattggaagcaacttgatttatctacagctccattatctttccaggcactggaaccagctgactgatctatggaagttcccttggtctccatttgtttagaaaaggtgatgcatcagaaacctttccttacactgtatgatagatgggtggtgggaaacaaaatctacttttgctccattctgatacatgagaagagagtatgtttatattctctcagtgagaattcagacccaggtatcacttagacttccattcaataaagtaaaaagaaattataaaacataaataggcagaaataaaattaaaagtatacatataaaatattatataaaacgtaaatatacaataattggatgttctaacactgaaaaattaaaagattaaagatgggataaagttaactatgaaacaatgggacagaaaaaagtgaaccatgagagaaattcagagcgaaagtgataaaataattttaaaaatgtatgtatctgaatatatgtgtagttaagaaaaacagagggtagttttaaaggctttagcacttgtctaaaagaaatttcaccagaagaaaatggaataacaggaaagtaatacctgataagataacagttgagactttcccagaattaaacatataagtactaagattgaaagtgcacattcaataccagtcagaataaatgaaattaaatacttacatattttataacattgtaatgaacttgcaaagaagtataagaagaagatcttaaaagctaacagaaatagggcatggattacctaaaagggaacaacaattagaatgacagcaaatttctcattagcaactagtggatgtcagaagataatgaaattatagcttcaaagtactgagggaaaaatcaaccagtgaacctgtcaacccagaattctacatatcataaaacaactgggagtaaaagagttaacactatacctgcaacttgatcttttttatggaggccatccagggaaaatgaatgaccctcggtgtacttccttataaccatgccaaagaccttcaacagacctctatgcagtataaaaatagtatttactacagatagggagtttttattgagaacatatattttgtaggatatatttgttgtaactagatttcttattttcaatgaacctggaccttatggatgtacggggcatggctttttggagaatggggagcagtgggtggtagtcatcaaaatattcccttatccctgtaattataagagtataaaacaaaagagctccaaattcctaatggcttcctttgtgactagtgtgcatatattgcttaatactattctgtgtgtcagaaatgaaaacacatccgaaagtaagaaaaaaaaattttggaagctgcatttggtctttagttcctgctggaaatagatgtcttgcctgagcctgctgcttgcctgtaccttttgaatcattaataaagtttggcactgggtaagatctataatgtgcagaagtgctctttgactgttcaacccattgggttaacacaactatcattcaaaaatcctggacaaatttccaggcatacctagggtaagaaagtttgtcacccacagacttgcactgaaagaaactaaaaatatttattaacagaaagaaaagtgaacccagagggaaggtgaaagaaacaatggagaacacagaaagtggtttattttcataaagttaattaaccatggaataaataaagaaaacaggaaaatgtgtgtgtgtgtgtgtgtgtgtgtgtgattaaaacggcaaaatataaatttaaaacagcatgaggaagactgtgtctatgtgtgacaatgagagaagaaattgttcagggccaggaggggtggctcacgcctgtaataccagcacttttgggaggtcgaggtgggtggatcatttgaggtcaggagttcgagatgagcctggccaacatggcaaaaccccatctctactaacaatacacacacacacacacacacacacacacacacacacacacacaattagccaggcgtggtggcaggtgcctataatcccagctacttgggaggctgaggcaggaaaattgcttgaatatggtaggcagaggttgcagtgagccaaattgtaccattgtaccattgcactcaagcctgggtggtggagcgagactctatctcaaaaaaaaaaaaaaaaaaaaacaaaaaaacaaaaccagaataaataaaccatactaggttttccatcttgcttgggaagaggttactgaatatacttatttaaactttgttagaaatatttgtagttaacattgcatgctcaaacgtaagataaaccactaaaagaacagaaatatgaaatctatagcttccacattaacagagaaaatatttgaaattaaaagttaggaattcaacaagggtcaggtaagaaataaacagaaaagaacatgtaaaatttaaaaacacagcatctatcttaaaatacatattctttatgggtacatataaacatggttagaaaaaatacaacctaaattcaggatgggagggtgtaggagactaggataatggggacttaaactctactagaaaaagagactggaagcaaataatagcaaacattaacattcattaagcctgattggtgcagatatgcattttactatattattcatgggcttctctgaataattgaataatatgctttttaaaaaatgaaagtatattattttccatatatggctattgagtatttgaaaaatgtgatttaaaccccattgaataataggcacttcttcaaataagttaaaaggatatttgcaaaatattcaaagtttatgtcacaaaagatatctcttccaaataagaaggaaatataaagaattagttatgttaatctgagatttttgtgataataaaacatacttgatatatttgtacgctaacaatatgtaactgtaatttttttcatgtgtgcaataaatgttattaataatattttcccatttaaaatttggtcaaaattatagaagttaaaacaacaacaaaagccatagccacaattttagcatatctgagtacagtgttcatttaaaagatttagaagtaggatgagagatttcacacatatttgcttaagccagaataaaacattcctaagaaggtcgttaggaaaaaacattattctttattggattaaggaactaatctcagcttaaaatttaggtcaattaacagcttatattccttctttctctctggcaaaaatttattatctaacttacttaatttatattctaataatttaatgctaaattttattctcatttttttctagagactataatatcttcaataattatttatttcattgatgttcacttgtataaagcatttagccttgatacacaaaacttaacttagactcctatcatagtaacatgtgtttggagtttataaacttgatttatcttttgagaattctgcctagagattgtggtaagatggttttctgatgtgggttttttcttccttctacatttttctttaaagaacacttaaatactcttaatatgtgtcattttttaaaaataaaattaatctcatcaatctttcctgatatcaacctggtttatctaaagaaaatatgagttatctgatcatattataactaaacagcaggaaagaaagaatttgaagaccccactgaagctttaaaagattgtagaattatttcttgacttgcatctttcctttctaccttcaactgtcatttttgacaacaaaaattaaaatcaataaaataagcaatatatgactattcacattttatctggtgtgtaaataatgtaaccttttccaaagagaggtctggcctttgaccttggcttctgggaggtaatcttgaagtcctggagtgtgatgcttaataagataatctttgtttgcctgggggccttaggccagccagatagtaacgtgtggggtaggagctttaagccacaacaaccatgtgatttaggctgtgggcttcaagtcacagggtatcagctggacctcctgagggtctgaaaacagatcagccatttaggtgaccaactgtgtctacatgatggagcctcaataaaggctgtggacactgaggttcgggagagcttccctcatctggcaatactccaagaatgttgttacatattaatactgggactacatgttatatattaatactgggaccactatgtagacaatggaagctccatgtttgcaactttcctggactctgcccatcttcttttggctgattttaatgtgtactgtttagctgcaataaagcataaccaggagtacaacagatttcaatttctgtgagtccttctagcaaattgccaaaactgaagatggctttgggaacatccaaagttataccaggtaaaataaaaatattaaggcatgcaattataagtttatatttcttaccatagcttgtctacaaaggaaaagtattgttgattatacacttaatatgtacatggagaagaatattgtcaacaaatcaattttaattctaatcaagtattttgatgaatattccacatatttaaaaattgcttaaccagtgcagtttaaagtgtttttaaaaaggcaaccttgcttaatattggtaatacaaggtaactggcagatatttcaaagactacttttatatgtgttttaccagtaattttgttgactttcactggaaatccacctttatggcagaaactctggcagatgcttttgttcagcagggttttttttgataactatgtatgaaaagctattttttcacctttcacagggactggtcaaaggctgacgtttgcttttggtgacattgcattaattgtctcccatgagactgctagggtgctgaaggcaagttaacatttcttgactctcacctcctcctgagtccatgattcttgccctccattagtactgtttatgcctgcagcatggctgcctgctaccttctctgctttgctgggacttcctctttcaccttttacttagtcatgtgtactgaattgatgagaataagtgtccagttgctttagtttagttagctgtggttgatgttagatgggcagtggggtgctttaaagaaagagtgggtttgtagaaggtaaatctcttgcttgaaactccgtggcccttttgtttgaggccttatgttcacttagtagattattgctgcttcattatagttgttttctgtgtacattttggcctttgatcttacaaagatcaaattacttacaaagagactgagcagatatcttaatagtcagacaacaatgcttcactcttggatttttaaaaaaaaaaatacataaagcttaaaacctgtaggaagcctgagggaatgaggaataaaaaaatgctgtgatcttgtacttttcttgtattactttatcagtgttttctttcccaataagccaaagattgtctctgtttaattgttttttcatagatgaatgtatatctttttcccaagatgaatatatgtctttctcttttgtcccattttactttgctctgtaggaaatgacactccctcataccattgattttgctattaaaagacacagttactggtgtgtctgtgtacacatgtgtatcgaataaaaatactaggactgttctaaaataggtaaatgctaaacatagtattctcttgattaaaatccttcaaaatccccaatagcaagtgcaaaacttcagatccttggcatgaaatttaaggcattttatggtctggcacagacccgcttttccagcctcatgagaagcagttcacagtcacaataattatttgtgaatacactgacactctccactatcatacaaaacaacattttttgtagttgataggttaagaccttgaaaaggatttttctttcctttggccttcttagtggccgtctctttctccattgcccacaacatcttgatatttttatttggaccctgcactcttctgttcttagtttgggtaggaatggtcccctgcctgacttaacacatcagcatatcctattcctctggacatagtaaatagttaatgaactaaatttaggtcacagaatgaaagcaagtcccacaatatctgtaggagaatctagaagcaatactcttcccctcttgctttcccccaatggtactgtgccagaatgggaggcctgtaactgggttattattttgctactatggagacagaattagagttttggtgtgttagtagtggtgcctgagatgaagctgataccatggatgatagatagggaaaaaaaaatctttcagtgacacatagagtgacactgtatgagcagttagatcaaacctcacctgaatccagtgcctctggtctatgcagttacacagacaatatattccttttcttaggccattttaagatttcatctgacacttaagtgtatagttattacagtctcacaaaccactgcttaaaatttatacaatgtgcaacataagttactttattaataaaatgtttttttccatatgaaataggcagaaatgaacatttcactttaccattacagaaatagcataaagaacctcaccagtctttatgaatttacaaatcttaacttatcccaagggctgattagctgtgctcatcagtcgacgcagcactaatgtttttcattgtgcttttttggcggcctggattcgtttcctactgacttattcttgtctattccttgcttcacctgctgcatctctcttactcacttatgcactacagcaataccctgacaggggactgaaaaaacaaatcagaaaaccagcatcccattttagctggttggatataatccaaataaattcactatccagtagaatcaatcagtagaaaaaagtcattataaaagtatgtcccacttgcttgttttctcttccggacaggctaaatatttaataggaatctaggtgttatttattcatttctattaggtccttctgacacccaatcctacattgtgatgggcaattaaggtaaatatacgcttaagggagaaaactttgcttctgggaaactgttttcgcaccaatcccagtctaattgagttatggcttaaacatctcttgcataaaatctttatttataggtattagatctactttaaactatttgtattctctcattcatgagaaaatcagagcttctggtttgtagggaatcttttttccctgccaatatgcaattaatattgttatcgattttgttatctactgtggtgttgttgcttattaaagtttcttagtagttccgtgattgcttgcctgtaaataaatcacaactacacaattgtttagcatgctttaagtacttgcacttcttttatgtgattcatataaattttacttggttatgaaattttcatgggagggctcacttgtaaatattttaaggcttttgaagcagtggaaattggataattagtatagcctgaaaacaatgaagttgataaattacatttcaaccaacccatgtaattacagtggccatatttctctaactcctgataacaatagtaataataatagccaatatctactgaatgtttactatgtgccagacattgttgtatgttctttacttggagaaattcattaaagcctcaaaacaatcctgtgaatctggcaatattattttcccaattttggagacaaagaaactaaggccatggacgttaaggagcttgcttaaggttttagggtaataagtaactaataaggaaaattgcaagtcccaaccctcttactttgttctgtccactacccttcctcctttcctctttctccttttctctatctctcttccttagatagcatttataatcttccaagattctctatgatttgtttattaattgtgtttattgtttgtccccttctgctagaaagggagctccatgagggcatggatctttgtactccaaatttggaacagtgatggcatacagtagataagcaattcatatttactgagttaatgaatgaagttgtagtattaatattaaaacacatgatgtctgttgtcagagaccttacttctatctataccactatgctgactcagaatccactgacagaaaagtggaattgtgccctttgagaaacaagagatatttacaataataacttattttacaaatcttggccacactaagaattatgcttaataccttacatacctaatctttaattctgtcaaagaaccctgaaaaataggaatacttattcctagtatataattaataaaacaggggctcagagaggtgaaataactcacctaaaaattatataactagtaaagattgggtactgagtctgatctgcacttttcacatccaaattgtagtctgattctattaaatgttagttcctttattttatataatagctaatgcttattaaaagataagcatttttataaatgttttgcatgcttatttcatataatgatttcatttcataactccattattaagcctttaccaggcaaggaaatggatgtatctcttgcttgaggtcacatagctggtcagtgggaaaagcattttggaaagcttaggcccaggcctttccatgctatcttttcctgccttcctccagaagctccccacaacttggcatagtgggtgctcaattggtgctcacctatttgaaggaactgaaaaaaaaaactgataggtttagcttctatagacaaacacttttaaaaactgtgatcttttctctctaccataaccattctctttacacaatgatttttcaagacctaaattgtttagagtactgccacccttctgttggctttgtccacatatattgagtatatatacgtgtgaatctctttgcttcctcatattttcccctttaaaacggcaacaatggtaacactgaaccatacctattgaatattaaaataaaacaaaattcttgagccaattggtgttctttggagcatgatttttatacgaatagtctagatttttccaccaattaagattttagtaagtattgcatattcattgtatgttctttcaaaacacaaccactttgtaaatatttttgttaacagatgatatagaatctttggcactgattttcttagtctttcattttatttaagcattttttgaggtgctatttttaaaatatgaacttttagtttagttatttacttcctttatttctattgtttgcctggtgcagaaatgctttttagtcactttttaggctaaagttacattcatgcctttggtttaaaatgtattaattttcctttgtttctcccttttttattctctgagctttatttttctcactttctctgtactttagtttttggaaactagcctaattctaaagaccaggagcccaatttctacagcaaatcacaaaccactgagctttgggagtaatgtaccatctcattaccagcactaggtcttttgatattgatgaaacactgaaacaagagcaatgaagattaaacccctgcttattttttaaagcactgttaactcctcatactgatacctctctacactaaatagtcaaagacagaaacaaaacccacaccaccaatagctattcatctttgttgttgccaaagcagaactatattaatattaaagaactagctttggaaatagtgacaaaaaggtattttgggctgagttgatgagaaacatctagcatgtatagaattttttttaacatagcaggcaaaaaaagcacctgccacagataatctttctaaacaaagtagaacaaactgttaggtggtggaaaatagtgaagaaatatgtttacccggctcacaaaatcttttttgattaaaaaatatacatacacttgtcaagaaagcaatcaccattttaaacaaaccccagcatcaaatgatatgactaagataatttttatgctcttttccatttttaattctcatttatttaatcttccataagaattcatgtcattagaggattttgacattgtttattatggaataacaatgttttgatatttattacttttaaaagccgcaaaatagcaagtcttcaaaccgcgtaaggcaaatagaagttatttttattaggtttatctcaatgcctgagtcacatatgtacttcccttagttcctgtgggcctaagtgttattaattcattagcatcaaatgtgcattaattcagcaaataattgacagctaactatatactgcctgtattaggtgctggggacaaagtcatggatgaagcactaacgatgaaatttacattttagttgaggagggcaaagacaattaaaatacaataattattctatataagtgagataaagaaatgaattaatcattaatcagggatgggaaattaagagtggtaggtgggatgcagctggaaagcggatagtcaggatagggcacacccattggggacatctttgcaaagacttggagaagtcagtgagaggccatgtggatatttgggggaagttatgttgcagacagggaaacagccagtatatttaaggcaacaagacagagtccaccaggcattgcattttctaggaatagcacaaagcccagtttgattgaagaagagtggcaaacagaaaaaaaaaatagaaaatgaaggcagaaatatgacggtatgagaccatgtagggttttgtagactgttttactctaagtgaaagggggaacatctggagagctctgaggaaaggaatgacataatataagttatattttaaaagttaggaatagagtgtatgagggcaagcacagtaacatggggcccatttaggaaataatggaataattcataatagagatgatggtgtgagtattacaggttaagctacaatgactgaactgcactccaatgaggcatttgtgtgtgtatgtacatgtgcatgtatgtgtatgtagatctatccatacaaaggtatcaaacttttaagtcatatgtggctcataggttttatcttcaatgccaactcttatccactggtagtggctgccaggtgtgccctaatgagagtctaatgtcatgttcaggctcagagagaaagaaagagccccataattatgaaaggcagcattgcagcagtgatgtcaggtgtgttccatctctgttaaaaggcaactgtcagtagttgattttaagtagctaagactttctggcttttggcttcaaaacacataaaataaatgaaaatgcctagcatttaacagtaatttctataatagcagtatctaaaaaggtttttaaaatgtcattttcactgaggattttttttcacctagattcctattccttagaagcaaagagtgaaaaatgtatagattattttctgtattctctggaaaataactggtatgcccttgaggagtataaatttgaaaaccatatgggttttctaggtaaactcatcaatattaccatattctacttattttacttaatctactatggattttaggccttgattgaaaactagtttgcaaatatcagcttttcattctattacagcttttcaaataggctttctctacaccaattttcatggtgatttcgaacactctaaaagtgactacattcaggcacatgaataaaataccagctggatgttaacctctggtatgattggaatattattcaccttcatgcaagacttttttttttcatctccagggtcaactaattttatttattgttattgcctgtaacccttaaatatataagaatctccatatgcatctatataaaacaaagccttgaaagtgttccttcaaaatagtgatcatttgcatttagttggcagtacaaatttatctttctgtataatgcttctacatctttaaaaagccaatatcataaatgagattatccccttagaaaacaatctcagactagaataaatcaagatatgggaaacttacaaatagcctttaatttaacgaatattaccagaaagtgtgtgcaactgaaaagttctaagacaataatttattgctgaattcgcaatgtaggttttccttttaaaaatgtattatcagcctctatccaatagtattaataatcttccatgcttttgtggctgagcaaatgcatataagatcatataaatctaagtgttccagtctaactccttctttgcagggatgaagaaactgaggcccacagaaggtgggtgatacctgcaaaatcacagtgagtaaaatgcaaatacaagaaagtacttccaactcactaagagctctttgtgatactacactgatttggttcaaatttttccttatacaaaactctgtctacaacttccatgagaaactgaatagaatataataaacctctaatatttgaagatgataatttgaggtttttttggctaataaaaacatctacagagtgttttctaacagcagacacaaaagttactaaataaataattgtccccaagcttgagggtattcccatgagatgattgaccttcataattttagtctttgtttagtttagataattgtgtgtgtgaggaggtaaagaaaggaggaaaggcaaattcaccctatttcttatgctcctctcctttggccttatttttttttatcataaaactttattggattgttttaacttttcaaaaatagactttactttttagaaaagctttagatttgcaacaaaaattgaatgaaagacatagaacttcccatatacccccttatcccctatgcatagaatccccgattatcaacatccccaccagagtggtacatttgttacaattgatgaatctgcactgacacattattatctcccagagtctccagtttatattagggttcgctcttggtattgcacactatctgggtttggacaagtgcttaatgataagtttctagcattatagtctcatccacagtattttcattgtccccaaattctctgtgctctgcctattcatctctccctttccccaacccttggcaaacactgacctttttactgtctccatagttttgccttttctagaatgacatatagtaggaattacatagtaggtagccttttcagactgtcttctttcacttaataatgtgcaattaaccatcctgtatgtctttccatggctttatagcatatttctttttagtgctgaataatattccaccgtctttatatgccttagtttatttattcattcacctactgaaagacatcttggttgcttccaagtttttgcaattatgaataaagctactataaacatatgtgtgaagaattttgtgcagacataatttttcaactccttaaggtaaataccaaggagtgcaaatttctggatcatatgtttagttttacaagaaattgccaaactgtcttccaaagtggctgtacaattttgcatgtctaccaggaatgaataagagttccaggaatgaataagagttcctgttgcttcacattctcttcagcatttggtgttgtcagtgttctagatttcggccattctagtaagtgtgtagtggtatctcactgttgctttaagttgaatttccctgatgccatatgatgtggaacatcttttcacatgattatttgacatggtatattttttctggtgagatgtttgttaaattcttaggcccatttaaaaaaatcagattgtgtttttattgttgggttttaagagttctttacatgttttgggtaacattccttcctctgatgtcttttgcaaatattttctttttttttttcaccacagagctttcatggtgaaagaagagggcaaaactcaacccgtctctttagacttgggaagaatatgaaaggaccaggagggacacctttcctaataacctagctgatggttcacttattgtaagcacattctcaaacaaggtgacaattaggttcaaatatcgtctttgaaacacaaagtagatcttaccctttttatcctcttattgctagtttagcttctactgttagaaagttgattcttaatgtaatatttgtctaagggtctgttataggagtcctaaacagatacatcagccattttatgctcctaaatgcaagccaggaaagagctagagataaaagcaaagatgttaatttatgtaaagtacttagcatggttcctggcaagaataacaagtcaataaatgatattaataataatactaatactgtaaataatacctaacaaggctatttttcttattatttttaaaattcatacagtctctaaaatcttcagttacttgttcctctcacagtgttccatactacaccctggagacactgatcaagcagagaactgtgtttacttgattgtctgaaacagcaggccgatatagcagttgcaagcatcttgagcaattctattccatatagagacataagaaaccgagagaaagagacacaatacatagaagattttttgcaccacttaagtcgcttaaaaatgagaaaaagatatatccagtcttcttttttttaaaagaccacatcacatttttaagatgtaatccctagtaatcaacatgacagcccagcagagcagaatcaggagttcttgctgaaataatcctacacactaacactttgtctaatgtcataataacatctgaagatgcacctttttctccaactattgagcggctactttctttcctctttccctcacagctgtctcccaggcagatgattttagtataatatctgtaatcactccagagctctttcctgatgtgtactttgttctctgaaccctttaaagttgtagcccctctgattattttggtcccagagtttcatgccttttacacattgttattctaaattccacgagtcatttacttgctcataatccaggtctttcaagcctctttgagtttgcacactcggttccacactatttgtctccatttttgtatcattagccaaattgactaatatgaagtctgctcaggatggttcaaaatgaaaataatgtgctagctgaagagtaaatattactgagctatgaatgatgaagatttgctcagaaattttgcttatgagtagtttgttatgaagcatacaaaccctagcattcattagattttttttttagtaaaaaggagtaaatcttttcttttgtatgcaaaatgcacttttcctttaaatttatgaagtttattggctttttaattttctttacaatataatatatttgcaacaattaatcctatattcttcctctttgaaatacacattttctaaaaacatgttgatcatgaggtagatagaataaagtagcttacttgatagcttttccaacaaccttctgatgttttttcttgtgctgtagaggctggaaagctgaaaaatgacattcccagactccattgaaattagatttccagaggtgatttatgttccacacatcagatgtatatgctcaagatttgtttaacagggaaggaggcagtggtgtgtgggtcccttttgctcatgtgaatcttacaggtatgggtatggctctcaagttcacagtgctggttactgcttgctgatctcaacagtctaaagcagtttttttttccagaggcaacagttttgtgatggacttcctaaattatccagcttctttatattggccaaagtagtagtttccttgatgagaaaggatacagtgttctgggagctaattctggttagcctagatagagcctgttatcacagccctttccaaaacaattttgtcaactctaatgccttgtaaaaagtcactttctgcttatgagaccagagcagtttctgcaatttgactcccagctgaactgtttcaagtttgagattctgaaatcagggtttgaggtactgaatatttttgaatggtcttcaaagttatcattccatttcccagagttcttttccaaacagtgcaataactttctacccacattgtcattcagtaactcacagaatcagattcttcatccaatttttagctatattatccaaatatccttgtcaccatgtagcatgaactacctatatcccttcttctattatattatgaacagatgcaccctgacttccctgacttcaaacactgttcagatagcccatctgagatccttatcttggactgtctgtttcctgcaactactaatgcaagcagaagtattatacaattcaagatgtaataaaactagaggtttttcttctcacaaagatgatggtgtggtataattgaaaatactacacagtttggaaacaaatcgacctagacttgaaaactggctccactattttacttactatctgtgtgactttggacagttatttgaccttttaagtctgttctctgagattcaaataccttacagagttcttgtgaagatcaaatgacatatgctcataaacatagcctgtttttcctgttggagaattacttcttcctcattgtatgtagtcttggtggacggattaaagataaacagattctaccatgtaagccaaatgaggcaaatattccctttctctgtctcaggcaacttagggagcaggaataatggcatatattcagcgaattgggagctctttcatgaggttttaaatctcccaggtagattggaggttatttattaaaacaaccaaggtaatagcagtggcccaaacagtttcaggctgagattccagttttctaattcgtggccctccagtgtttccttgttccctgcccattcttaggctgcttcaccaggctcttattgatgttgtaactcctaggatagttttctaataaatcccgttttgtgtaagttattcgtgatggtttctgttgtttcccacacaaaaacactgattgatagagtattttttcctactctaaaaaagagaaaatgaagccatggaaaggttgtgttactaatacatggctgtgttaataataatccacatagatagtaactagtagagtcatgatttaatgtcaagtctttcagaccacaaaatctgttcttctgcttaaacagagcttttttcttttttcttttttcttttttttccttcttaaacagagttgtctcactaagcccaaatttgtctaactggccttatttccctggagtatatcctggaagtttccattcaagccaatttaagttactttaaattaggaaaggcagaaaacaaaagcccaaacctttgtaaaggaggaggatttgctacattgttctcaattcatcacagaagaggatgaaactgagtgattacacttgctggagagaaaaaaagtccttcccccgctcaccccaaataaagcattaactttatgttaatccatgaattaaattgaattgcattattacttagtgctaatctatataacctacttaaaatttaattgtatgtcatagtttgaatagatgcatgctatgcattgttctttacattataacatcatcttgacattatcaatatgatgtctatagaagacattaatttcttgttctgaaatacagaagtattatttttacattcttttgcgggattgtattctttttgcttatattaatatcatgtgaaatccacccaaaggtagcaataacaattatatatttgtttcaattttgaaatacaaatttagaactaatatgcatttggtacccacctcactgaatatgaaatctcatgactctttacatcgagtgcttatgacaacatgctacagtgtgcatggccaaacacattcttcaaaaaaacaacataaaggatataaaggctgacataaatgagtattattcctcagattgttcattgatttgtttcatcttctaacacaacattgatagacatataatgtagcagatatattcttccttgctggcagaattcactgtttcaaacgtaaatccccaacagtctaaaccattctatgcgatgccatacctcctccctgtgattgctttacaaaagagcatgtgactcagtcttggcaatgattgagtcacaccttggcaatgacatgaaagggaagactgctgaggattctggggaatgtgtcttcactgatgaaacgaaacacagaagaaaaaattgcttatcttcctttggccattgatgtatctgcatggaaagcccgtaactgcagaaatcaactgggattttaacggctgttcacagaacacagctgaaacactggacagaactggctccttgagttgctgaattaacccactctggaactaatttcttgttatatgaaataataatgtttcctttttgcttaagcaactttgagtaggggttttccatgatgtgcagtccaaagcatcttaatgatacacatagcaagtatttcacaggagttcttagcacaattaccatgacaagtgctcacgtaatgtttattaaaaaaattcaattggcccttcatattcttgggttctgagtctatagaattaaccacctacagatcaaaaatatttaaaaaattgcacctgtactaaacatgtagacatttttattgtcattattccctaaacaatacaacaactatttatatggcatttacatagtattaggcattataagtagtcaagagataatttaaagtgtacaagaggatgcgcacaggttatatggaaatactataccactttacatcagggacttgagcatctttgggttttgatatccaagggaggtctgagaaccattcccctgaggataccaagggacaattgtactgaatgcaaggaggttaatattatctgacattatcatggacttcagaaaacgtgaaggaatatgtatttatttgggctaaagatgaaaataatggaagtgactacaagcaagtaatggataaaatgaaagtgttatgatggagggggaggcaagaaaagacacattttggtacctccaatgaccacctcagggcttgactttttttttttttaaatgaaaatatgacctcacagcagagtgtttgttctcactcttcatgctactgtgaatgtcatccaaccttaccgtggccagcccggcctctccacatttccagcctgtgtgtaccacagtagcaaatgttctttcattcccaaagggctatgtcttcaaaatggagaaacaggacacacaccaaatgtataaaacagaaaataagacagaagaatgtgcttattggctttttcttctatcatttaatagagtgctatggtttttgaatgtacgtgtccctccaaaatttatatgctgaaacctaatcaccaaggtgatggtattagaaggtagaacctttaggaggtgattaggtcatcagggttcacatttcatgaatgagattaattcacttataaaagaggcatcacagacctgtctcccactttttgcccttctaaggtacaaggacacagtgccatcttggaagcagcaatgaagcccctaccagaaactgaacctactggcactttgatcttggagagctatgagaaatgcatttttattatttataaatcacctagtttatatcatattagagcagtaggaatggactaagagattgggcaagggtgaaatacaatctaaaatgcaagtaagagtttcaggtataagaaagaagtagagacttacgggagtgagcctgtctgcctctgttaagtatcccttgggcacgggataaattttctttgtaatggaaacttctgaaccatttataatagtgtcagtacctcttgaaagccatcaattaaacgtttatcaaaaaaacataaagaccttttccccattctcattatcaagatctcatagttagctaggtacttgatcttgaagcctgtatcttcaagtgtttattaattcacaatctcaatttctctcatttcttcacctcttacggctcctggttcagctctttttacctcccttctctaaacagtaagcagcttcttgttatttttttctcagttttatattgagttttatacacacggatttgactcagatttttatctctaaataactgtatgaaaatatttactgaatatgtgcaagacacaaagctggttaggttaaataaaatgacacataaaactttgactttgttttcaagaatctcagaatccactgggagtctgatatttaaacaattcaacgacagacatactgtgataagtgccgtaacaaaaatatgtaaaaaatgaaaacgaaagtagcttgcctctcaccatagtctgtaaggcatcccctattgggcttctccttttatttcaaatttgctatgttcaagatagaattcaccatctttcctcccaaaattgttctccattgtgatgattctatttctcctagctgttgcacagttagcttagtcactcaggcttgaaagatgggtattctttgcatttttcttagattcatactccccatctagccatatactaagttctgttcatttttcttttgaaatatctgttttatccttctgttctacagtcattaccatcgccctactccaaaattggatcactttatacttatattcctgcaatttcctagcagatgtctatgaatccaggctctccctcatctaaatcattctgtgtacttcaaagacccaccgaattctaaaatagggagacgttgacctctaatgcaacaatctctacaaatcaaccccaaaatgtagatgaatacccatctactatccaaatacttattgatgggaagcccaatttttcaaaaaaccttcttacttaatttgtagattattttaattgatagaaaaattccccttgttttggtaagtctacatctttcttgctctatttttcccccttgaatccttgtttggattccctgaaatgtaaaatctcatcaagcctttgaagaaaactattttctctttttaagtcttatgttttaaaaactggttaaacatatactgtttccataattgaatctgatataaattttagaccacaatatcttgattgccctcctattggtattttacactttttagcattatttaaaatacggtgttcaaatataaagagaatacttcacaatttccttacacagatttttcattattctgctcatcaaccaaattcaagtatcttaaatatttccagtttttgttgtgtcaaaacaaaacttctctccctgagttctacctgactttaaaagccatccagaatttatgtgttttgctctagtccaacttatttatctcagctacctaaagcatatcccacatttgctgggatgggatcctttctttagcatctcctttcattcacttattcacatttccaattctttccttatgcttatccttttgcctgaagtgacttatctttacctgattttatcttctctttccttgaacactcagttttagacagtgtaataaggaatttcacctcatcaaagagaggtctggcttttgccttcagctactgggaggtgacctctaggttcctgcagtgtcctgcctgataggaatcctttcatttgctagtgtgtttgactactagaccacttaacaaggtgatttatgatggggactttgaggccatgctatatcacctctaatctcatgaagaactgatgagtaaaggttgcctgacttttgtgagtggtaggagactaaagggcagccaatgccagcactatgtgattaagccccagtaaaaactctggacactgaaggcttgagtcagcttccctgattggcaaactctgtgtgtattgccacacattgtggcaaggaggagataataccatccatgactccacaggaagaagacagccagaagctgtgtatttggtcctctctcagactctgccctatgtatctattccattggctgagtttttgtattcccctgtaataacccatgactataatagttttcaatgagttctgtgagtccttatagtgaattatcaaatccaagtttagtcattagagtcctttaaattgtagccagctggtctgaactgagagtggtcctggggacccaggaactttgtgacttgtgtctgaagtgaggaccgtcttgtggggagaattccctgaaattgcattgttggtcaaactcaccacacagacccacttccttcctgaagcatcctctaagtactacttccctcactgatgttgcttccttctaaatatctatatattgactgttcacccttgaacagtgtgggtttgagctgcacaggtccacttatatctgcctctgtcacccctgagacagcaagagcaaacctttctctttctcttcctcttcagcctactcaacatgaagatgacaaagatgcagacctttaggatggttcacttccacttaataactagaaaatatattttcttttccttatgatttgtactaatattttcttttctctaacttactttgtaatcaaaatacagtatctaacacacataaaatacaaaatatgttttaattggctgtttatattattggtaaggcttctggtcaacagtaagctcttagtaattaggttttggaggagtcaaaagtcatgtacaggccagaagtggtggctcacgcctataatcctagcactttgggaggccaaggtgggtggatcacttgaggtcaggagtttgagaccagcttgggcaacatggtgaaaccccatctctactgaaatacagaattagccaggcatggtggcacaggcctgtcatctcagctacttgggaggctgagggaggggaatcacttgaacctgggaggcagaggttgcagtgagctgagatcgcaccactgcactccagcctgggcaatagagtgagactccatctcggaaaaaaaaaaaaaaagaaaacaagaaaaataagttatacacagatttttgactacacaaggaattgctgctcctacccccctacatcattgaagggtcaactgtatactgaatatcacaaaatttgtcacagacatagatcactggaggtaacatattaagctgacattacgataagtaccagcaaaggtttggatttgggtaccatggatatttagcaatcttgtaacttctgagatcagaagacaataaaagaaggagagagaagactattataatgctgtgaaaaagtataagaaagagaggatggtagtgatactggcaagaaggcatcaatcattttcctaaggaaccactgtattaacaaaatagttcaacagttctatcaacatgttttaaagcacttactaggcactgaaaatgtgtcatcaactctccagggatgaatagttgatgatggtatttgataattcttgcaacatttttttttgatagcagtttatttcagaggcttcatactttgggaataggtctctgcctttcccacatcttacaattttatatgagcaagaccatctacatgctctgcctgtgactggtagttttctttttaattatattttttcctatttcttttttcatgaaagatgccaatagtcagtgtggtgaccctgtcaagtttaacatgaatggataattctgagtgatgtgagatactctaaatagagagaaaacagaaagagtagtcatgaacagcacataagtacagcaatatgggaacaggaaataagaaaccagaaggaatagaggaattaaaagggcagaaatgggctcacactggcttccagaactagaaggaattggaggaagatattcatagaaactcagaaaagttctgaaatcagaaatggtgatgggttgattcttggcttgagtatagcagcaggtggtaaaaaaaggggatagaaagaaggaaggtattcgttggccagaagtttgatatcctttccttgtggaaaacatcttgccttttggttttatttttacttctctgagagctgtaaggagaccaggattcatatttccttgggctaggattatgacagattacattctttttttttttatccctagataatgcttttcagaaagaaaaacatctcaaataggcatcctggagggccctgaaggaccctaaattgggacaattctataaaaacaggatgtttgattatctcttgttctgctaaaatcacactacagagcctggctgagctgggggatgtgcaatagatcagtaacaaggcaagaattcattatccacctgctagagttctatgataacctatcaatggaataagtgtgtaaatctctactttttaagcagtcttcatatttcacaaaacccctttgtagctagttaagccacttgcaactttcctaacatccattttcactactggaaaattgataaatcaaaataatgcgttaggttttgatgtgcttaatctggtttctgtttgaaacattagcatttatgaatcagatatgcaaagcgtggtgtgtccgatttccataactctatccctcttcagtatactagaaataattgggccacgagtttattaatattgaaatttccagtacaaaatgcatttctagttgaagtgataccagctagtattttacatactggtaagtgctgatcaattgatagacgttttttctattcctgatgttttaagaaaagagaaactaccttttctgattaaaagaaatgcagtcattcagtaagcaatgcacacaatctttacaattttctgtgttcaaatagtcttctgaaattataccacatatgtgtgtatatcataaatatagataaaaatatcagcgttcattctaaattgcttaaaatgtgtatttctcttttaaacagaaacatttactataattccatagtttttttttcaaatatgcttttttctaagacaatttaaggagctttttgaaacagggttattgatcttttttataagatcagatgaataaagtatttccaagaaaactgattcccaggatagaattggtatgttgtttctctaaattgtggtggtttaagaactcatcttgttcattttcagcatataatctatagtttttgagaagctaaatggaaagaatgatgaaaaaatgcacagttgcaaaattcaattttagaaacacaacttaaaaggcttatttaatatgctgcaggtgtaaatatatgcagcataggaaaagatgatgagatatagaacaaacaattatttcaggtaaaataaaacctaacacttgtgttttctgattagaacttccctttccatttattgatatctgtttcattcaagacagaatgcgaaactatatatcttctatgttttagtcagggtaggatgctaaattatatttttaaaagacatcatttagctttttccattgcagaaacaaatgtacactgaattaaaacttaggagctgatagcttccacaggctgttgcatatcaccaaaaactcaacatgagttcattaatacttgttgaattggaacttttttttaagtctgagcctgtcctgtctaataaaatatacaaacaagaaaatatgaactcatctaatagttgaaaggtaatggtcatctagtaggctcttctcttggaatggtttagcaattcattgctgcatgtattcagattaattttatagcattaaagtgataatattgtaaaacatgcctatatctctttcacatacttccttctggtgtagtaaggattctgcagtaagatagtgtggtggactagttgacttcccaaggcctattattctatgaagtgaaaattaatatccttttaacagaaaagccgggtttccaattatcagtagagcagatgttgtgcttttcttctggatataaagaaaagggatgtacatattatgcttcaagaggtgtagcaatataagtaaggctttttcactctgctttactgctaccctgagggtaaattgctcgggtgtgcagctccatcctgcaattcctccaaatatcagaaatgaaaagcacagctatgaaaggtccaggcttggctttcctcatcataaaattatgggaatgtaactcatacagctgctgtgactacctgctgtctgccagatccccttgcttccatttttttctgctcactgggtatagccagtcatttccaagagctaatttgcagttgattatgcaatctgccaagcccaatcaatgtgcatactcatgaccactcataagatcatttgccttaatcataggagacctggaggtcactacttcactatagggaatatattcagtagagatagttgtaggggtgcccactacccagctgcctgccaggtctcttggcttccatcattttcatctcttggatgcagccagttttatccaaagtcgcttcaaaggcaaatccatttcctaccagtgagaaatcctctgctgactacggacttctgaggcagcaagacacatacaaataccttgacaaaaattcagaattcagctttcttcattttctctctttttaaaaaatttaagtaatgttagttttcagcaagattttattcttttccatgtgacaaaatgaactgtcattaggtgtctaacagaatggtcttctaaaaatcaggcctcttgttgggatttattgggctcatgatatctttccatatgtataagccagtttttatttcttacattctgaaatttctttttaaaaatggaccagattatatttcaatacatgcttgaggattgtgacttatagatcttggcagtttacaatcacctagtgcagagaaggcaaagatgtaccatgtgttctgctattctccttcctcttttccttgcacatagttatatatatatggcacataattatatataacatatataattatatataaaatgtatatattgtatataatatgtatatataattgtatatgttatatatattattattatatatatattagtgtttaccatatgctgggaattattataggcactcaaaatgtgacaaagaacacaaagttcctgacctcacgattgcttataatcccatgaggatagaaatattataaacttatcccagtatcatttcttcctgagccctgacacagccacatgatccttcttaacctttgcagtagatgttcactaccaatcaataagactaggcaggtagaatgaaatctgtcattcctgatctagtgcaatctattgtgatagaaaaataattcacccacaaaataaaatctgtaccacattttattgaaacccctaaatttaaatatttcaccataataaatgtaatcaatgtataggccaataactgtttaacctgcatcttacctcaacactgagtcttttccaactgccaatcacagctatcataatgatgtgtgatgtgcttctctttattgaattaaaattcaattttagaaacacaaattaaaaggcttatttaatggaggatattttatgaatttaaaaaatcaaatgtaataccaaaagcattagtttgtacagtttctttatgatctctctcctctctatataaatatacctcaagaaaattatctatagttaagttttgtttaactcaccatgtcataagttaataaggttacaattatgttggatatattattgtcaatgactgcttggtttaaataagtttttttttccagctatgagggtggggtcagcatcagaatgaataaagctatgtacggccaaattaatgacctatagaatcatctaaatgaaaaaatgacaataatcactttctttattttatcttagtctgaactttccaccaggactctagtttttattatttaataagatttaaaaagtgaaaattcagttttggataagtgtaatatcttgatttttggaattaatcaatttcgtcacattacattaaaaggtccgatcttctttgcctgtgtaaacctttttgaacttctaaacatcagatgaagtgccactttatcctcaacatcacttaatgtttgtactgataatagtacagttatcattacattaaaaagttatcattacattaaatgtcagcacttaatgtttgtaatgataatagtacagttgtcccttggcatccatggaggattggattgaggacccttggcaataacaaaatctgtgaatgctcaagtcccttatataaaatgttgtagtatatgcatataaccaatgcatagcctaccatatacttttaatcatctctagattatttataatatctaataaaatgtgcatgttctttaaatagttgttatactatatgttttatttgtattattataatttatgttttgttattttttattttttgaatattttttatctggggtttattgactccacgaatgcagaacccacaaagtcagagagccaactgtatgtttaaacatgctaatttgaaacattgtattgtaactttcttgtgtggcctttaaaattgtcacagattttgtcttattccacaataagattgacattaatatgcaaataagaccaaagaatgaatatcagattgtcaatgtatctatttactgtatacacacatgtgcaggcatgtgtgcacatatacatttctgttagagatctaacaataagttgatatctgataaagacatagctttttaataacttggcatatatacgcaaatgatttatatttctaaatgatgagatatttcctttaaaattaatgcattatttgttatgcattaattgtgattcaatgaatgaaatgaactttaatcgtatgaagcaatatttttaagataatttctaaatacaatttggggtctgaaagatctcacagtttgaaatattgatgatagacccaaatatcattttcagtgtaaaattgatttgtcctgaattgggaaatgttaaatctatgttctataacctaactactaccaagagctgcatgactctagaaaagtcattgagaggtggcaaattttagtttacctatctgtaaaataaagaatagcatatttctatgggccctgtgaaattaaagatatcaatgattctatgtcgatacaagtatgtccactcactggtgacatgtcaaagaatgccaaaatctacaacaatgtgagagtgaaaaaataatgttcataaaattataaacaagaaatttcacatagcataactacagataagaagaataaaaaatatgtaaagctcttttatatgtttgcccttgatagagtttattacaattattataaattgcacaaaattatttgttgaaataaagcatattaattacttatatattcaaaagttaaacattgataaacatcttgctatgtgtatggaactctattgacttttttgtccaactttctgaaggcaaaatacgttgaaataaacaaggaggaaataaaagtgattctacttaaacttcagattatcataaacatgaatatataactagatgtgccctatggttatttggtcatgtaagaaaacattttaaatggtccattttcaaagcatgataaatctaagtaccggcagccacccggcaaacgtaacaaactgcattgctcatgcacccagaaggtcacgaaaagggaacagaatgtagaggaggggtcagcccataaaagggaagaaagtttcactatcaggaaattgaaacataagcaagaaaggggacctgggtataaccttataagggggataatgaaacttaggcaacgtccaggaagattgcaaccccatagtactcgaccaatgaggaactggggaagggacttgcatgctaggagataaattacctggtgtaactgccccaggtgtgcctgcctactagacacctgatcttgcaagatcgccattaaaagtctcacttccgctgtttttcatgtctctcagtccattctttggatttggatgggtgaatatgtgtttctcacaaatctggggttttgtccaggatctctgtgccttcatggagtgggactctcgcagagaggggagatgcgtcccacctgatttaagtggcccactctgtctgggcttactggctccctgtagaggctatagacaaacctgaaactgttattcaggaggcagcagaggcaacagaaggagaaaagcaggcaccatggcaaccaggcaacctcgtgcatgagctgaagtaagaaaattggactataaattcaaccttggtggttgggcatgttcataggtcgagtgtgtgcatgactgagatgtatcctagatatgaaacaagtgcagagtcccaatccatggttcagttctcccgcaagggaaatggccagagacagaggcagcgattcttggggtgtgcaagaaacctctagtagggagggttgagtacatgaggaaaagctcagatacagagactgacaggaaaaaggaaccagaaattctaggcctagggaacaatagaaagagggagtcaaagagactctctctgacattcccctggatagtctgttggggagaatgctgcaggtttgcagggactactctcaaaccagggacaaggaaaagttaaagataataaagtattgctgttttatctggcctaaagaccctacttgtaacccttcggtcttttggcctaagtttggctcaaatgaggtttgggtgtgccaagctttaattctgtatgtgaataataaaatcccatcctcataggaggagataggttacgttctctgctggatcaaggaattagcacccccatgttacctatcaaagaagaagaagaagagcctagtaaaaagccctcacccagcgaaaagccctgagaccccctacaatgcttgccccctccatacatctcacaaaataggggacaggaagatcaaggggcaacaagagggttagaggaagaaatacctggagaccatgggggagctgaaccaactgcttctttaaattctcgtccaaatttaagaaaagaattagaacagtgtaagagggatgttgagaacttccctatcccttccacacagcaggcatctagcatgttgccccttagggaagttcccatagacagggagagattggctttgtaagtgctcctcttacaagtactggaataaggaatttcataaagtaaataaaaccactcctagaagatcccctcagtttagcagaccatctggaccaattcctaggacccagcttttacacatgggctgaaatgatgtctgtcataaatatcctgttcacaggagaagaaaacgaaatgattaggaaagcggccataaccatctgggaaaggcaacaccctccgggcaagaagtctcgccagctgaacaaaaatttccaaatattgatcctgaatgggataatagtgatcccagggatcaggcccaaatgtgggatcttgaggaactaataattaaagggaacaaagagctcactcataggacacaaaatgtctcagaggcattcgagattcaacaagaaaaagaggaaacaccctctgcattcctgcagaggctcagaaattagataaaaaaataaaataaaataaaaaaataaacctccaaattagatccagaggacccagaagggcaagacctcttaaaggttaactttgtaactaagagctgacctaacattacaaaaaaattacaaaaaaagattgatggataaaatgagaaactgatggaggaattactgaaggaagctcagtcggtctttgcaaggagagaggaagaaaagcagaaacaaaaagcaaaaatcatagtttctactggggaaaaggtagtccaaaaaaagactagatcaagatccccctcacaggagacaaaggaatgacagatttcaacacagagaaagaagagaaatgcaaggaaaaactcctaagactatgagtaaatgttacaagtgtagaaagccaggacggtttaaaagaaaatatcctgaatggaaataagaaaaaaaaggcaatccccctcacaaccgttgaagactaggggcttcaggggttccttctgagtaggtcccaccaggacttttaataaatttgaaggtgggacccgaggaagaaaacgtaacgtttttgattaatactggagtggcttgctcctctctaattcaccaaccaaggggtacaaaagtctctaaggaaaaatggacagtatccgaggtaaaaggggagggattttaggttctgatattgaagaaaatgttaattagattgagaccagagcacactgaagggtcattcttatatgttcctgaagcgggaactaacctcctgggtcaaaacctgatcatgagattgggtttaggatcaggaatagaggaaggacaagtaaaagtaatgacgggcctcctaacagaggaggaggaaaaaaaattaatcctcttgtgtgggttaggaaaggcaacagaggagggttaaaaatcacacccttacagattaaactaaaacaaccaggacaagtagtttgcaaaaaacgatattgcatttctattaaagggaaaaaaggtctccaaccgttaataaagggattcattgaagaaggactattagaaccctgcatgtcaccatacaaaccatacgataactccgattctcacaaaaagcctaatgtgttataaattggtgcaagatctaagggctatagatcaaattgttcagactcgccaccctgtggtgcctagcccctacaccctgtttctttttctttttttttcttttttttgagatggagtctcgctctttcgccggagtgcagtggcgctatcttggctcactgcaagctccacctgccgggttcacgccattctcctgcctcagcctcccgagtagctgggactacaggtgtccgccactgcgccagactaattttttgcatttttagtagagacggggtttcaccgtgttagccagaatggtctcaatctcctgacctcgtgatccaccagcctcagcctcccaaagtgctgggattacaggcgtgagccaccgcgcccggccccctacaccctctttagtaagatagtcctataaacagaagtggttcagtgtggtggatctaaacgatgcattttgggcagtcccttctactttaggactagggacctctttgcctttaaatgggaaaaatcctataactgggagaaaaacaacagtaccgctggactgtgctgccacaaggtttcatggaagccccaaactcatttggtcagaccttagaaaaagtcctggatgaattccaaccttccaggggaacccagttgttacaatatgtaaatgatctcctaatttctaggtagaggagggccaaggtatcagaaaccactgtgagcttacttaatttcctaggagaaaggggattgcaagtctctaagaacaaattgcaatttttagagaaaaaaaagttaaatatttaggatgcctgattagtgaagggaagcagagaataaacccagagaaaatatcgggaatagtgggtctgcctttgcctaaaacaaggagagaactccaaaaatttttaggtttgactggctactgcaggttatggattgattcatatccttaaaagacaaaaaatctgtatctcaaattactaaaaaaggaacccaatccctcgcaatggtccccagagaaaattcaggcaatgaaggagctaaagcaggccctcattgcagccctggtcctggccctctcatctttagaaaaaacattccatctgttcgtaacagtagaccagggcttggcccttggggcgctcactcaaacttggggagggaagaggcaacctgttacttttgtctccaagcttctccatcctgtctcttggaggtggccgaaatgtgtgcaagcagtagctgccacaaccctgctggtagaggagagttggaagcgaacctttggtggggccctaatgctaagtaccccatgccaggtcaggaatatattaaaccaaaaagccaggaagtggttaacatattctcagattctaaaatacaaagccataataatagaaaaaaaatcatttggtcataacaatgaatacttgcctgaatcctgccagtttcctatggaaaggagaggggaacgaaagacatcagaccataactgcttagatatgataaaatacaaaaccaaagttagaccagaccttagggaagctccactacatgatgggataaggctgtttgtgaatgggtcatccaaagtgatggataaaaaacaaaaacaaaaacaaaaacaaaaaaaaccataatggttatgctgtcattgatgaaaataaacactgtttacgtgggaaaggtaaattacctaatggctagtcagcccaaacctgtaagttatgtgttcttaaccaggccctaaagctccttgaaggtcaagatgatactatatatactgattctaaatgtgcctatggagtggtacacacttaaaaaaatctggacaaagcagggtctaataaataggaggggaaaagaattcatacatggagaactggtcaaacaggtcttaaaaagtctcctgcttccagcagaggtagccatagttcatgtaaatggtcatcaaaaagagaacactgtaaaagctgtaggaaagaagcttgcaaataaagctgctaagcaagcctcctgaaggcaaaaattagactatttagcctgatcccagacatccctaaagtagtattaaggtgcagtttaccagagatgtgaaggaagaattagacaggataggggtcaaactaaagatgggaaatgggtacttcctaatggaaaagaaataataaataaacctctaattaaaaaactaatgtctatatcacacaaagggagtcattagggaccccaggctctgtgtaatgcaatactcgggaattatgggtgtattgggatttataccctcactaaacaagtatgcaaaagttatgtaacttgtcaaaggataaacaaaaaggtaattaaaaaacaggccatgggaggaagacctcccaaactaagactatttcaaagcattcaagtaaatttcacagaaatgcccaaagtaggaaaattaaagtacttacttcccccttccaacagccactgctgggaatgtggtcaaaataatattagaacagactgtacctagatttggcctggtgaaaaatattaatttggaaaatgcgagccactttacctcaagggtgttaaggggaattataaaaggtttacaaattagatggaattatcacaccccttggcatcccccttcttctggaaaggtaaaaagaatgaatcaaactctcaaaaagcatttcaccaaactaatcttagaagctaaaatgccttggatcaaatatttcccaatagcactccttaggattaggacagccaccttccccgctaaagaagacttggaattgtctcccccacaagttattatatgggctcccacagttgggcagagctacaaatctccctactatggaaaccaagaatcaattttaagaaattatatactggcccatatcctccaccctgtcaccccttaagttaaaatgacttctgactcaaaccccaccttttaagtttgtagttcaccacttccagcctggtgacttggtgttaattaaaacttggaaagaagacaagctccacccaagcagggaaggtccctattaagtgctcctggccactatgaaagctatgcaaacagttgaatgcaggtggactccccatacttgagtcaagggactgagaaaagagaccccaggagggagggaaaaagactggtggaaagtgcacgggtcacctgaggaacccctaaagttaactttgagaaaaatctacaaagaaaacatgggctggccccatttctgaaagttaatatggctaggatgggctactatacgaaaagcaaaagtcaaaatggaaactggcaggggactcctccctacccaatcatgttggtaattaatgtaaccaaatggtagcattccaaactataaaatttaatgccttccaggtcttaccctgtgggaatttggaaaatcagagatagctctggcaggcagataaatatctttgccctgaaccgaatacaggttacagtagggcatcaccctgccgcagctgagataatgtatggtggactacccaatttcagggttggacagtaaacacggggtgggtaactccaagctggagacccttaaagattaaactgcatctgtccaggggctccccgccagataactgccagaatttagaatgcagtcctatacttatcaccatgaacaatccagccattctaaaccaagaaccaaaagtagcatcacgggtatatgggtgaggggcagacatcacaggggaagaccccctagggtgatttgttcttaaactaattaagaactcaacctcccatttgcctggaactattccaaccccaaaccctaatactttagtccaccaaataataaccataaaaggataaaaataaggtaaaagtgaaccttagaaattgagacagggtaaggggatgtgaatgcctgggtcgaatggatcaaatttttggtacaagccctcaggaagagtaactgctatgcatgtgctgtgagatgacctcagccacaagtggttccgtttcccctaggatgagataccaatcctaaaggaatgcattgcatattggctctataccaggacaaggatgcatggggaaatcagacttgtaagagtctgtcattgctctttcccacattgcagaggtcagatcccagagtaatcccttagttctttataggaaatatgaaccactcctcttgcctctctaggcagggggcagagcccatgggataactcttgacttgtacccacatccgacatgccactggtgagtcaggcaatggcagttactcagctctccatataccctgggcttatgtctggtggaattgtgggaaaaggaaacttcgtaacttgttaccatacaattggaccaggacttatgcttcagtccaattggccattcccttcactctggcattccataaaatacccaaaaatacacatggccactgaaactggagagatctaacaaattcttttgatcccaatatatatgttaactcaataggagtcccaggtgggtgcctaataaatttaaggcctgaaaccaaatagctgctgggtttaagtcagcactcatctggtgttcgactattaatgaaaatgtggattgaattaactacatctattataatcaacagagattcatcagttatacttgggatgccctcaaaggggtggctagccagttagatgccaccagccaaatggcttgggaaacaggcttgtgctagacataataatagaagaaaaagggggcatatgtgttatgttgggtgggaaatgttgcactttcattctcaacaatactgccccagatgggaccatcacaaaagctttacaaggtctaacaactctagccaatgaactggcagaaaatgctggaattaatgacccattaatgggttggctagaaggttggtttggaaaataaaaaggaatggtggcttcaatccttatatctctcataattgtggcatgagtcttaacagcagtgggatgttgtattatcccttgtgtaaggggactagcacagagattaattaaaacagctattaataaacaaatgcccataacttaccagcaaaataacctgatactattaaaaaccaaattaaactcactgtcctataaggaaaaaagcaaacaacttctagagtgattcaagaatcaaaaggtttagatgaaaatgagaccaaagaaagtaaatagaaaagaggagggaatttgaaagaaaccattttaaatggttcattttcaaagcatgataaatctaagtaatgccagccggcctacaaatgtaacaaaccacatggctcatgcagcttgaaggtcacgataagcgaacagaatgtagaggaggggtcagcccataaaagggaaaagtttcattattgggaaattgaaacttaagcagagaaggggatggggtataaccttatggggggataatgaaacttaggtgacatccaggaagattgtaaccacatagaactcaaccaatgaggaactaggggagggacttgcgttctaggagataaattacctgctgtatctgctccaggtgtgcctgcctatcagacacctggtcttgcaagactgctattaaaagtctcacttccgctatactttgtgtctccaggtccattctttgggtttgggtgggtgaatgtgtgtttctcacagtcagagaacaaatattttgaaaaaggaagcaacactcagactggaaggttggtacattgagtgtactcatagttttctcaggttgtgaaatgtctctcaaggcatgatttagttagtaaaactcttgaggcctgaaacaatatcaaaatgttctaagtctagggcagacttccacagggttaccttgataattttgcagatgcaggctacaaggaacttttagagggtgccttggagaagagatggtaagacagagcattttgactgcttttcagctattttaaccgcagttgacaccagcattcagcataatatgctctgcaaactggatgttcactagtaagaaaggaaaggcagtattccttgctgaagtaagttttgagaatcctgaattaaacatgttatgatgcttttaattgcagaagttctcagtatctctaatattagtttctcatgtataaattgagtttttaagacagtgatagagtatgcagggtctccaaatctagttgaccaacagaaccattttctttcaaaatatgttacaagaccagcatttgctatgaagtatatacattcccttctgtcttctaaagcctttgtttcactattacaaataatatatactgcattcaattgtgcatcagaggctcaactgaacatagtggaaagagtctaggcttctaagagcccagagacttccctagaagttccacagaattgaagcattatttttacttattgattctatgtagatcaatgtcaggatgttgtgaaatgaatcatctgataggaactgcttttatggttgtgttgagataagctgaatcaaagagcaatatgttcttttgttaatgttcttagtgtcacaaagtatcagcagctgtatttgcactgaaaagattagttaaagacacacaaagtcaatattaaatataactgatctgaataactatgtattgagaaaacataatgaggcccatctttctttatgttcaaacttaaattggccaaattctacatcagaattttagaattaaagtcaaagaatatgtccaatttaggttcatattatagagcctatagtagaattatattctgaaaacttaggcagatttgttagaaacgtgtaaacagttagatatactgaaattttagatgcaagtaaatgatacgatgcatgagaaactccagaatatcttgtttaattaaagtactatgaatagtctttattctcaaataaaaccaatattatcctctcaacatacacaactttctttctttctgtagaatcaagtgttatgtttttaaaataactatcaattacattcaaatggatcttttctgatatgaaatgttctctattgggaatatcaaatgtaaaaacagttcacccctacagtttacttaaaagtatataaattaaaaaaaaaataacataatgctttactaaacaaaagtgaaaatggaagcagattatcttgtgataacaggactgtactcaaggaaaaagaatctgtactctttcttgttctgtatttccaactttttaaatgttatgatatctagtttgagtacagtgtatgtattacattcaattgtgcaccacaggctcaactaaaggcaaaatttgcacagcatctgttgacaggaaaactatgtataacattcctaacttaagtagcacttagaaaaaaaagcataaatactaatcgattttttttttttttttgagagtgagtcttgctctgttgcccaggctggagtggagcactgagatctcggctcactacaacctgtgcctcccaggttcaagcagttctctgcctcaacctcccgagtagctgggattgcaggtgcccaccaccacgcctggctacgttttgcatttttagtagagacagggttccactctcttggtcaggttgatcttgaactcctgaccttgtgatccacccgccttggcctcccaaagtgctgggattacaggcgtgagccaccacgcctggccatactatccgaatttttaaaatgtgtaaataaaataagctataggaataagatacagtggaaagtaatatatttacattaattatcaagaaactaacagttttactatacatataacatcgacaaaaaatacctcataattatagtacactagtcaatagggcagattaaagaatttctcctgatggaatagtttatggatacaattatagatacaattcagagagggtggatttagatgaatcttacagaaatcaattttattaccttataattatactacatataattcaaaaacttaaaatgtgaggttttttgttgttaactaagcatatttagttcactagtttgctgaatatatttttctacctgttttctgtttgaggaatacagaaatctacccctacctccacctctcaaaaaagtgagttatgaggaaaagcacacagggtggttttcatcttggagaatctgccattatttagggtctgggtctcagttttgtgggaccagaaacctattttttctatgtttttgagttgataaaattggataagggactcttgctgcataaattctgaacaggctaaggaatacatgccatttcctaaacgtataacaaaaactctggtggatcaacatctttctcctgaaggcaagccaatattaaatctgatgtctatgtttatgaagtacatagaatttgtagacattttcttaaaatatctcaaagtcctattaggtatatgttttcatcctgattttataggagaaactgagattcacggaagttaggtagcctccttaagatcacacagcagaggaggagccaagatggccgaataggaacagctccggtgaacagctccggtctacagctcccagcgtgagcgacgcagaagacgggtgatttctgcatttccatctgaggtaccgggttcatctcactagggagtgccagacagtgtgcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatcgcgctgattgctagcacagcagtctgagatcaaactgcaaggcggcaacgaggctggggaaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgggcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagcgtatcagcaatggaagatgaaatgaatgaaatgaagcgagaagggaagtttagagaaaaaagaataaaaagaaatgagcaaagcctccaaaaaatatgggactatgtgaaaagaccaaatctatgtctgactggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccactgcaaaatcatgccaaaatgtaaagaccatccagactaggaagaaactgcatgaactaatgagcaaaataaccagctaacatcataatgacaggatcaaattcacacataacaatattaactttaaatgtaagtggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtacagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcagaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtgttgatgggatgtatttcaaaataataagagctatctatgacaaacccacagccaatatcatactgaatgggcaaaaactggaagcattccctttgaaaactggcacaagacaaggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggacgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagccatggggaaaggattccctatttaataaatggtgctgggaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccgtcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacacgttagtgggtgcagcgcaccagcatggcacatgtatacatatgtaactaacctgcacaatgtgcacatgtaccctaacacttagagtataataaaaaaaaaaaaaaattaaaaaaaaacaaaaaaagatcacacagcaagtgaatcacaaagtcaaatgcacactgaagtcttaggcagcccattttgatatggtacttccaaactgagatgtgtaggaatacattttaagagaaaatatgaaaaaattatagacctgagactaggtgtgtgtacctggggtttttaaaactttctcattattcacagctaaggaaaggtcttttaaaaaatatctagtaaaatgattatttgaggattatctaatacacaaaaaagacaaaatttcaacttttttcacagaatttgtgggtccctaaaaatatgggtgagaaggtgggatgagaaactggcttaatttttaagtttgtaggagttggagtcagacgaactctgaccatacttattagctctctcagcttcagattcttctgtaaattgggatgaaaatgaccagtggtggggttgtcatgatggttaactgagataatggatttaaaattatttaacacagtgtctgccacagactaattgcctagtaaatagtaatgccttttatttggattccactgcaatgctgacatgctgtggagacaggctgacctacctccaatgtcataacgttgctccgtaagcgtggaatcagatgtagtctcaagaatccattgctcttttcgaagcaaactcagttgcattttgtgtgccagagaaatctcccttggacaggcttaagtgagggagtcaatacatggttttgtctcaatgattcccactggcaggttatggactaatatatacattctttaattacaataattaatgaattagttacaaattaactcaggtcaaaagcctagaacccttttttggttattcagaattgtgtttaagtctttgctctttacacttaaagggaagattgatgtcccaaataagtagtacctcatttcagctcctgtgcactaccctactgtgaagcctgtcttgtgtaaaagcatgtaaaatcaactaactatagctcctatttagtgtcataggcatggctggggcagggaaagacaatacaggagagcagatggagaaaatgggaaggtgatttcacatatgacttaagaaattacaagttaccctgcttttacttgccaccaaatgccttctgtcactccaccccaatccagcaggaactgaaggttcattaatctgtgattagattaacccactgaaaatttctgtgtttgcatgagatccatgatttttgcaagttgctggagaaagggacaagttagctgtgacttgtcactctagggaatcttaattagcagcccgttaatttgggaatttgtagagttcttttctcttagttgagcttatttcccagagactcttacttggggtcagagatttatgtttttctcattctaaagtcctagattcaatgtagatatttcaagtacaaaagcactacatacccagctgaatggaaaacggtcaatttaactaagcttataaggataccagagcaatttcacagctgatttagacccatagacctttcataccccgtttataggaaactcatagaatttaagagatgaaagcaaagtttaagattatctggcccaatccctccactatagagagactatgttaccagtggaatgagatttgttgagtacaggggccacatctttttcatcaatgtttctgaatgagttgagacatgcctgaagccctaaacataattgactagacttcaaaccttttgaataagtaagagtttcctaatcacactctactatatttcttgagtacatcatcctatctcactcagtcccaaacaaatgaaaatttaaatacaaacagattgtgtggcacagtatgtttcaacaaccaggaaacaggactacatttttcatttttcaattgtcagtaggtatgaacagtttcaatatgttaccattaagtgtataggagcaactcttgttcaagggattagtacaaataatagtctgatgaaatatttttataagaggggagaagatactacaaaattcaaacacaaatcagtctatggaaacaacacttgagagtcttcagcagagaatatagcccagaggtgccacctagtgactgcattctgctggctgtgaaaagcatagttaacatgggggatgagatttgtacatattaatatttcaagtcatctttaaatacataacataaatgtctattcataattttttctgctctgtcaaattcagaaaataaaatgagtaatgaactgaaagcctttgaaagccacaaaggcaaaaataaaaacataaggtatttatcaaagtgctttgctcttatgggtgcacacacatgtccttggttctaaataaatatgataaatagaatttctagtgtatgatgggattaaaaaggatataatacattcctgactccaccattgtattttagggttatattctaagatttatttttattcgaagcccagtatgtagcacataatatatactaggcaagggatgttgaattagtgaatgcattaatgcaaaaatgttatataaatccttgaatttaagaaatttcaagagagaagacactggcttggaaagtggacagttccaatttgtcctcactgtctactcaaccaggtatgatgactacctttgtgtctgagtataatctcattttaaaatcagagtaatcctgatatcaaggaagtttggtggtttaagtggaggagagtggtagcgaaagaggtaaggccagaaaagggacaaaaaaagtgctatgaatgaaatacaaagattggtgaaatgtcatcatttctgcttggtagcagaaattatttctaattaagtaaattttaagtaaataagtaatcagaaattacttactcatggtgtgggcctagtcagcttgccctcatgaattgtaaaatgggtagataaaatgctgctattttcctcccctctaccccccccttacacacacacacacacacacacacacgcacaatactttttaaaaaccaagcctaacagtaaaggtacagactcacacgctcctatgtgtgcttgcctaataactgtaatgccctgttgagccagatacaataaaaaacaataagtaaatgtgatgagtatttcatgaattggaaagattttgattgcctggctgcatgatcagaggcataaagtcctcttggccttatgcccacgagccagccaatggtcttttgaaaaccacaaaaatctttaagactcaaagtgtgatatgaaagatgtcatgttttgttgtttgtttaaatgaacaaaagatggttggttcacctcaggaagaaaactggttagcattttattaaataaaagtgcccaaacagggcctccctgataatcttcttggagccaatgagcaggtaagtttgggttgttgggttgttgtgaggatgggaggagccaatgagcaggtaagtttgggttgttgggttgttgtgaggatgttgggttgttgtgaggatgtaatttcatttacatatgcaggaagatcctaacataatgcagaaagatccttaacacatgaaatatttactgaatttctgggttgttgggtaagttgttcagactctctgaacttcaaattccttacctgttcatatattgtaagattatttttgagaagtagatgtttgttgaaaatactttttaaactataactcactttgaaatatgagtatgaatattaccaccttcaaacaaagcacaaaacagccttgtctatttgcacttgcaaaatatctacctagtttatttaaggtaaacaatgggataaagatgcaaagtcggctactgatgctggctagatgaccaggcagagtccaagcatctggatttctggatttagcgatttatatggcaacaggaaggctctcctgcctactaatattcccacaatgagcctgtttctaatttccatcattagaaataaattagggttaaataggaagcttcttttaaaatacaaataactctaggaaggtgcatatttgcaagcatgcatcagtttaacactgatctgctaataacaactggatgaaatttgctaattttggactacaggcattatttgtgatcctcagtatagcgagaagctctgggctaggaggactgacagaaaagcaaaaattagagggctcatattctaagtaattttaccttattcttctaaatgcaaaatcttcatttaaacaattttttttcattttctgtttgcttttgctatttcaaaattaaggccaacttaaaatatatgcatgcctacttagaataaccacaagcaagcatttgcttgttggcttttacagaatcctatgtccaggaaagaaactatttcctacatgcattattgaaagactaatcatttattagaccgaaagtcattaactctaattgtttcaagatttacttgcatttatgattctttcctgttatagatgccttctctaactatcagtgggccagttgggatttatattttacattaagatcttggagtcttctttttaaataggagtgtgtgtgtgtgtgtgtgtgtgtgtgtgtgtgtgtgtgtgatatcaaccaatttgataaaatattgtaaaattattggtaatatggcttgataaatataatcttttcaatgaaaatcattacctttttaatagtaaaatagttgcttataaacatttactataaaagtcaatattcaaatagcttgtactctaacaaaattcattacctgaatattggaaaaattcaaggaggcttggtaggttctgaaggaaaatattagatgtagaaaaaaggaagtatttgttcacctggtatggtttacggagtgatgaccatccaaagatgtctacattctaattcccgaaacctgggaatttattacattatgtagctaaggggaattaaggtagcagattggattatgattagctgactttaaaataggtagattatcctggattatccaagtaaatccagtgtaaacacatgtattcttaaatgcaaaagagggagactgaagagtcagtgtcaccgtgatgtgacatgagaaaaatttgagtggccatttctggctttgaagatggaagaggcacatgagcaaaagaacatggacagcttctagaagttggaaaatgcggaaaatagattttctcctacagctccagaaaagcacacagccctgctgacatcttgattttagtcagggagacccattttggacttctgacctccaaaactataagataatacatttatgttgttttaagccaccatatttgtgataatttattacagcaacaaaaggaaattaatacacctaggaaatcattcattcacccatccattctttcattcaacaaatcttatgtgtttcctaagtgcaaggcacaatcacattcatctaatcagtgttcagcctgtagggctgtcttttgttaacttctattttctttctttccactggtaaaccagaaataattaggtgaggaaaaaatttttcccttcctcttaggaattttggggggaaattctattttccaccagcctttgtttcccttcctttttgcagatatatttttgaaatgctctcccattataaatctggcctctatgctggacttgcaataatcaatgcttatttgacttaaaatctaaattataaagataggtatttcaattcttctaatttcccatccagctgaaatcctcctcacattaactcactcattcatttatgcatttatgcagtgagttcagttcttaccatgcttcactcactctttcagacactgtacagagaatgattttttaacaaggaacaaaaaacttgtttcctgttctaaagaatcttgcaatctagagttgtagcagacacatacctccaaatataatgtaaggtattaagtgttttggtaattgtgatgtcactctataattagacagtacaagatacttgctatatacttaataaggacttacatttataagtctgttttatgtatataaaacagagtaatagtaatcatcagtcattttaatacttatgctatataacaatcatttgatttaacatattaaatacttgtgattagtacacgtggtgcctgactttgaagcattgatctatatctttagtggcatgttactttgagccgagagtaaatcataagccaaatagcctaaaataatattttgagacagagctgaagatatgttaaggaagaaagaattgaatagtgagaaacagagattagaaagcacctacttttttatctttttaaataatgagcatcatattctaaattgcatcgtaggttttctgctatacttttatctggaaattaatcaactaattatggataattataattaatatctgaattcattatattcaggcatattaattggaatttgaaatatattctgagctgtcttaaattttttacactctaacaatcagagaataatggaagcttgattattttaaattaggaaaaaaccctacaaaccttaaaataagctttgtaataatagactttgcttgatgcctcctcactctcattcttacctttcttattacttttacagtattatgtctgcacagtatacacagtaatagtattctcctgtgtaaagtaaaataaaacactgaatcttttgttccaaacaacaggataaagtccaagacatttggcatgacatttatggtattttccccatctcggttggtaccccaccacccacagagagaggtgggagtcatccttgtttcactctctccctgtcctcagaatcaaatcaacaagtaagccctgatatgtttgccgttgcaataattcttgaattagttccattctctccttcctactatcactatcacatatgaggttttcatcatttctttcctggcattatataataaccttttctgatgcccgtcttattcacgttaattagaccttgatcctgactctcagagttacataggaagcctaataatcagcctatgcctacgggtaagtagatcaagcttacagcaaggaacacaagacccttcagtgatccagcctgtctactttctcagcctcactgcactttctgctcagtttacactccagaaattatttgaagtttccctcaaacacaccatattcttctatgtctctgtacctttgtccacattgaactgtttgtctagaatggcttttgcctaaactaacaaattcatgaatcacatcctctagaaagccttttatgatatttttaaagccatatctgagtttgaagagtgcattacacatatttctcttatagcacatattgtattacataaatctgttttgttttcatgtccctctcattcattgaaatgtgagattcacaaaaataaataatggtccaatcacttttgcatctctgatgcatggttcagtgtctcacacattcagatgctcaataattttttgagaactgacagaaaccacagaaggtgacttactcccaacttccaccagtttccctacttttctaaagctctacctctatgaaccacaaataagtgtgtcttccattcatccaccatccatccatccatccatccaaccaccatccatccatccatccatccatccatccatccatccatccatccatgggtaatcaggcatatgcatctggtctagtcattaagattttcgaattttgtttagtaaataaatagataaattacccaaccttcttgctattgtgtgattatttgatagttgaatattttcacccctctctattcccgaatgagttttattagagtacactatcacaatctatgagattccttttatgttctacttctgtggattacttatgggttttctaaagcattcattcactaatttatttattcacttatggaggaaagataatctattgacaattggacttttttttttagcatagaacttgatgatacaattttaaaaggttgtttattatcctatttcaattaccataggaaatgctagcataaaaagtatttttagaaacctctattatctataaatcacaagagagtgaatattggtagtaagttaattttggtagaaaattaattctgttttttattgtattgtcttctcttacatgggttttttaaatgatgaaagttagacacaacccaatgtaaagcaaacagtgttacgtagcttttgtcaggaaactaacttctgtattcatttttttggttcaaacgctttgctaagtggttcagcatttttgctgaaatcatctggcatacatggaagacctgctaaatactaagcactctattagataataaagatatagaaattaagtcagtttttacccctagtcttctacattttctaccattttgactttttaagtttttgcttgctatggtactcccatttcttgctaactatacctaatccatgaagattctgttcatatatgtgaagatttcccccaggcaaaattgtctgatttttctttagtatgaaactatagaatatatcatattaagtaatggatagttatacatatgcctatctcttttatagattataaacacctttaagataataacctatgctcctagtactcagtgcttgatacagctgttactcaataaagttttgctaaatgacaaactatatccttcacaggaaatagaaaatggatcttcctggggtaagttaaacaaagacattttcctttttaacaaaatacagtaaactagcaaagtgaaaaattattttctaagtacatgaatcagatagcatttattcaatttaaagtggaatttctttacataatatggtatcttgtggtgaatttaaataattcagtttacaaacattaaattctgttttttcaaaaacagttctgttgttgaaaatgaggcaaacatttgatgatatagctgtaggcatttcaatattggtttggctgtatgcttgctcagtgacctttggtaaaaaaacaattgtttcggttttttcccttgactgtcaacgggaactagattgtttcatagacttaaaaatgatcttaaaacacccataaatacaatgtgcttaatgatagccattttaaaatagtgacactgtacaagtccaacttaagagtctacattgactttttttggtttatttttaggtatagatgaatcgtatttcaaaactacttctccatttgtctaaagacacataaataaagcatttttttttactatgaataacaacagcattcagttaaagattaaattattttcagaataaaaatttttagttgatgactgctaaagattatttctagggacaaagtaaggacagatgctaggtggggtatttgcggtgcattaaacaaatatttaattttaatcatctgcctatagactaaaaatggtttgccgaattaatgtttattaaatgttttgaatctatatgaagctaagtgaatactggtaggactacaattttaactttttagattattagcttgatgctttagagataattatgacctaggaatataaaaccagcattagggcattattgtgaatttaatctagattgggaagttcagtcttgaattgcagggatcaaggtcacagactacttgtgtaatgtattcagacagacaggctacacaaagcaacccaataaataattttaggattaatagtttgttttaggcagagtagatacccttaagctcctttccactctttaaaataaaagtccaacataaatattaaaatacacttcgaagatgatctcaagaatgtgtttgtttttttcaaaaagtaaatagaaatgatttatgtcattgaataagattacactggtttagtaagagatggtaagcatttttagctcgatggccattgtccagaataacttatagtccagcacaacaattacaataaaggtagtatgaatttgctaattcaccatatatctcattcattgtgaaaaacgccccttacctttcaaactgagactgagactaatgaaagaatagttttctttcattcttattatgtactatatttcatagccttttcttgaataatgatgttaataattcaattttcattcccttcatttgaaacagattctgacttgtcaagaatatataaagcataagttatgacttcaggaccttcatttcttcagaacttatgatcataaatgatataaatccacttacttcaatctattttcagtgtgtccaatattttcataactatatccactttatctctgctttaactctctggcagtaatattaggaaatatgagatctgtgctgagttattttacattctctttttccacttatgtagaagcagtaaatggggtagtttgcaaatctaatatttattatctcctgaatacttttgtgagaattttcatttactattttcatttggataacattttttaaagctttgtttgaaacaactggaacttttagtagtttgattttattcacagagtaaattattttcccacctgcctttatgttcttttgcttagttatatattgccaaatccttctcctttgtatcttgctcagcagattgcacattcttttaaaagcttttgtttatcatttataccgctctttcaatcctgctataaccacatactctttaaatccttgcctaaccaaactgttccctggaggccttcaacaaattcacaattaatgaagggtgagtttcatttatagctgcacttgttttttatctttcaattcaattcaacacgtatttattaaatttccctacaataatcatttctaaaagtttatattatctttttttaaagactgtggtgctaagaaattcaattttagactatttttcacacattcatagtttccaaacatttaaccctagcaacaaattgaccaattctgggacataatggctgctgcttgggcattttagaagtcgtgccaacaattattatgtctcagagtgcttgaaaggctaagcagtccaaatttttgcctttaagcacattagtaaactttttccatatctgggtgtcatgaggaggtgtgtgtgtatgtgtgtgtgtgtatttttcccccaaatttaacctacacttctatcatactatgtactaggaacacttatagttactttaccaatattgacttactcaattttcataataactccatgtactaggtactatccttattgtacacccaccccattttacaaatggaaactctgagtatagagtggttaagtaacctgacttgaatttttttctaagaagcccaaccatggaaagatcttttgatataaataacatactgaaaaaataatctcactatacctattcccaataaaaccttttccaaaaacatgaagtcagaaaatatgctattactggatgccactaggtaccacttcttaaaatattttgcattctactattctttgtttgagtagataagaaaggtactgtgtccttttaatttatgaggacttcaaccaataattagggcaatgaccaaaaaaggaaagtaagaacttatctaatctttacgtcaacccatcaggtgacatagctatatggaagttacttaatatcctcattaaaagtgatagagaaaagaagatcaaaaagtttactagcaagattatgatctcatatgaacctgagattatattaatctgtagaggacaaaggcattagtaggaatcacacctaataagtctttataagttaaaagaaaaattagattcccatgatgactggttctaattatattaatatgacactcaactttgagagactaacccctgtaaaatgggaaactgttattaatcacaaaacttaaactttgtgtgcattaactataaaatgattttaaatagaccactcaatatgtttcagtttgagaggttatgaaaaagtattctataatttgaccagaaagtgttatattatgagattctttaaatatataatcatagacttgctcaaacatgtttcattttggggtgggggtaattcataatcatctaaagcaatttaaagcatttttgattgattacaatttgagatagaattttttttttcatttctaaaacactcagtttctcagatcagcaaatcctgttttagactaaaatttagtgccatttctggaatgagaggagaaaaaactatttaactaacttatacctctttatgtgtaggcagcaccaacaaatcctttaactcagcagttacaagaaatccctatgaacttttcaaagctgaataactttagcatttccactttcttctttaaatagccagcagccaacattcagaatgaactgctaaattcctatataacgagaaaaaggttgtttctaatatcaattgcttttatctcgatttcatgtcactcagaaatgttcacagttgaaaacaacttttaaaaacacacttaacagcaatggcctatcttttcaaagtatttgtggctgaattaggaacaatctgaaaataaagcccaacaactgaaataagtcctctaacttgatagtttcaagagaccaaaatctcctactataatattgcaagagtagaagtataggttttcccctagctattgttccctttagaagcactaaataccttcttgcttcataatgattttataacaatggaataccaagccatagtaaatagttttttaatagctactccaaaagccttgtaaactctctacagctctgtttgcaaaggcattgcagaagctaatcaccttgcaactattctacaacgtgacacatatttaccgcatatgccctacagaatgaaatcaaagacgtaaacttcaaatcagggtcagatcacaaaatccaacaggaggacatatcacagatagacgaggacaagtaacagacattagagcagtaccgcaagcatgcggcccataatcaacttggtttatttctataatgatgagaaggtcttgtttaatggaaaagtacccagacatactttgagaatgtatgtggatactgacctggacttgtgacaggactagaggtagtaggttcaataatttctacaaaaagggaaaaggaaagaaaagaaaaacattttgtgtattaatcatacataaaagacaaacactcatgagacaatcaacagtcatgcaacatatacacagatggtctttgatatgaagacttccctgaccgtggacacaattgaccaaaatccaattttatgaggtttacacaacaccccatcactgactttgatattaggccatctttcattctgaggcaacatttaggagtcatttccatatcctagactatagcatcaagctctgctgtgctaaggttaaagacatgcccttagaattcccaatcaacagtttataaggttttcttatagtaaaatattaaaacctacatgtagaatgtcttcctcttagaggatgtcagttccctaaaaagtctttcaatcatgttgtttcttaatatgttctataaataaaaatcattgataaagctcaaattgccccaaaataacttttcaaaggtaaaatctcattattcactaacatacctccaaacttggccacatagaggaccaattatatctgcttttatgtttttgtgtagaaagtaaatatacacacacatgcacatatccctatacatctcacacatatacacacaaacatgtacatgttttaaattacctggaatatatttgtgtgtctacaaggcactgttggctatgtctcaggcaaatcaaaggatatctgtgtcagtggaatatcaatataattttccagcaaatatctaacaaataaattctatggtattttaaacaatgtatatagttgtatttaagatttctatttttaaacttatcttcttaatagaattgtttcttttgaagtgttaaatgatggtgataataaaagtaccagtgatacaaagactaaacaccatcactggcaatgctaaaggatattaacaatttttcataaggaataaagcaaataccagaaaaacattgcatttttgagaaactctaatgtagtagcctgagatccttaattcagcactcatttcacataaataatctactcctttttaacttagttaataaggaaattctataatagtaagaaaaccagattagattcttaaaacttcacacagcgagtgtggcagtgggaagtaaaagcaaagattcttatgtaaaatcttgccttgggactctcctctgttcaactatgttcccatgacatacaagaaatgttgctgagcaaaaaacatgcaaacaaacaaaactacaacccctccctctttaaaaaaaatttccagtccctttggaactcttggtttttctctgaaaaggcagtggcaatgaccaattccagttaatagtgaactcacattccttcctttttagtcgaactattggtttgaataataaaaccctagtttagcagtagttataaaataagctgtccaaaagacatcttttgtgggtatgtgggagactaaagtttacatgtgtcccgttctgcagggctgattctttgggcccttttctgactgttctgggccatggatcatgctgcctagctgacagccaacaggatcatagtctaagttacaacagatctggcatgaaagaatatacttttgaagaaagatactctcaaatggaaaataattaattgcataacaagctacaattaaaaattcaaaagtccagtcatctatcagacattgcaatttgttgttattgagaagtagaatcttactaaggagagtctgtattagactacttaacgatgtgagaattattccattttccatttgcaaggatagcaattattatattcacaaataatatttaaattccttgtatgtgtcaagcaatattctaggagctgaaatcataggagctaataaaacagttagaaatgccaggcctcatggggcttattgactataaaatgtcaggtttcaaaatgtgagagcattcttatccccaaattccattatttataaaaatttaacaaaattttaaataaaaaattatatcagagaaatgatgttctaatgaacactgtccttttggtgggctagcaatagtctcttaaaatttttttgtgactattatacttttatttttaaaaatgaacttcaaaataattaaaatttatgttaaattagtttaatgctatataatacatcgtaatttatagagtatgcactcaaatgaaaacattttataattcaaaaaaatgaaagcataaaatggcttgaaaggtagaagtttaatcagaatatttattgatgggaaaactaaatttaatgggacagtgaacaggcttttctatgttccgtaacttggacatgtgatcttcaatttcctcgactgtttggctcccattgttttgaatttctaatgctgatttgagagttcattgaaaaagacgggtggcatacaactacaacttcatctcaataaaaggatagtagaaacaaatagctatcccaatgaaccaagctcttctttgtacttgcttatgtagagctaaattgcttatgtaaagccacattgtctcatagaaaggcttttaaaagaatacaggaatttactgcataaaaaattatgttgcgtgcaggatccactctataatttcagcttcacagtcaatccaagatttttttccccacgtaggccaagataaagtagaattcctggcgaggtaattttatgtaaaacaagaattgagaatagagaagttggttgagttggagattcatggttgcacacagggctagatgaggatgaagcagaagagaaaccaaagtgagatcaaaacaaagagatttggaaaagctggtgctacaggcagtagatgatgacagtcagctagattccttgatgtgagatagttcagtgagttagaaaggactcagataaaatagggatcagatcttaaacctaactaattatttcactgcatggtagaaagcaagttaatgaatctctccaacccctagtgtcgtcatttatctaatttggataacagttcctattttatagggtttggaaggattaaagacactgtactttatataaacaaccaagtgagagtgagtaaatgtagttatttcttattattacttatagaagtgaatggaaaaatttgcatatgaaacaatgaagaagaaattaagcagactgttagacttaagggaaaattcaaccttaccaagtagaagcaaagaagaatggcatgagtaaggaaactatataattaacaaaattctacctacgatgtagacattgattttttccaattataacatggtgaatatattgtgttttagggtaattatttgtgccatggcttgcatatggtatgttttgcttcaccaagttccatgttgaaatttgatgcccatggtgtttgggctacggaagtggatccctcgtggatggcttgatgaaattctctcaggagtgagtgagttttcactattcccacaagaagtggttgttgaaaagagccgggaatcttaggcctgctccctcttgccatgtgatctcttcacacactgggtccctttcaccctctgccatgagtggaagcaacttgagacctcataaatgcagatgctggtaccatgcttcttgcatagcctgcagaatcacaagccaaataaaactcttttctttgtaaattatctagccgcaggtattcctttacagcaacataaatggactaggacaattttgggagtcatactggttgctagaagataactatagaatccagagtatttttaacagttctgattcatgtaaaagtttagagtataaatttatagatcaagatcttaaaatttttgtgaaggacaaatgcactcctaaaatgggaattttgtgccaaattacaggcatgtatttttaacacatccaagaaatatttaaaattaaactttctccctttatatctctaaacagatcagaatgatcccactgacttaatatagtcaagctcttttgttaaagaaaataatgatattttattactgagaaaatacattgtaggtaatagttgaaactaactagagccaataaatctactatagatttccttatactattcagagttcattgattcagtatttcagaaactacttattgaacagctgttgtaacaagtcattattataattacattaattacaattctgagaattatctaactcctactatgtaacaaacacagtcctaaatgttttacatatattaattcatttcctcccctcaacaactatgaggtagatatgagcattaattccccttttacaaataagataatggggcacagagagattaaatatcttgtccatagtcacacatgtaataaggagtagagatgagagaaatactatgctaggatgtcttagcatcccattctctaccttccagaagaaatatcctattaacattcattatatctataattacttaaatggggacattcctatgcaagggatcatataagacttcagtactagtagctttttcaataatagggtctttttattaaaggtacctaataagtgagtagcttttgtcaccaaaactggaagagaggcaaattcaatgttaattcctggagatttctatcataatggactttgcaggacaaaagagtttacacacaattttccaatcttgttctcacattttaagccaacaccaaatacagctatctgcttctgtataagccttgatgccatagagggacaactcgtctgatagttcagaggatgttagcataacagaattacacaattaaataagcatcatgaacttgtaaacccttattctgttaaaacagtagtttaaccagaaattacttagctttcaagaactttgttgtttttatatggattggtttttgagctcctgttttgtcattggagtcattaacttgtaagcagtgaaatattcttcacgaggtgccaagtaggcttttctgatgagcaacagtaaaggtcctcagtgagattttcttatgggtcttattatgtggagaatcagagtgagcatgccaaggctaatggtggaatatatcactgtgggctatttgcattactgtggggaatgaccttagcaaagggatagttttaattgtacataaaacagaggtgaagagaagttcaccaagacagacattttcaatagttatgtgggaaaataaggtatcatgtaaaataacattttacttccttagtaaacgtaattttggccagatagaaggaaattccattaaaacaaggtattgaggaaaccatgtgttacaagaaggaaccatttgtaatggccctctctatagactacattaatgattgttttataactctgcacacacgatatattattaaaattgttcagtatcaaaacacttcatttctatgtattttggaaggttacatttggtttctaggttgttattttatctttatgttattatacagtagaggtgtgtgtgagttatcttttagactgttgagagataacatgattgtgttattgagacacagcagaaattaatccttttggttgccgtggtttcatctgaaagctctgactcccagtcattgtggagtggaagcaatgtcattttcacagtagaatgagagtgggttgccctggaatgaccaaggttagtgctgatgaagcctcaggagacaaactgtgagctaagttagacacagaaggcaaagaaggttacccttacttttcacctttatgagaaggcccataaagtatatgccaagcctcttagagcactggaatagcagaggcttcgtgcatggagtacaatttagaaatcacacttttgccctaagcagaagaaatacatgatctgtgaactttcatgtatttatagctaacatcagagtacacaagttgttactgtctaatacagacagcactgtcctggaagtcagaagactcagattccatcccatctggtgatcttaggtgtgtgactctaaccgaagctccagacttcatttttcttatacattactaataggttataatagttggttcaaatacttcactaggttacttttgtttccatcacatggttgttgtttaaaggatggtttagcatagtggttgataatagagtttctggaggaaacttacttagcatcaaatcctggctccagtacttaggagccactcattttctctaagtttgtgcaattattcaatggagataatgatgatatctaccactcaacattgtagtgaggttaaatgagacaatgcatacaaatcacttagcaaataagcatcactctataaatgttagcttattttctaattgaaattactttaaaatcatcacagcattatgaatatttcatcttgtaagtgactatcatataattcagccttaaaagtaatttttttccctcaagaaaaccatttctattaatctactaaacagattgccaaaaaatatttctgaatgtttgcaaaggaaagcctacgaaggaaaacattagctgcactcggccaccaaaatttcactgtgacttaacaaatgcacaagatagactgcatttattttgtagaggaagttttttgtccctacatgcagctattgtttggaggtgttcgagtagatgtgtgtatatgatggagtaaaggaagattcacagagggctaaggattacagtgttcctatacgtatctctgtatatatatacctccagtattcatttgaagaaaaagtccaatgtcaaaactaagaaaagatgcgtgtttattatcatcctggtaaatatcctgagacagtataaatattgccatacttaataggtcaaaactactttgaataaaaaaaatcctcttagttaatcaaaagccaattctggtttgagttagaaaaacatcgtttgtagtaaaaaagaagtactgataacaactggtgcatttctatgcttaataaaattaataaaataactttatacttatattcaaagttgctccaatatattttcctacctgctgagatttgaaagaatgatttggaagtattttggtccaggctatgaattacaaccaaccaaaatgtttatcccagacttctaggtatgtttctatctacttcagtaaatagagcattaagtcaaaagcgcattgaagaactttgggttttagtgaatatttcatacagcactctgaggctaaagactgactttcataattgtgtagatactaatctctggaaaagatctgatgagagtgtggtattattttcttccattatcacagaagaataaatgtcttagttttcagcaaactcacttggttttctctctaatacaaattagaatgtaaataaaaataaagggaatgtggtcaaggatacaacaagaatccaacagaaactgataggtttataaaagtccattgtattgatgccatgcaaagaaaggcagggcctagatacctggtaattaagagtcggactgtttatttccttatacctagaaaaccctcattactcctaggaactgaattacaacctgttagctctttccagttcttcctcatgtatgattatagagaggaatggcttttagttattgcttctgatttttttgttttggctggagtattgacagatctccaagggcttagcaaaagaccctatgctttgagacacccattccacagattaacacattactcatcagtttgacatgctgaatctaaaaggggatttggcaaattcaaatcggcactctaactaagacttagtcatatgaggtatgtcgttaatgcttggaatctgtatcagactgttaaggtattgttataaagaaatacctgagactgggtaatttataaagaaaataggtttaattggctaatggttctgcaggctatacaggaagcgtggcactggcatctgcttggattctagggaggcctcaaggatcttttatttagggtggaaggcaaaacgggagcagacacatcatcacatggtgagaacgggagcaaaggagagagagtgaaggtcggggagccacacacttttagaagacaagatctcatgagaactcactattgcaaagacagcaccaagccatgagggatccacccccatgatcaaaacacctccacccggccccacctccagcactgggaattacaattcaacatgagatttaagcggggacaaatatccaaactatatcagaatcagacagacctggttacaggtctctgccataaactagctgtgatatattttgtaggtcattgattgtaggaaaggttttttttaaaaaaagaatatccaagatgagagatctagcacagtgactggcatatacaggtagataccaatttttgtatctctcatttctgacctgggtccacaatttctgacataatagaagaaagcccttaatttctagccatgcttaggccttatttgagaagcacatattagacgactgacaaataaagaagctgaaaacaagtaatgaaaaggcagcttgagggtggaagacagatatccctggagtattggctttacattttggggatatataaatagtaagtcgacctgctgagcagcatgaaatggtctacaatggcaaactctctgacaacgaaggatgctacgggacatgcgttataggcattaaatgaagtttcacttcatgcagtttctgtaagccaggtgggtaaggacagattcaacatggaacagcaggaacagaacgggctgtcagaatatgcattattacagttgtctcagcgctgtacttgaagcaatgtagcagcaatgcagctttctgggaaaccaatgccagcagaaaaccaggcctgccaaagagcagctgtactattggctcagttaagaaaaaataccaaaggccaggagcaaagccatgaagggtgaccagggaggctttcctacagaagagctgttcgatcattgccacactgacaaatcagattattctggacttatttattcctttttcaatgcacctttgagtgtattccattttcctgacactattctaagtgctgttgatacaagagtgaataagaaattctctgtaaaatgtattgtaacggagaccataaataaaaacaacaaaacaattacataattgacactattggtgggaaatatggtaggaaatatgaaaaataagtcctggtggtaggaactgtgaaaaataagtccaaggtacttctatgataacactatggtaggaactatgaaaaataagtccaaggtgcttcagaagcatgaagccggggaacctctcatggtcaaggtgttggaaaaagcctctctgagaactgccatactaaaccttagtttccatattcgaatcatatgctctgtccaggctggtgacagacaacaccagaaggggaagtcagatggattctttgctggtacgagcctgttgacaagtttagcaacagcacattctgtactaggcaatgctgttgagaatatgagatgttgacagggcatgaacagagaggtactaaggtaaatgattccagctataggcagaggatgttacagcctgatgaaattttagagggcattctgattccatcagttcctcctattgagaaggaaaatgagggcccagcagatacagtgatatgcccaaatcatacagccagtatactgcagggatggaattagaagcctggccttttcactcccaatcgagtgacaatgaagaagaaaatctttgcaatgtttcaccacaacaacattactctaaatatgacaaatcagcaagagccaagtgtttttagcaatatgccagggcaggtggtatcataatgtcactcctatgataacctttgctcctcataactccatgatgcaatgagagcaagtgactaaagattaagagctccacaagcaatttttcctgatccaaccaattctggagcacatttaactttggaaaaaattgccactctcagactgacctgaacaagtacaactgtgtgtacgtatatatagcagaatgtaaggtgaatacatacatacacatacatatgtgtgtgtatgtgatatgacatgagtatgtatatatgacatgaaaaaccacttttgcttatgtagttcctgtctttctcactagactgtaagcttcataaagccaggaactgttttactattttattctcaataactgaaacagtcttggcaaatggtaggtactcagtaaatatttactagataaatgaaaaaacacatacacaattgcaaatatgtatgttttggtgtggacatttgtacattcttacatcatgtgcttgtgacaaccccccaaaatctgctggtaacaggaggattcatggagagtagtagtcacacaccccaaccaaacattttcatagttgatatcagatctcaagatggtaagagttctattacgaagtgccaataaaagcctcagcttgatctgcgtataaaacccgtcttaaaaagttaaagcagtttctattatgcaaattgaaatagtagagtctgaccaagatatgtgctttcctgaccatatcataatttttaaatgttttattctcctgctatttagttacaaaatgattccttatcaacagaaagaaaacataatgtgggagggcataatgagttggacctaagtgtgtcctaattgcacaattcactgtacatacataaaagaaatatgtgatttcagtaaagtttgattttagagaacaaactggtatcaaactcaacacatctaggttttgcttggtctagatcttctagtagatattaatataaaaaactttaatagtccccttaaatttattcatttgagaaaaatctcagttatgaccaagtcttgtaccaaattacatctttcagtgaagaaagtgattcttatgcctacaacattaaactcttggaaaatgaatccaggaaaaagcactaagtggttaagttggatagaatgtttagccattaaaaccatatgaggttttaggccttatatgaagtcaaaactttttttttaacattatttgtttgtttgacttccttgtcccctgcagctgtttatgaggaagatgtattcattgaggcaactgccagaaaccaaccttatctagatactgccttgtgaaatgcagtcacttttgagattttctccaacctgtaggctttccgttccttccagctcactaaatatttcaactatttgctgaaatagtatatgttttaggtgatatctgtttaatgtttatttatctaaatcatttaagtagtatatattttttgctaaattaatattagttttgcatcaaaagtgtctaggggcaagggtgataggagaaaaaacatatttttgatagaggctgcaaaccttgggtttgggaacaggtactgtcatttactagtttggtaattttggtctagtcacaaatgctttgagttccactttgtcactgagaaaatctaagtaatatctgcctactttatctaacagtgtgacattgagtaaattaaatactttctctgggctacagtttactaacctaaaaaacagggaaaataataacttgcctcatgaggtgattgtgaaaatgaagtaacttttgtaaagattttagtaatttttgtaaagatcttagtgcctggcacataaaaaacattataaagttagtattattattaatgtaacttcaacagattatatacactttaagtattagacagtacaattatctcctgtctgacagccccgtataggagattgttggtgagacaggggagaggcagtctgagtagctatggatgagatggtatcaatgagaatagtttataattccactgaggttcattttactttataagaacacagcaggtccagtggaaagaatggaaacttggaaatctaccctggttctggtcctgtggattgttaattctgcagccttgagcaacttaacctaacctctttccaggctctttcctcccctaaaactgagatgagtattcaggtttcctgagtgcctgggcaggtctcttgctatagcagctgattggctgctggcttaatgaagcatctcattcattatttcatgccagaaagactattaattattatatgctgagtgctatgttagatgactgagagataacagcctgccccccaaccaaaaacaacaacaaaaaaatgaactgccccaaagaagcccttcatctagtagtgggggagtggtgtggggtacaaggtcccatgctggacctagagaacaagtcccatatttgaaattcaggatctgtttgtctgcctttgaccagtctacagaaggaacaaggggtgctttatgcttcttaggtagatgcaacctacacacccctccttttttaggagtttttctggctttcatggcaactgccaaataggtttggtaggcaagaaatgctctcctgaactttcctagattggaggtgattaaactcctttggaagccaatgccctttgctgatttcagtgtgtcaatatccttttaaaaatccagtcttgtagattgtccaccatcttctatatcttctgtctttctatctatgtctattgtgctgtctgactctgtctctctctttctgtccccttcttgagacatattcttaactcttttccttttttttagctgtgtggactgtgatgtttttcagaatatgattcattgtgtgccaaatctctcaatatttctattttctatggatctgataagcgacaaggagcagggcattactggcagccgcctctatagaaagaactcaggcccgaggggaaaactcaggctgtgtgtagagaagtagcccattgaagcagaactctagcgttggtgaggatggaatttctctctaactcctcccatgcatatatttctatattttggatcctaattagctgtgtaattttggcaccatttgctactttcctctctgtaaaattagcaatctaaatatatgatatccatgatgtaatccaacttggaaatattatggctcaaccatttctatggttcaaatggttatatctgtggaaataaatctgtgtctgataaacagacaggagttaaaccaccagaaggaaaagtaatatttaggatttttgtttaattgacacaacagctctttggtcacaagtctttctaattacaaagttatataaccagcgttcagttatagttagtgtaaaggtgatttgatccaaccttctttgaaatctacatacataaggaatgtccatggcaaaaacaatttccagacacactcaacagagggtaaaatgaaaatttgacagtgaagaataaagcaacttgatgcacctattaattaatgcatttatctattcaaaagttgatggaatacccatgatgtgccaagtattatacagtgtgctagggtacaaagataaataagacagcatatgctttctagtgggcacacaacaaactatttaaaataaaaataaatataggataacataaaaacttaaaattttaccaaaaaataaagaaggcatataggtgtttaaaagtggtgatgatagtagtatgtatgcattgagtacatgccagacaaaattttaagtgatttaaacacattaacccttttaatattcacaacaactcagagaagttggcagtactattactatcatcattactaaagaaaagtaaactaggcatatggaaactgagtacctgtacaaagtgacacagatagtaagtgccatagccagagttcaaatccagagggtctggactctggagcctgtgtacttaatacttaagcagtgattcttataaagtattgggtaaggggtggccctcagtgtgactgagtagaaaagaaagcctgcaggacttgaggaacaagaacaatgtaggttaagacctgcattatctactgtcagtttcctatataaagaggtgccctattggttgccacctctatatatcttttctagctcctagtcaatcaggccgcaaatttagatggaccataatgaagtaaaagtagagagaggctggcaagttggtttgatactctaatcactgttcaagttgcttttgctcttatttttaaaacaaattttctaacacttatgaccttattgaactgggggacaattgtgtccaccaaattccttttcttccagaaagttttgatgtttttgtttccatatagctaaagtaggaagaggaaaactctttatgaatagctccctattaacctcttctaaatttctttctttgaatccgattttactgccaactccaagcaatagtcccttcccttgttgtctggtactgcccatctaacttgttcatttgtcaagagacagagacaatagactgggaagtatttgttaggcgataattaattggaaatgagagcatgtgtattttgcaatttagcaaagttaccggagtgaaaaagggataggctgtttctgctcacagtctattcttgtgtcttccctgttggagaggacgtcttctaaaacctggactcacaacattgcagctttaatgtcatttgaagaaaattagaaatgagaatagcccaccaaagaaacagaatagaaagagaaagatatttcgagatgtcaaaagatttacaaaatgagagattaataaataggatattctttcatatcagtgtggccccagacagaagtgaagatttcatgcacattttggaaaattgacctagcagagaaaaataagaaggcaggggagagcactgctttgccagttctatgcagccatggcatctgtggttgccagcttttgagatggctcccaatgatcctggtttcttggtattcacatcattgtactgggatcggtgtatctgaccaaaggcatgtgacagaggtgctggtatacaactttgctctgaattaaaagagtcactgcaatttgtgtcttgtgtgcttcacccactgcccaccacgtctgatcagtagcctggaagaaggctactgttgtgggcagctctatgaaaaagtccacctagtgggagactgaggtttcctactaacagccaccctgagtgatcttggaaacaaattatctggactgatcaaacctcagataactacagccttagccatcatcttgattacagtctcatgagagaccttgaattagaaccaccttggtaagccaccgctggaatcctgacccacagaaacggagatattatgtttgatgttttaagctgcacaatttggagatatttattatgcatcaaaacataactaatacagctccatcacttattttctggagatggggctgattctgtaggctcagggatcctttctgtagctggtaacatttctgctgctttggggacaacacttcactgtgataccttcacactaagtgaggcaccctccatgctgccaccaaatgcaaataattataataatggatctcttagaggttcagtcctgaaggctaaaactgtgctctacaaatttgtcaaccttcagaaaaaaggaaatgagatccttttaggcattgggctccaatctggatttgacttcagcttcttgtcgctgtttcaaagacatcttacattcttggatattcttgacgtttgaatcatgtgtcaagatgttgttgattctagtgatggcaacgtttcatctcatatgcatagcagattgttaaaacatgccgaggctgtggtgctcctttccattctgccgttcccaattttattgtcacttcagaaataaactacaacatataaaggagcactgagaaggcggctttaagagccctggggtagagctaaaagcagctcccttgattttatgtttgagccatctggtgcttacatcagctaccacttgttttcaaatatatattatttgcgactttgtagagctgaataacatgagcccctttggtacagcaaatattgtcaacgtacagtgatttaaataaaagaaagagctagtcatttcatatgagtctgtgtggatagaggttgatagtttccctgtactgagaacaggagagttcttatacttagagaagtgtctacaactttatccttctggacaccagagctataaattaaatgttttcagagaaaccatctgtgtctaggccaaaggctagcatttattgagtgcttactatatcctaaacattatgctaagcaattcaaatattttgtctaacctaggcctacatattagtcagaatacattagacaatacttcagatcttaaccttaagatctcagggaattaacataacaaatgtttatttattaccatgctacacgcatatttgtatatccctgtgagactagattaaccgtcttattactgtattatctggaaagaacaaaagttatctttgttcaacttggcggggaaagagagtgttatgcactggttcctccatgctttggcacagaagccccacgatcaaaattgctcaaaatttcattggtcagaaaaagtcacatgatcttgtctaaaatcttcccaagtgcctctggaaggagaggagagccaaaactggccaagcactagaatctctaaaatactttttaaaaaacatatttattttatagatgaggaaactacggcacagtgcagtaaagggatcttccaaggtcatttacctgagaagtagtgaaactggatgaatctaaacctgggtttgttaaaacccaaagccccatgctcttaagcaatgcatagagaattccagcagtgattgaagagaggtggagagtcatataatatctactttgccagaataacattatttcatggattctttcaaatatttatttcagatcccttaggtgagtgagaggagggaccctgtcagcaattgactaccattgaaagctcaagcttctagtatagagccaggcatatagcaagtgttcaacaaacttcagttgaaatctattgaatgcatgtctaatctgtgccagggcttacataccaggatctggagtgcacacttgaataataaggatgcttccaatgatctatacttctttcctcatttatatggtaaaatggtaaaagtaagctatgttataaatcacccattcctttatgaatttaacagtattgtgggacaatcatttctactgtccaagtccaaatggtggagcagacagtctttgagtttttttagcctcgtcatcctttgccactcatgtgttgtgaggagcccccaagttcagcacagattagcttctccatctatgatcatttcattctcattcttattgatataccttcccagccactcatagatattttcagttatgttgatctataaatggcataatattttacaattgacactatgttgtgtccttaagagtaccttcccttattaggtcccagtgctgccatttcctggaagcagcattcctttaaaggatctttcctaactcacacttgctcctggcaaggttcagagttgacttctttgttacttacccattttttttttcctgtctactgctccagacttgaatccagcccttcatgcagggacactaggatcacagatatagaacatccacactctcattcaggctgtaaacctgtgtaggcccacaaattcatactttcttccatatactaccttgtagccatggtcagcccctgcactagctcctgagaccacagcctagactagtttctgagagttccctcctaacatccacattctgttccttatctaaatcacttagtaggataaactggaccacaatttttccttggtgtaggaaaatctacccatagggtaagggcaacagtcaaattgtaggaaaggatttaaggaatttagtttctttctacaacactgaaacatgccaaattatgagcaatgtcgagttgggcaagctatgagataagccctacgtattcactacgtatacatttaagtgtataatgcatctcttaagaataacttagaacatctacatcatgggcattatgttgtctctcagaccagcattataagaagaatttagtataatatagtatggtactctacattgtatgctcttaagaagaatttctatgtatattgtttataagtacttaaataacattgcatattccatcgggattgccagtggaatttctcctagcttaacacaaaaatgcaagcatgattcttttacagtcatcttcatttcatcaaaaatgtgaacattaaaagtttctggaaaatatcagattccattaaagacaattatgaaagaaaaatcaaacatactttagttttggggtacgtactttcaatcataatttctcttactgttaaataaataatgagacaggaaattgagaaataatggcctaatgaactattcatatggttaagtgtttcgaaggcatattcagacagccatacatgtacatatacacacaaatgtttctagtatatgaatatgtacacaaaaaatttaatcaggtaaattcagtgtgatatataaaaacaaagactgcaaatcaggatacctgaggtcttgtcttttcttgcacttatttatatttaagatcttaggtaaattatttaactttgtttagacagctatacaatgaaaaatttaaatcagggaaaataatatatttgttagttttccctttcccacccgtggtagacattgctaatcaatcacagtgctctttcctgctggccaggatgtcagtttcaaaacccttttcagtattagggctgcacagagactccaattgatgtgattttatacctgatataaagtccattggtcatcctgggaagatgatcttaaatgtttcctctgcaatttcatttaaagaatacaacttcttttctattgaaagggtttggagcctaaaaataatccattcatattcatgtgcatagtaacaaaacatgggcccaaagtgtgaaaacttctatatctttaattaaaaatagtcttttttcttcttcttctttttagaatacgctatatattgacaaagactctttccttggtctaactagagtcaggcttctcctaagccctataggcctcaactttgacatttgtcctttttgcccctgcagcacccagctatagcaagaatcttgctcagttagtttggagagaatctctcactcttcatatcatcacttgatatctgatccaatacctaattgcttatcttccccaggtgatatgtaatcacttgttctgcctttagcaagaatattattagatctgtttaaccagacaccttccttaactctaatgttttcctttagtaatttttcatccactgattctcatcctgtggcccttctattatatatatatatataatatagggacactaggatcacagatatagaacatccacactctcattcaggctgtaaacctgtgtaggcccacaaattcatacttcctcccatatactaccttgtggccatggtcggcccctgcactagctcctgagaccacagccaagactataatacattagaagaatatattctatatatatagagaatatatagaatatatataggatatagtctatatataggatatattctatatattctctgtatatatagaatatattctatttctagaagaatatattctatattaggagaatatatatacacacatctatatgtatatatagtattgtatatatgacattatatattccacactatattcagaattgagctcagttccataatgaggtctctttcccttattgcactagttcctgaataaaatctgggtttactgctttaactactgcccaactctgttttttcttggactatgtaagtaggcaaaagtataatttgctttacagcatattctcaggagtattcagcaattgaaactgcccaatcccttgacaatgcagagaaatggcattgacaggaaaagacatttctttgcatttgacctaaatatagggacatatagaaacttttctattcttaaatttttgtaacacagattttatttatttgcagtctatttcgttccacagaaaaattgagtcaggttgtaaaaatgttaaaaaaaacctaggcaatttcctgtttctttcttttatccttctattattaaaaattctgctgagtatatactttctagaaataagagtatatttgaactgcatttcttactatagcatatgtttattaacagcaagtgccaaaatatcttaacttttgatttatatctagcctctttttgaatgaccagtctcatctctaagtttttctgtctttaaataataaggctatttcaagcatttcagaatgaataattaattgctgaacctgaaatctctctggtatcaaagtattaatgcctgaattaattttcaacttataactgttttcatttacacctacttccttggtagttatttaaagcaattttatcttccccgtctgtggcttacatgttaatgtatttcattttaatgaacactctttaagctgtagaagtaggccagacactatcagaatgtgtcatgagtggagaaatctgactcaaagatgaaattttagataaaaaggtttaaaaaggctgatacaatggagatatttttaattcacagctgagaaatgattcatctgaaatatattgctataacagtatctatccttttctaggaattaaacacagataatttcacatctgtttgtgcataattttaaaaaattttgcctgagactgtggttgttcacatgagccaacctggaaaaaagtttgataggtgatggcttttaaagtaatttgctatttgcctaaactcaaatttgtctgagtgtgtagatatagcacaaatatcttcatattattagcacacttctaataattacacttaagtacaaaatctttttcttatttaacatatttccttttgatgatagaaaatatcttcatcatagaacatttaaaaaataagagttaatagtaacttaggcttacagaaaagagttttttagtgcaataactaagtcagcatcctaaatgaagatccattgctttaattaatacttttgagaattaaaagaaataagtttgttgttttgctttcatctttatgcctttcagacatattagatactagggtaattaattaaataaaactgggtttatttctttataaataaatttacttaacattttagcccccaaaatttctattatagaacattgattgtttttctattattgaaaaactgggcactaaacaagtgtaaatcagacaggtgtcaatcaagtgctaatcatagataatattatttgctaattagacaatattatattgcacattggagacatctttttttttagaatggaatattagtgtaaaaatcaaacaatggtgttattctcttacactttatttagcaggggccaattagttacctatcagtaggctacctgttcggcctgggtgtatttttcggttaccaggatagagaatttctgtattaaggaagaatgagacacttaattgttcaaggggtgaagagtttgcaaccagaaagtcttatattgggatttctcaccctcctgcaccctgtttttgccctcaaactccaaaaaacacaagatagaatattaagtttctattcctgaataggatgtcttcacagaacctactctcctcttttttcctggtggaaaaatttggacattctagaataaaaactggaggtctaatttattatttctcttaatcaaagaatacattttgagcatcaagatcttgaatttcttctctagatttcaccaattaggttgctggaatccgaggtgccttgcaggtagagccttctggaagattagaatgagaacacttaaaggggacgctttagagcaccaaagtcccagaaatccaagaacctttaactcaagatcagtaacccagtgaaaaactccaagaagtgatccccaaaatactcaacggtcttactttttttccatcccttctgaaagtgctcattaaaaggaatctattttcctccaataaatgggtagttggcacagctgccttcctaaggagcagccacttcgaattcaatttgagacaatgagttactaactttttgagtaatggattgagaagccctagttggccattgctgccatgaatccccctcactcccaattagaaattgcctatattttacatcaaaccctggtttagaccgctagccattcttaaagctctgtaggcaggtaagtattcctttcataccaactgatgaattggtagtagatgcttggaggtagtaattgggctaagcagcaaagaattccaagaagcaacgtgtgttgggagagaggactgggaggaagaggctgcccacgtgccatgttacccttcctgccctatagggtaatttcctttctgaatcttggttcatgatcttacttgttacctgaaaatagacatttttagaacatttaatacttgcacaggatatataaagatggcatgcatgtgtcctctgcccataaggaggaagaaaattaacttactactctaaaaagttgataatttgataagagcactgctgagtatgctcagagcataggattagccactctcaatcttcaaagtgtgacattttttcaaattatctttctttcctaagtcactcgtgaacataaggtcagcaaagatccactgaaagataataaacactctctagtaagactgtatgtattccctctttgaatgtttggaaatcacttttgatacccctttttcgttttctgtaatccaagaagttgagaatatcttcaaatgtccttcactctcactgaagtcatttttccatccactggtccccaacttgttagtaacatacaggtttgaggaagacgtacttgagaatttcctccagatttttctcaggtttctgtttggtaatgctattacatatcagctagtaaatttagtaaaatgtattttctatgatgctatgtaatctaaaaaatatgaatatacttgccactactagatcataaaggatggtatgaacttctgaacttggtatacttagagaatattacttaatataccatgagatgtcatttactagacctcttcaaatgaaaataaaatagtttgaggatgtattctgagtactcagattcatcaaactttaatgcacaatagcaatctctctgttttgcaaggaaatctggggtttctctgctgccttttagcatttgaagcatagaactcacatttttatgaaatatttctgcaaacttttctgccttacatgtctaaaacaattggttcattagctagttaagagactggccagacagaaagtggaaaaagtttgctgaagagagaggtacacacagctcagttagttaaagagaaagaatttcttgaaggtctgaagaattaaaacaacatgaccattaagtcaaactgaatgctatggtttactcagcaattttagaagcgtttgctatgataatgtatatatcctggtgcacacattatcttggatatacacaacattctaagaaaatccatcaaagtgcaataatttgttattcatgctggcgacaatgttttcaaatgggtttttatctattttgtaattacacacacacacacacacacacatacacacacacaagtccatggagacacaaaaactcactcacactgccacactcagagaaaataaaacacaaagaaagagagagggagatttatactcccaaaataaaccgtggctgggagaggggtcgatatattctttttgaaggcagctataaatgttcaattaacctatttctcatgtcttttattatgaccacatatggtgacaaatgggcctaacaagaagggtcacagaacaacagatgtgtaaaatagcaaaatgaaacacctcaacagatgtaaaatttttattttgcgtgaagtgaataggaatgtggagattgcattttgcaaagtatgaaaatgccctcaaattagaaaggctatgagttggaatggttttagaaacattctatggatttatttgaagtattcatgaaaggtctttcccactacagccacccaaatactgtgaagcctgatagtctgtagttaaagatttagtcctttatggtagagatagttcatcttgcacttttgttttggaacacaaatgcctttggttggtagagcacatgtgagaaacaaccacaaaataactgaaggggattgtggagagacaggaaggcagcagagccttgaatcctgagtaagttggcatgtgagggcttggaactggtaatacttaaagagtatggcgaagtctgggaaattaggctttcttccagacaaatgttagctttgtgataaaggaagtgtgggagaagaaggatgtcaactttagagtgctttgaaagtgacaatgaacgtcatgcacttggagaaaataaatgtgagggagaaagcaagtattgataaaacatttctaatgtctctagttgtttaatctcattggactaaattaatctgctcattactttaataagacaaattccttatctcaagaacttttaactttttactttgcagtagctttagacttatggagaaactgcaataatgaagctgagtccctatatacactctactcagtttcctttaaggtaaaaatcttatataaccatgggacaattatcaaatatcaattatgaattatcattgcaattttcaatactaagaaattaacataggcacaatgtcattaaccaaactgaatatttaatcagatttcccaaatgtttcccataatgtcttttttctattccaagatccaatccaggatacggtattgcatttagttttcatgtctcttgatctcctcttgtctgtaatgtttcttcagtgtctttcattatcttgacacttggaagagcactggttggatttttgcagaaagcccctctatttggatttctctgatattttctcatgattagactcaacttatgtatttgagagaggaataccacagagctgatgtgcccttctttatcatattaaggatagattacattaatgtgtcttacttctggtgatgctaaccttaataatttggttaagctgttttttgtcatatttctccactgtaaagtgactatttttctttttccatactctactcagtatcagtatctactcagaacatccccacactcaaagggataggaattaagctccacctttataaaaatattatcaaagaacctgtgaacatattaaaattgccatagcaattaaaacatattcatgagggagatatattgaggatatactgatatcctatttctctttaaaatattgcctaattatttgaggtatcattatacgtcagcaaatgtcacctgctgcaattattataatggcgttctgatggtgtttctctgttccctcattcctttatttttaattggaattcttctggaggactattccttccatgtcattcatatatgtattcaataatttatatcagtatggactagtggatatttattttattctttcagttataatatagcaccatcaatatttgttttgtaccttaaattgttccagttttgtagcttaaattgttccagttttggtcacctggaggtctttagattgtgtctgtgtccttctgacatgcacctcatcctttcttttctttcttttttttttttttttttagcacttctttacatcctagcaccaccagatgctctaggctcatctcgaagtttccctgcccagccctagaattagccatttctccaacgattcctggtttctgttattgaggaatggtaatagagaccaagttctgggaactagttgcactagtcactactggggtgtcagtgcttctagacttctcagcagacagtgttagggaaggtatgtatgtataccagtgcatgtatacacatatcatttatgtttatttatttatcttctctgtgtgtgtgtatatatatatatatatatatatatacacatatatattcatgtgtatgcatatatatatgtatatatcaacatgacttcatattcatatctccaactccagtcaaacacctttatggttcattctagcattttggctttgcttatttttaatttctttcttaggcagttggaaagctaatttttattactatatttttcttatttttcaaccctagtatacatgtaatattagtttcagaactgtaacacataatctaatgagaaatggatttaccaattatgatacagttatttttaatctttagtcttacattatcaaatcaaaagataatttcacaaagttacttagatcagctcctttcttcctcatctgtttcagtatggttatgtgattcatttgttacacagttagattcatttctcagagtctgcattccatcttgtgtttctcaaatatcctgtttaattttttaaagttgcatagaataacgttctctttttgtgatgcacatttctatggattttgacaaatgcacatagttgtatatccactaacacaataccctgcgacatagttctttcaccccaaaagttcccagaaaggtcctttaaaagaaaaacaaattaaaataacactttaaacttttaatcaaattcctaaaacatgtatgtgaagtgcctgccaggttggactgtggattcactctagatggaatatactgtttacaggcaatctaatactcagcagaacaccatcaactgcatacacactaaaatctcttaaatcacaatacagtctacattatcattctggtaaaaaaaaaaaaaatcttcaggaattccaaatgctatgcgtatttcttgttctttaaaagctcccaggatcttagtttggacctgctttttcaaccttactttctcctagtctccctttgccaactatattctatcccagtggttctctaagtgttattgaaagaccagctgcatcatcttcacttgaagtctagtgcacatgattgtcaactacacagatattttactagtcactaagaggtcatgatgatgatgatgatgatgatgatgatgataactatatatgaaagtcatcgtttatgagaacttttttgttccttttatctgcaactgacaaagatcctgagagatattaaagacatctattcttatagtttccacttaaagatgaggaatttcagcttcagagattatctgtctcaaggttaagctaataagtagctaggaattaaactcagattttcttcttcaaatttcttaccttcccaatatctacattgaaatcctttggtgctatcaggagagaaaacaaataaaactgatgcccattatgtatgaccttaatataacccaggccctgtgtaattctccattatatatatatatatatatgtatatatatatttccaattaaccatcattctgtcaattctctaagaaaactgctatcagattgggatactagaactctgagatgcagaacaactttcccaaagtcacccagcatatttcaactccaaattgtgtgagcacaaattccctttctttccaatagaatcatactgggttttggttaaggtaattagaattactcttagctctcaaaaaacattttgtgtctcataaaagtgatcattttgcatttcttaaaagaccagccaagattctaaaagccattaaatgagaaaggatgtatgatatcctttacatagtgtgatactatgtaaaggataagcttcatatccattgtcttccctgaagtaggaaagattttcctggcatttgccttctatccctctgaaggcaagactaaagggaaaaattctcaaaagctttaagaaataatgtatctttttctgtctaggtagaactgggtttgaatcaggctccacttcatacttgcttatgaatttggacaagttatttcatgtttccgagactcaattttatgttctgaaaaattgggaaaagatttcataatgttgcattaaggaccaaataatatgatgtacataaagtccatagcacatcctaaccatgatcatgaaatcagatattagaagaggtaaccgtcaaactcactaaaccatttagacagtcccagcctcctgctagccaatacggagaccaaggaagtttgagaagcttatcataaacatgattaaagcaagcccctaacaaagatcaatgtcttattaattttgatttaacactcaaatttcaatttttcccatagcccatgttattatacatctaggtttgcctgagacaattctcatataattttaatagggcctacttttcctctaaaaatttccgcagtttggatgataaactatgagatcacactgcttaaaagggattttttttggcactcactagttctattgcattttgctctttaaagataagtagacgatacttgctgaactgtataaaattatgtactcacttgaatttatgaaatgccaatctcaagccaaatttgaagagataattgcaaaattttgtatcatgaaaataaaacagctattaaaacaaatagtcatctgaaatagaaatgtttagggtgctaagttttttatatcattgtttctccatacgctttggtattcaaacagctaaagacaaccataaatcctgaaagcatgaacattcaagagtcctgtatggccagatatgttgagttccagagtttttggggttgagcagatggcttaggtgtccttttagtatctgctctgcctgcatcaaaaggagaaaaaagtgacacagtattctttttagatctttctttcatgaatatgcataaatatagcattcatgaatcactgagatgtaggagactgttaaattgcctttttgctagagcttttttttttttttttaaagaacttatgagtcaccatacttttggctcaattgcaattccttttttagaggtcatttttgaatctgttccactggtggtatgtaagctggaatcaagtggaggcatgaagatccgctaataatgacttattaaagttctttatcttgccctgtagccaaaaacgtttctagtgacaatgtaggtgccaagggtttaattcagattgtcattaataaatggcaaagattatcgggcaaaataataataataagagacagtgaaaaggaaaaataaactttcttagtagaacttattctgctctgttacctattctgtcactatcttgataactatttgaaagcatgaatttgccctagaatctagaaagatcttatttccttctttaaaacactggacataaatcttcaggtattccttggtatttttcctggttctaaaatatgaagagcaaatatattacattgcttaccattaccccgtcacactcttgacaaatcttaataatctgggttttttcctcatctaatacctcatagtcattttcattccaacttgagaagcaggtactttcaattaagtggcactagaatcttatgaaatctgtaagcctttcctagtacagatttcctaaggcacaaggaagaatgtaattgtttagttctcaccttttaaaaatgtatgaaattacttggatatttagcttgttttcttttcttttatttaggggctgtgttctttcctttaaatcatttgtgtaggtaaaagcagtgatttgttcagcttttgctaggttattctgttataacagtcaaggtctaagtgactccaacaataaaatttatttcttgctcacgtaaacagttcaactgcagttttgcttctgttccatgtgtcttcctcattctaggaccagattcatatcacttacctggctcatattcttctcatggcagagggaaagtctgagacataaccattagtagttcttggagcctgtgctaagatgtggtgcacatcacttctgctatttcattggccaaagcaagtcacatgatcaccaatgtcaataggaagaaggccttgcacattatctaaaaatgggtataaatgtgtaatcctctcatggggaagtaagtgaatatttgtgaataataatagaatctcacgtggcatatatttgtttgcttataaaagagtgcttgttctccatgaaacatattggaatagagagagagaggactgactaccttttacttaagtgcaacaagataacagttcagatttcctgctgactctgggagatacttaatctcctggaaagacacatctatgaattttgcttgtaagctggcagataaatggccggtgcatgaacccaagatagggttgatttttccctcaatgtttttatgctgctttgcacctggactccatgagctagatcagagaaagcccacagagcatttttgcagaataatgtcataaatgcccacataattttaattacagatgaagcttaaatggataattcaaaatatgctccaatcatacagagggagagtaaattatcatctattattgactgaaagaactagaaagacaagtaaatggttgctaggccctttgctatcatttagagaaatagaagagcacaaaaatggtaaagacatgagcctgcagatatgtaagagaaagatttttttgtcgttgttatatttgtttttaacagaaagaagtttggaacaagcaaaagaaaagagtttcactgggaatcttgcctttctagtgtaaaagagggtgaagactttaataaataaatctagcatttgtgaactggaagtgatggctgaaaaaaaataaaggaaggatcacagagccctgtgaaagtttggggaacttgtcctagcaggttgacacaatttgacttgaaaatgatacactgttggtgtcctttgccctgactataggtgacagacgactggaacagaagaggcacactgatcggggaggaaaaaaaaaaagaccaaccttccactctatcatttcaaaacaaatatgtatttatgcttggaaatggaaggaaaaaggccaaaggtattctacatttttatcaaatgcctttatccatgcaacgcaaagctttggcattacctgcgagactgttagaaatgcagactctcaggccccagcgcagatgtagtgaattagaatctgactttcgcaagatctcaggtgatctgtttgcactttaaataagtttgggaagtactgatctaggatgagtagccccttgctaggggaatgcacgtatgttattttacattatcatcaccacatacactcatagtatttgtttccaaaatttaagaattagagaacttaatttcataaactgggaaaaatcatacatatgttaagtagtggattaaggatttggacccagttctgtgactccacaatctttatcttccccattctgctatcttttcttacatttatttttgtacccacaaaagaacaaaaaataaaagctctgcttcctttggatctcaattttttaaaagtcaaaacccagtacttcctttactcatatttcctccctgtctcaatcttctctcttagtgttgatatgtacaaagatgtgctctatacagtaagaaaacatcaaaaatttaatcgcaatttttgttgatagttcaaagaaataagaaaattttttataaatgactatgttttatcaattctggatgccagtcgtttttataaaattgtcaaagcaactagtatatggatatgatagactatttataattatgtttcacaaggataaaactggaactcacagatcatataatcattgactcagctataaaaagatttagagataatctcttcctgtgccctatgacattaggttactttccaaggtcacctattgcagagacatggttaaaactcaagtattcagatttgcagtgtagggttcatccttttctactatgtatcatactgcttcaaagaggaagttaagagtaactatcaattagatatcattaggtaagtacacaaattttgcatgatattttaaggcgaagaatcagtactgagatcctcttcccaaaccaatcaaaggcccatttattgagaggtaaccagataaaataaaatggttgtaaaccaaacactccctggtggttcctcgtaggaagccatgcttccccagcttcaagcctttctatgaattctatccaaaacagggttggatcagattcttactgagatcctacttgacttaatccttggcttggggttactagggaattaagacatattcaaaggaaaagaaaaggaaaaaataagcagctggagtttgtgtgcttgggtatgcttctatgtatgtatacacaatagtttaagcctggctaagacttttatgattcatgtcatttcttgtatacagacttcatctcagttcttagtggtttttcagtaacaaggtatttgcttagcagggaaaataagtgtttctccctgtgattgccaaactggtgttggtctctctgcagagcacatttcctcatcaagaactcaggccctctaaataggacagagcaacaagtattggcatgcagacaaaaacctgcagagagtgccagctgactcttcagtttcttcaccaggtacagtgcagagacagaaaaatgaaacagcacacagctgaaggaagaaaaggcacatgaaataaatatgatagatgcaatggagataagatattgaaaagcagagaataatattgagggcatcagtggaaccagactaggttggagaggataatgttcttaggaacaatttcaataggagcctttaatagatttatacaattctataagtttttctaaatttctttttttattttgaataatttgctagtctcttcttgctgatctatgtccacatgtaagtcaaatattgaaaatatatgccctaatttaaaacaatgtctgacacacagagaaggccatgtgaagacagagacggagattggagttatgttgccacgagccaagggacaccaacaattgctgacatctaccacaggctgggaaatgggcacagaatggattccccctgagagcctcccgaaggaaacaaccctgccaaaaccttggttttggatttcttctggctccagaactataagacaatgtatttctgttgttttgaaccacccagtttgtagtaattttttatgacagccctagcaaactaatatagatatttaggtgaatggatttctaataatagatatacttttaaaagtatcctaatttttaatgtatttagtcatgagaaaaatatatcaacaaactagggtaaaacattttatagtattttccgtatttcgtatataagtaaactgaggcacagagaagacagcaactagaaataaaattcttagctagctttttaaaaaagtgtttatttaatgttattctctatcaggtaattgctgtggtggtctgtgtgcatcttctcatttattcatagaaagactactcttcatgagataagtatttcagtctctagattaggtaacaggctagtaacagagttggatttgaaaccagagctgtctattctaagtccatgcttttaaacatgggtcagcaaaattttcctgtaaagggccagatagtaaatatttttggctatgcaggccaaatgatctcggcaacttctcatttctgatcatgtcattatagataatacatgagcaaaaaataacagtgtatttgggctgctgtaagaggacaccatagactgggtggcttataaataatagaaatgtatttctcatagttctgaaggctgggaaatccaacataaaggtgaattcagtgactggtgagggcccgttcttcaggggtggcaccttctggctgtgtccttacagagtgaaaggggcaaacaagctccctcaggcctcttttgtaagagtactaatcctttttatgatctgttcacctcccaaagggcctactcctaataccgtcaccttggggcttaggatttcaacatatgaattttgaggggacataaacatttagaccatagcaaaagtctagaataagatttctggtttcttgcagaaaattggaggaaaagagtgaaactgacagaagagaatacatctcaagttttagaccaatgcagacccacaacattcttttcttttctttttgttgtgtgtgtgtggttttatttttacctctatttccatcatattccaaaaactatctgcttgagataaaaatggattaagtattgcagagtttaaggcaattttaaagtgtatttttatatagattctgctatgaatgtggtagctgagtattagaaaaatgtcttgagggaaaactcttctaaaaataatatttctagcaaaagacagaaatggtataggaattggtaagcatttcctattacctatactttaatttaatagcctatgcttattttgatcacttaattgcatttactagcagtggttatttatatgtagctgcttttctgatttcatgatacttagaataaaattcaggtaaactgtgcctttgctctgctattgcctgatttatatataatagaaatatgtagaattcatttttctgtgttattcattctagatttcatcttataattgatttctgtattgttcagctcacaataaagtatatcagtgcaatatacactaaatgtttgtgtcccccctccgcctcaaatttgtatgttgaaattctaaagcctaacgtgagggtattaggaactggggttttggggagccaattaggccatgagggtggagctgtcatcaatgagattttgtttttttttttataagatagaccccagggaattttcgcagcctttttctcacatgtgaggatgcaaccagaagttagcaacctggaagagggccctcacccgaacctgacatcttaatctcagactttcagtctccaaaactataagaagtaaatttctgttgttaataaaccacccagtatatggtacttcttatagcagcccaaactaagacaatcaacagatgcaatgtataagttcaaagattcacaaaatgatagcattactcccatctattcaattactctgtgtatcaagagaaaagacttgtttattgtcagttggattattgacttccttagctgttttagtaaggtcattttattaacccctctatgaaatcggtgtattagaggccttttaaaacctccttgatgggggatacgcattccatatcagagagccctatcttaaaccacaaagtatgatgaactctagtgaagaatcatttctggtaaatttacagaccatgagccctgtttctgttcttttacctatgagagattctcttgacaaacagggagagaacttgggaaaagcaggaagaaggccaggcttccaggagtccctgaggaccttggaggttatccatgtgttccagatgaggagactcagaaaataagaaatttgttcattactagccaatcaagtatttattgaagttaccatgtgacaagttctggttgagtattgaatttccagtggtaaataacaacaaaaaatgtagaaatgtaaacatgaataaacacctgaaaataaaaatataaggaaaaaaatacacatatatacatctatatacatatattgtttgtatatatacatatggtgggtgtatatatatctacatatgtgtaaattatatatatgtgagtatatatgtgtttatgcacatataaaataaaattataagaattatgttttatatgtatgtgtgtgtatgtgtatatatgtatacgtgtgtgtgtgtgtgtgtgtgtgtgtgtgtgtgtgtgtatacgtatatattaaagtgtccttgcctcaggggcaatgatccttttgtaattttttttttttttttggagacggagtctcgcttcatcgccaggcaggagtgcagtgggatgatcttggttcactgcaacctccaccttccaggttcacatgattctcctgcctcagcttcccgagtagctgggactacaggcacatgccacgatgcccggctaattttttgtatttttagtagagacagggtttcaccatgttagccaagatggtcttgatctcctgacctcgtgatcctcctgccttggcctcccaaagtgctgggattacaggtgtgagccactgtacccggccagcaaggatcctttttaagcctatagaaaccttatctgttgttagggatattatataaatttcagaatcttagataaatgaatgaatcacttcacatgagaaaggaactgaaaaagaaagaaaaagttatcatctggtggtagaaggaggggttgaaagaatgggaaagaaggagtaggaaatagagccagcacagcttgagcttagaagagagaaaaaactctatttgagcagttaacatgaggcttagtgcatttcaaggataaataaatccattattgttgttgaaataatctggcatctcttctgtaaaaatatcctttaaaaagttcagtaatgatctagactaccgtttgggcgtttaaagttttaaagtttatttatttattttttaaagcatgacaattcagttttgttggggttacacatggttcttgccctcactaaatgcagaattcagatgataaatatctggtgcttagattttatttggtttacttcaggagagagctgcagtgtgacttgctggcaaaagaagacagaaagtgtcattatatgtgaagtcattgagggattctcttccttgctgagttgtaaaggggtgatttgaaccatgtttcaaatgacctttagaaaagatcagacacaagtgtggctcaccaacggggtcacttcatttccccctttgtgactgaagcactgggtttctttttcagtgttggtggttatagagtaacaatcactgaattacacaaaacaaggttctagcttcattttgccactaactagttttatgactgtcatctatgtacttaatttcttgatgcctatttccttaaaaacaacaacaaaaaagtttcaatgcaagataatttgcgaaccattttcttataatctgttgactcacagaggagttttccaaggggagtccatgatttaaaagaattctaggagggaatcatttaataaatttttatgtatttttaaacaagaagctgtttctaatttgttgtatggcttggatttttttgtacatggcattttctttgacaagtgacagatggttataccccaatgccacaggtactcctgtagaactataaatttgtcctccttgcttaaaactatagctcattgggggtttttatatatcttagaaaaactgcccatggtacattaactggagtgatatactgtttctgtatgattttaaaagaagtaaaattatctacatttataagttggaaagtgacatatggctactgcccaatagtcaagtctatcttttaggtataagatgcaatacaaaatcactgtattataagtacttttcttatttgttaatgcatacttccagtggtcaaattattttatgctacagttaaatttttccttaatagtacttataaactttgtttatactgggtccttattattattattattattattactttctaagaaaaatgttctgaaacgttactggatgtctctagccatttctctccataaagcacatgaaggcataccaattaaatttgttcaaacaagtcatcatagtttataggagaaaattaacataagttttaatcaaattgaaaaaatggagaatttcgcttgtagcttatgacttagtcaaaagcttttataactgttgttgttattgtgtttgtgtgattttatatttttcaattgatagaaaaaggcaccattgactgatgtctatctttgataccaggtatgtgagctaattgccaaattactgatgtctatctttgattccaggtatgtgagctaattaccaaattaaactgatggtatgtaagaaagtaaaagcaagttttcattttgaactctgcattaaacatagattaatgggtagaggactcagatatgttgtgaaaattcatattagaaagtaggacacattttagccatgaatagcattttatcatcacttccttcttattcatgaatatattttgggacagacatatctaaagttttctgaaagtaaaaatggaggagccatatgtgtttatttgcttcgcaaagcatattcaggaaaggcaccatcacattatttaatcactacaggactattctcataattctctgaagcacaagtacatctattatgaatcatagtcagatttaccatttttaaaaataaatagcagttttctatatgattgaccaaattgattttgccaagatgcaagtcaaacaaagtaattggctaaaatatgcaaaagcaacaacaacaacatcaccaaaaagttttcaaaatgttgctggcagcactggctcatgcctgtaatcccagcactttgggatgctcaggtgggtggattgctttagctcaggagttcaagaccagcctgggcaacatggcgaaaccacgtctctaccaaaaatacaaaaaaatttagccagacagggtggcatgcgcctgtagtcccaactacccagggggctgaggtgggaagatggcttaagcccaagaggtcaaggctgcagtgaactgtcatggtgccactccagcctgggtgacagagggagcccctgtctcaaaaaaaaaaaaaaaaaaaaaatctgaaatttgagctcattatgcacaaagcagttacttcacagtttttggagtatacattttttcaaaagttgaagaggtaaaaatggcacaaagtaatatgccttgcctcctttttaagctaattttcacacaatatcaagtataagactgaaactgggcagggctgacagacaattctttgttctgtaaatttataccatatttaggccatattttggagctttaatttttcaaattagctctgagtattagcctttgtcttttatattagaatactgatgatttctgggtttaaacgggctttatttagccctaccacaagttattcattagagtttaaaactctaacaagccatctaagcattggtgacccctctgatctctgttcctttttcttaatcacaactacagaaattacccattagtcttgcaacacatagcaagtctaaacaaaggcagaaagcaggctgttgagattctgggaaattctaattcctcctagggaagaggacaagtaaacagctgaaacgtaaggctctgttcagatcaagaccacgtcattatcatctgtttcacagggcttctatttctaaagtgagcacaaactcttaacacatacttattttcagtattctgaacagaaaataatatgctcaacaacagtaccctgcacattaactcttctcactattgagaaaagcaaagcatctcgtgttgccaattgctaggcattttatatcactgcaaagtcctgcttaagcattgatttccagcataggggtcagccatgtacgcgtgaggtctggaggctttaaatagcagacttgtgggtatatattcatttaaattcatctctatgtgttcaagtttattttgcaaatgcgtaagtgtactaacctactcgacgttggagttattactatggaaacaacactagttaataaatgcctgatttcacatatcattgtgctagacactaataactgaataaacatagcacctcggcttctgctttgttacctccttaaagggaccctagaagagtaatcaatgaatagtcgataaagggtgaccatttagattggcttcctaatatcatcttgaaagcaattttcagttactgtgaagactggcaaggaaagtactcctggataagcgtagtttaagaaacctccagaggcagaattcttattaggataagggttttgcagaaaattcccttgtgctggggagcttcccctcccacatacaaaattacatgatgacattgcctctggtttggaaacactgtaggtatgcttaatatgggtatggctattgtaggttcgatgttacactaagggaaaggaagcagagatctaggactggttagctacatgaatagaatagataaagggaagtcacagaggaaaattggggagggaaaaggaatgaatttgaagattgatacgaagtatgtaccactcagagaaaagggagtcagaattattgaatgttatgcatatttaatgctattggcaaaattgccatttttttagatgaattaatcaatgttgattttaggctaataccattaaatgttggatttctttatctccccttctgattccatggtcaccaagcaaccttctcattgtgatctggtgttctttacaagtctaactacagagaatgaatggctgatcctacagacttcaacaattttctgtcctcagacagtgatttatcataatgaattaataaaatgacttctgactttgatgtggcttctcttgtagttcattttaagaacagaatgagctgatcatgccaatatgaatattataaaccaagtcaatttcttattataaattaataaattgatattctagggtctactcagaatatatgttgtagtctcttatattttttagacactgtcagtctgtcatcatagtctgctaagtcctaggcagatgacaagaaagactctctagacttttgaaatcgaagcccagaatctagattatggtgacctaaaaaaggccttttaaggacccaaccagaattcccctaaaacctagctatttaatggagtgtggccctttaaaggatacacctaccatttttatctctatatatctgcagattattgggagacactcctttatgggtctcttgcactgctgcatgctttgttgttccctgttttgttgggaatgccaagaatgaaagacccaagtagaggataaaaagtaaatgcttttattcaggccatttcttacaggatgaagtaatgtcttcctctgagaaaaagagcaggcttacttactggcttctggaaaatactaggttccctaaactcaatattgttctcttgtaacagacactactgcatgtacacacatccataatggccagccatgctatccctatgggaactggggcttaggaaactgacacaaacatgttgactttctgcctattgtttttgctgtgagaaataaagttttatatctctgacccaggagtcttgtgttttctaccagcatcagtgagattgtggcaagctaacattagcttgtaagtagggtataatctcagacgctttgcagttattgactcagatttctacagtcttttttagcacagttgcaaaaaataaagtattaggaaaactgagttcttacctaggctctgccattaacaaattatgccaaagaatagttactaccttttctttctggaataatttcttccagaaattattgaataaaatgaggagaggagagagaaatgaagtaggtgatgggagtttatagataattagtgacttaaaaatagcattcatgtcttaggaattctttgttattgtctcaccactacaagatacagcacatatcaataaatttatgttctattttagcccaagggacttgggaacctcttagaagccttaataatttatttcccttagcccatacttattctacattaagtgatgtgcatatgttctgtgtatatatgatgccttattcggtgaagataattaacttctcattgaactcaaaatacataaaccatttggattatctctgggtccatttagttttaataattcttaggtccctattcatttggggtattatggaatgtagacatctttaggagaacaactatttgtttgttgtttgagacaaaattattctgagactaaatctgtaatgtgataattttcagggaagaagaataataggagaacgtggattgctcatatgtgttgcctgcattatgccactttcactcataaactcagtatggtgctagctgatctacagagagaggaaggaatatacatatctctgctaagggaggagctcatacaccctacaatctaaattgattaagagcctggtaatttatatattgcaacattgaaaaagtcagttgcttctgcctccaaccaaagcagtagagaaatagctacaaagcatcaaccttgacatcaaagaagactaacacacttgctgtgggaagtctgtgaaatttgagggcacagacaagactaagggtattgcccttccaaccaaccacagcagttcagatttcctcaatgtagctgctgtttggttgagagaaaacaaagaggatagtaagtgaggcattggagctatcagcattcaaagccttttctacttaaaaatctttcccagttgggcacggtggctcatgcctgtaatcccagtactttgggaggccgaggtgggtggatcacgaggtcaggagattgagaccaccctggctaacatggtgaaaccccgtctctactaaaaatacaaaaaattagctgggcatggtggcgggtgcctgtagtctcagctactcgggaggccgaggcaggagaatggcatgaacccgggaggcagaggttgcagtgagccgagatctcgccactgcactccagcctgggcgacagtgcgagactccggctcaaaacaaaaacaaaaacaaaacaaaacaaaacaaaaacaaaaaacaaaaagcacaaaacctttccctaatgttattaacaaattaaattaactgtattggaaggctactaggtttttgagcaaattgttttgtcaaagaagccacgagccttgtctgctattacagatgttcaacctttaaagagagttctgtgtccccagtctgcagcggtacaaaatgggccatgcaagctgctcagccccagtgctttcttgatatgtagtcatggagcatagtgtccaagaaacaacttccagaggacacagacaagagccacagaggacaaagaacttgagagttcttcccagagcacagaatgagtggctgcccatagagttatctaaggaacatactatactgctggaaaagtgaatcttgactcttccaactggcaggagctgatcattggtgtataaatggctgctgttttgggttttttttgttgttgttgttctcctcttctcagaatgagagtcctattgcagttttctggttgatattccaccatagtattttggggttgcgtatgacagaaaaaacaaaaacaaacaaacaaaaaacttattttaacccagagatcatcagacaacatgtcacattcaggctgatgaagaagaatgtgaatcactcagagattctagccctcagttatctagaatcttgatgaagaaaccatggttttctatctttgataggaatgagtgtgttctatatggacaaggaagggcaggcctagatatttgcatcacaaaggggtagactgtagtaaagactactggttttcttttcatatctatcatatccttttcctataataagataaccacaattttaggcaaagaatactagcgaagaacaaaatttctgacttcccatgcagctaagtgtggccatgtaggtaaaggccagtgggccataagtgtaagtgatgtctacagatttggagaagtatttataaaaggaggagatgagaccttttccttccctcttttcttcttcctacagtctgaagtatagatttgatgctttgaactgaagtggccaccttggaccaaaaaataaccctgggaatgaatgttacaaactggaacaaaaatcatagaaggggctatgtccttgatacagtgatgctattccaagtgctgaactgtctattgtgggcttccatatgagagaaaaataaagttgtttaagtcattgttattttgggttttgtcacttgccactgtttctaattctaactaacacagatgctttagagaagttgtctagaaagttattcacagaattgtaattttttttgtcagttcttttcaagtctcaaaggattttaatagtaatgaataaaaaatgataaattagttctcagaatattcctgcctttttggtggagggtctctaagcactttggttgaatagaattttaatggtgaaataaaatgtagatgaaataatttgcttttgtttctagacctttgttttagacattaagatttcagaagttattttaaagaagtcacgctataattttatagctttaagggatcacctaggaagaagcctataacatggctgcaatcttcaaaaagctgtcaacaatgttggaggagaagccaagccactctgaagtgagaaatataaacagaaacccagatgactatgtatctcctggtcttttagaaggggttggttacaatcaatacacatagtagtggccaggaagaactgaaatcaatattgggtgatttttaatctagctatatacatgcacatgcactttaaacagtcatttcaaaatgttataataggttccagattttttctgttatccatctatgtggtaatcagaccaatttctagtctgaaagcgtcctctgtctaagcttgtctctttgctgaactctcctttgtaaacaatgacaataacaacaacaataacctaacataatattttccaaaactgttaaaagctaggcctatctcacgttgaattcaactattgttaaatcacaaaagataataatgttgtcctttatatttgaagataatgattctgaatcaccatcagcagaatacttgcttggagctattttttttcccagtactgatacacactctctctgaactcctgaagtcatgattatctgtatcaagatatagcagtgcattacattctgcctttccttattctctaattgagcctagatactaagtctgatcttacaggagccatactgaataaaggctgcgatacttctttcctaacacttctcttttctcacacccatcagttagtagggtataatacacataaacatttatattatacttgctgattaacagtgatgctggatttgtgttaagccatctcagctctctcatcgtgctcctattataaccagttttaagatggtaggctgggactagagatgtaagttattagaaatgaaagcaaaataaaatgaaacaaaaaacaactaacatgcaaaggcaagttcttctttagagaacttaattcttcattgatctggggctggtgacagtatatactatggctagtaattcattggatagaacaaactgtagctgaattggtaaactatctttatggggtgatttccaggtcactgaaatcagttttaatatttattaatcagctgttatcatgccattatcaatcaggcaattctctaatcacaagacaaggtgttatacatctatatagaaaagttcttaatggattcactcaggggcaagactatttaacggtattactttactcagagatgaaagattttgctcataaatgtctttggggggcttcttgaaacatcctgtataatttgaaggaaagggagattagatcaaacacatatggtatgaattaatgaatagactaacagtgtactagaaaaaagttagggaaggttatattagaaaaaggttaaatatttcattaaatagttcagtacttattatcttactatttgatcagcttaatagatcaacagtgaagtaattactatttctttaagaaaaaattggcacaagcatatctgattttccagaaatatataaggagaagataaataagtacattgaggaatatcaaaagtcgtagagaatttaaggcagagactaacagtaggcttcatcttagtaactgggataatttcacatgcattatgacacagcttacgaaccaaagcattacagtattctggtaatcactgttcatttgtcactcacattttaaaagctagcaatagtatatgaaaatatgtttttggctcatatcatttctgctacatttccttgcaagtccactttagaagctagcatctgcctttcttttcacccagctctgtccacttcacctgtaattgccctctgtgttccagtcacatgggatttctattattcacttatattagtcattctttctatcacccctaagaattaattacattttgtgataattgcttgtgttgccaaaccccttttcaaaattgacaatctccaaaatgttgtgaatcaagttattttagctcaactttgtattcccaacacagcatgagactaggcatatagataataaacttaataagtgaaaaatgctgaagttttaagattatgacattactggttaatcttatgtcccaagcatgcagtctacaaatgtgttttcttcctttaaataattaagaagaattggaaaacaaaataatacaactacttaagttttttaatacaaaatacaaaataatacaactacttaagatttttttttttttttttgtagtggagaggatgatatgaaagggaactgattccacctatttcaaagcagtttaacatatagattcctcctcccctgattctagccaggttagaggaaagataacaatggatttggaacctattgtgatgttaatgtgtggcttatttgccctaatatatgaatgctttttatgaccaggttatatgtttttctctctggcttcatagaattaagacattgcaaaataagcatcctctgaggtctcataccttaggaaaaaatgaatgatattgcttaaaatctactgtggagtgggaatgaagcatagtaagagtcagttgtaagaaagaattggtttgtgttgcagcaaatttaaacaagagatgtggcacacacatgcacacgtatgctcattgcggcattattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcccaagaacaaaaaaccaaacaccgcatattctcactcataggtgggaattgaacaatgagaacacatggacacaggaaggggaacatcacactctggagactgttgtggggcatggggaggggggagggatagcattgggagatatacctaatgctagatgacgagttagtgggtgcagcgcaccagcatggcacatgtatacatatgtaactatcctgcacattgtgcacatgtaccctaaaacttaaagtataataataataataaaaataaaaaaaaagaaatgtggcatgcatgtgacaatatttaggtaggcatgagtttatcatagagacaaaataaaatcctaattttgtcagaggtcattatatagatttggagatacagaatagaatcattcctacatcaaaataaagtgaagaaaattatagaaataatggggggagggcactgaagttatataagaggataaagaaaggccataatgtataaatccctaccaggagccaggcactttatgtctatcttacttaattcttccacctctatgtgagctaggtgttactcctttaactccattttacagatggactaattgaagataagtgaggttatgtaatttgtctagagtcatgtaggttacatggggagaaattgtgttctcctttatagccattcaagtagatagtggcatgctaaagctggcttatactagcttttaaggccaattgagaaagttttagaaattctgcgatttatttattaaatacagccattattaaaattgaattctataagtttagaattaataaatgatactaaacacaaatgcaatagctattcaaacctcattacctccaaattactttactacagtttactattatttataatcttgaggttacttgcatccctgtgtctgtattgtagaaatattataaaatggtgtgtgatatggcacatctcttcccaactctgcattcagtaacatcacttggtagcttgaaatcagccatggtgggaatgtttataccatggaaaccggcaaatggtccaagttacaggttgatttattgcttagttcattgtcgagacttaagaaaatgatgaagtgaatattaatagggattaaacgtaatgtgtcatgtctgtggccattacattaatgtcgacacaaaaaattggggaaattttcttgcagtattccaaaactattctccgattcagcaaaaaagttgcacaggttattttcatctaactcattaccacaaaaatatcatgtcttattcgagttagaataatcctcataggtagaatacagctccatgtggaacatcatgcatgtcacatgcatggattataatcatgggctggttacagatacatgattctgccaaaaatcagtgaaagaatctgtgagaagcaactgactatatggaatttacaataaagataattgcatattttcttactatttgtaagtctcattatacacaattttttttttttttttaaatttgagaccgggtctcactctgccgtccaggctgcagtgcagtggcgtgttctcggctcactgcagccttgaccttctgggctcaagtgatcctcccacctcagcattccaagtagctgggatgacaggtgtagacaaccacattcagttaattttgtgtattttttgtagagatggggtattgccatgttgcccaagctggtcttaaactcctgggctcaagcaatccatctgcatcagccttacagaatgctgggattacaggaccaaggcactatgcctgacctacacacatcctttacttcagttaaatatttaacaattcaccactaaatgtatcatagtgaagccattaaaatattacttaggaagactgaataaaaatatggagacatttttgcaaggtatacaattgatttttttaatgatattgtaaaataaacacatggagatggtatggttatgtgaaaatgaaagaagttttgtgaggagggtagataatgtacaattgatatacagtacaaagggaaaaactatagaaaatataagtgtttaacaaaagactgttatgatgcagaaaagcatcttgtaatgtttcttcatgccaatcttataaaatattttggaaagaaagggagggatttgtcatagaatacaatcctatacagacccacagactattattttgcttcataaccatatatatatttttttaacttttgcctctagaactataaaatggagtgtgtttctggcctttctctctatctaatagcagcatattattttgccttattttttctcattaattttcatttcctctaaattttagtacacatatggaaggagcagatctcatcttttcaaagtcagaagagattctctgggggaaacaaagttttctcaaatcaaaacaaatatgaaaacaaggaaacaaaatatgctttgggcagccaattctgtgactaagataatattttaaaaaagtaatcctgcttttccccagaaatgtatgagaaaatctttctgcaaatttcaagcacaagcaagttgcctcccaaattggccatttgcactccagggctaaagctgaaagcgcacagaattgcctgagtaattcaattgcaggcagaatcaatgcaagtgtgaacgctgccctggtcaaaggttggcccttaggctgcaacttaaatcaattttgggtaagctaagtttgattacattttcagtgatgaagctttcaaaagcaattttgggcttccctattcagaggctgtttggttccgttctgaatctatactcctggttagagaagcatctatctgtctcttttggtgatgattaagtcctggagttgaggagaaataagaggaagaaaataagaggaagggatacagaaagtaaaaataaataaataaataaataaataaataaataggtgagagcctatcactaatgtgagtcagtaacgtaaaaaaaactttaaaaaatatatgactatcacaacaataagacagggaaaagaattaaggaggatggtaacaaggaaacgaaaataataaatggaagatttatcatgatggtgatatgtggcagcctaagattattttagcatgtgaggctcattctttcaggtgttgctggcaggaagaatgttagagaaatacaggtggttctgcagaatgaagcaaaatgggtgtaagaaaggatgtcaaatatggcctccaacaggcacatgctagcctgagagaaataaaccctttcaatttatccttttccagcagagtcaagcctgcagagttgatgtgcatctatcacttatgcaagtcttcctaaaaaatgtgtttacttagttaatgttagtcagtttgattatagttattatctacagtttgtatgcatatcataaactaagtgctcccaaggagttataatttttttgagaaaatacaaatttccctatagttatggtcactaattcttagagcaaatactattattctgcccgttttaggaaaacatatatgttgttactcttgtcttaggaagtgttttagaaaacttggaattcattctaagtggactgattagtgactttaatggttcttcagcaagaattatgatctgcctcactaattaagcagctccacatatgcactaattggattgactcaaagaaaggaaccgaagattatgcaactatctaaaaaacacatttgagagctaggaaactgaagttgcttcatttctttaaaactgttgaaagagaagtgttgcttaaaaataggctaaaattcggaaaatccaacctactataaatgcctggccagagcataggtgaaataacatttccatgcaagcaagtctggcttggtttattcaaatcttgtctaactatatactgggtggatagttaatttgtatctctgcagagaaatcccaattgaattacatttataaagaaaggaaaccctgtccacactgaatagacacattcaatgaggacatgccattttcagtcttttccctagcagttttatggattctaaaactgaatttagagtgctttagagaaagagtggcccactgaaatattattgctttcacagttaattcctcctctttttacctttatctggaacatcagaatggccaaaaaaagagccaatttcaatttactttttcgtttagtggagtaccctagtaactatgtttcactctgactaaagagaaataggaagtttaatcataatgatactcagaccttcataataatcattttgttcacacgtattcctggatcttttattaggggtcacatttccattttcagagaaagaaatcacagcacagaagcgaagatgatacagtggcccagactttgccaccttattacgtgctcaaaccattggatcccactttagatggagtcaaaattacagggaacacagtgcacgcttgataagtatgctccaagaaacttctcagaagtgctgggaaagaaatatctcacaggacctccaaaaggctttgtaagagaaaagatcaggaaagtcatactgaagaaagactctgttaatctgttttcttttgactggaaatgttggcatgttttcatttttacaaagtcctaatagtcacaacgccatatactcaagtcacattttggcctaattagttataggattagagctgtgtgaaataaaatagcaagcaagaatgtctattctagtgcctttttcataggttactggccaaggttgttgcaactgtgaacataaaggaaatttctctggagagtaaaattctgtgtagagatgacaaaatgattaggccagcagtgctcttgagctaagttttatggaaactcactacagagacaagcacattaagatgcatttttttgtcgaataaaaataattttgagttcaataacaaaaatatacagaaggtaaaaatattggcagcacttctactttgttaaggagtaagtttaactttaaaaaataacaatcaatcaatacatactatcttttaaacatgcatagatttcttaggatctgaaaacattacagctgaaaggtaacatggagactagttagtctagtcccctcatattataaattggtatgctgaggccaggcagtaaattgctatggagctctccaatttaaggccagtttgactccaagggtagggcttctagtaaaattttgtgattaaattggaaactctaatttatttttctatgtgtttttggtacctaatcctcataagcaagccatatttcaaggctgatcaatgacaacaccaaataccaaagcttcctttcccttccaaatttactgaccctttgtcagctgtgggaaatgtatgtgctgtaccagtagcttgaagatgccactgtcaaattgcctcaatctgggagaaacacatcagtagagtaattaatcttgtacaacctctccatctttttttttttttttttttttttactcattacaagtgaatgcttatgtgcatggctgatttaattaataattgtaataaaaaggacaatatcataatgatatacatagtgcattaacaaatgaatcaaaggaccagtgctgctaatttgtctatccagtgaaataaagttacacagttattcaggttatatagatctgtgcttgcctgtgtttacccttcaacatttgaattatacatgagaaggacagaagaggaaaccagcatttaataggcacttgttttagactagtagtgtattggccattttgcatgtcctctcatttaatcttcacaataatcctataaaaataatttattttcccctattttataggtcaggtgactaaagtatctacaatccttcatgaaggattatagttttaacttggatctgctcgattcaaagcttttggtgttccacctgtgtagtgggaaaagcactggaacaagggtagtaaaaacgaaattctagccctagttatgttgcttgactttggtctctgactcatcctatttgggtttcagtttcctcacctataaagtgaaaaaactggtttagacaagaagttttcaaaacaaattatttggaactgtatgacaccttgagaggcttcaaggccgctatgtaatgtgatgggtaggaaaataagatttgtctccaacttaaccaaactaactccagttttatctttgttatacattaagagtttgcataggttttatttggaggaataaagggtttcattgcttaagaaagttggaagaattgactatgtaaaatctgagacatcttctagctccaatttctgtcaattgacaaacgtaactaaagctccgctaactgatatgtggttttcactagaggcaatttggtgacctggagcaccataaacttcaacagtcactctgactgcttcagcctgctggttatcgtctctcccatatgccactaaatgaccatttggtgtctatcttcttgaaaatacatacatgttccaggtatgagattgaagaggtaaaatattctcttgctttactcatactacacttcagcaaatttgtatactttcatgacttatgtgatgattatgtctgtgtgtgttatttttgtttggtagagaacgacttgataggcctgtgtagctggatcaaattctgcctacaactgcaaacctaatttttgtcaaatatttattaccagagcaccaaggaaagccttctcattaacatctcaaagctgcgaggataaagcaggttgtctcacacagcactctgtcttcaataatcaccaagtctaaatttattactgcctctttcaaccaaaatgaaaaccccatctcctttaagttgcaagaggagagataaatttctatctaaaatgggagtcattcacatctgtggtatcacctttcagggttcattataataggtaaaagtaacagagcccatacagttgcttactggcatgtgggaacatctgaagcaagcagagagctgaaatattacttgcaaggacacagctagtttcatattcaacaaatcagttgaaaggtactgttcgcttgcatcggttgaatctaaccagggaaaaacagttacattactctctcttactttctccagtagactcttccatttccttttggatactagctactgacttcttttttatctgaaaagaaaagaagcccatcacattaaacaggctgggaagaaattttctctgatatgaaaggagacattccagaaagttaaaaagccctgactgcataaagcatttaaaattgggacttcattattgtctccacaaggctgctaaggcagggaaaagacagttttgatcggtcctttgaatgtgttatgtgtaatatttctgagacaaatgctttgttactttgaataaatgcatacacgagtacacacacacacacacatgcacacacacacacacacacacacacagatatccctatagcatcattaggacttgtagaacctatactacagtaaaggatttgacactatatttttaggtacacctgagatgggagtttagcatccacacatcatagcaatattatcattacctattttgggactctaagcaatgagtcttcatcaatagtgagactcaatttgtaccaaatatttccatatattaggtctcaggagagggttgtattaaactaaggctgtgtaaattctaagcactttgcttatgcagctttcttccatcttaattaattctatttccctttagatggcaagtctttgaatacgtgtcttataataaatatttgtacttttgtggaagtgagaaacaaagcgtgtacaacatgttttacttatagaaataactatgttttactgattactgaattcccactaaagtgatagcatacatttgatgaattgaacccatagatggcaggatgggaccactcagttcatagtctttaaaaaacagacttggaagaaacatttttttagttgctcatgttcaggaagcaaaaaacgcactgaaaaataacaataaaataacaaatatctttgaatccccaattttttatttaataagaattttgctatgaatagttggcatactgtcatccattataaattttgttaaagcacttcattcctgagggctaatatacagtgatctgcacaatattctctctgcctttccttctcttcccttccaattttgtactttttacaacatagaaatctttcaggaatttttggacagagaatctagaggatgagggatcttcattgtatactagctttcctgtagtttttccaccataaagtttgctttctctttattttagaaaacatacatttttaccttaagtaatttaaagtaattctattgatgaaattactaaaacctctacttaaaattataggtcctcttacaattactgcctaaagcctacaggccatggaagataaaggggtttaagttgtcttcatgttaaatcaaaacttttgcttatttccctcgcacccaaagaagatttgagaaagaggcaaacaagctgaaaatgatggagacttgcagaaaaacagaaaacattgcaagttcactatagtatagttcatcaaatgttagggtgttgtatctttgcggatcagggagctgctcatatacacacagccattgggcctattaatcagaaagcaatcctaatcagaccagcagctagacataaaggcataacatcagccttgtcttcttcttttcatagcctaacctctgaaaagcgcaatttattatccatgtctctatttcctcatctatttatttaaccttaatccacagaaatctggcttctactctcagttttacacagaaactgctctggcaaaggtcaccagtaactaactgcccaaatgtcagagacagtggttgattttcagatgttccctgagtagacgtagcacaggacagtgctgactcttcattcttcctaaaatgggctgctctcacagctttcacagcactccacagtgctgaccctcctcaggcatctccatccacactgaatttgcttgcttctgcaggatgcttctcttcctaggctcactcgatgctaattttacttggatttctgttcttggtaatcttatcactctacatggcttctatgagaagtctcatttactctcatggctgaaactatcacctccattctgataactttaaatctatgtctccattctggactttatacccagctacctattagacattgcctcaaactaaaaatatctagaaatgacctaattttttcttttaatttctacctccttttaaaatctaaaaaccttaattcttttcttatgtacttattctggctaatttcatgcaaactaaacattagcagttatctagatccttgcaactcccttccttttcttgccagatttggtcattaatggctatctcctaattagctctcaactctctcacctctgctactctttttggtgctattactattattgctattttgcctttagaattaaaagtttaatactgggtttagcagtccacaatgcctaagagtgtcttttggaaaccaaatctgtttgtatcattcccttgttaaaatccttccgtaactctccaaaaccaggatacagccaaaactcatttcaactctctcatcttcatcgtgtcaacttgtctaccctcatctctcaatactctccttctaccttttattctagccattttaaagtactattgtgtcttcaaatgtattgaattgtttcatactgccatgtctttacatgagcggttcaacactagagtgcttgcctctctctttcttccatcaccattcccacacccaggctcatcctaatcacctttacctcaaggggcatctcctttatatttttccctgagtccttgagactgactgagttgatcattctcttttttgtgtcactatactttgtgcacatgattgttgttgaatgagctcctgcaaagttctgccccagaaagtgagatagtcattgctaagatgatgttttgagttgtaccttagatataattcagatagtggtattggctactctagataaaagttctttcatgacccttgagactatagtaagagcaccttctctgccccattatggtaccactgaccttattgcattatcgttgcttgcttgactgtttctcacttctcactcatctgagaactccttcaggatggggttccagtcctactcacccttttctttccaacatctagtgccgtgctttgccgggtgtaggcattgtagataaaagcttagaatctgaagccagattgtcagggtttaaggttttgctttgtcactaaccatttggcttcagccacatttatattctctaagtttccttttctagaagaggagaattacagaatctagctctttggattttgtgagaattaaatgaacaagtttatataaaaaataagaatagggtctgtttcagagtaagctaacaatgtgctatttgtaattacagtcatattgccttgtatctgtagaggttacaagtacaaattctacagctaaaactcattcactcatttatttattcattaatccatccattcatttactcaatgtttaattcatttattcactaaagatttactccttgcttattaaatagcaggtgctgtgcttggtgatatgggaaataaaataactaatcagacatagatcctgtctttttaaagaacttataatttgatggagagatggaatatatataaaaataactataagacaaaataaaaatgcttagtgcagtaagagcttcagatgaggtcataccaggggttctgaatatatgaacattttttcaaactcccagggctatgttcataattacagacaagattttcacatttgcctttattaacaaattaatcaaattgtatgtacttaatagcacctcagcatacagcaagtcaatggcagagagagatgatgagagtctcttctgaaggcactacgtttagaagccttttcagcactatattatttccagacatttgtgttaagattgccagagtaaaacaaatgtttacacaagtggcatttgttcctaatttttcacattcattaatgtttcagttttgaaaatcagaatgtaatttagaaatttaaatagcaaaacgtaatatgttattaagccttaaatttttctttactttgccgtgttaattcatttattctttcaagtgcttgaatatttaaaccatttaaaatattaataatataccaaagaagtatcaatatttacattaagttggaattcacactgctttataatattttcaatggtttatattattcataatttcactaaataaatcatcctcatggaaggaacttaagcaagcatattatactataactattgcatggcaagcaatgtttttctttcaaatcgagtgctaaaggatattaggctgggataataaaagatgtaatataaactgatatgttttatttcacatcagcattcttaaattatggtaatgtaaagctcataaatcatggaaacttattacagtatatttttaagttgtaggaacatcatatatcccatccccatttctgcaaaacagaaatgatatttatgatgaactatacaatatttgcatttttcagagatagcttactataacaagatcgtaagacaaatatacatttgtcaagttaccataaaatattaactctaagagataaggataattcagataactttgtggcactgaaaagacagtatactctctctagtcttctttgaacattttgagaaacatttgatttcaaaattaagaatattttgtggctgcaacaatttgttggttactcagcttctaaacagcagtaaaattaattataggaggaaacattcatggaggtttctagccttttacccgatccttgtgtttgtgcttctttattaatttttagtccttaggaagtaagatacattagaaatgtagtatttatttgaataaaatcttaagttttattttaaaatacaattttgagtaaaaatattatctatatggataaaatattttgtccatgatcatttacttactgtttcattttatgtatggcttgtgaaattctggctaccccaagatgaatgttttatgaaaaccaaccaagagtaaattcaagccatgttaatctatacttcaagaatatgcaatacatttaaaaaacaacaaaatctcaccaaatctactgacttcagccaaaagacactttttcagttagccctattatttatgtattttttcctttctcagctctaacatatttttttaaacacatgtcgacttctacagggattataaaatccttggacaactatatgatttgggagcaaagtttccatgtgtaaggattgcgtgatgtataaggaatgtgtcacatcaggttgagttttaaaatgaacgtactccattcttaggttttatctctacagatggataggggcccagaggcccctggaagcattttggtaccattgcattacttacggttaagaggcaggctcgcattggttgtgcctagcttgttggcagccacacaggtataattgccgaagtgctcctgtgtcacgttggtaacagtgagaatggatcttgtgctaaaattttgaataataattccttgttggccattgaagagcctagaagacaaaataagctctaggtaaatatgtattgtgaataccagtttcatttttttatcttagctggggttgtcatggcaacccatagacaattcaactacgctgacgttagcatataacgtgataatggtgcaatttacatttcacttacattagtagatttgggggaggtgaggttgcatgtcagctgtagattgttcctgtgggattatttgtgctatataacaaactgagcttggatagctacatgtcctatttaggcactgttacatattttagaaaatgaaacataccataccaataatatctcatctattaaagtcaggaaggagtttaagggaaataaatataaagattccacggaaagtacaaactgatggtttctaggtaagctggcgagagtatgtctgggtcatttcagacattattaaataactcccttgaaagttaaccctacaactgtgataggatagttctgagtccagagtcaacaccactttactcttgtacaacccagacagataacttccattaaacctaaaaagagacagtcatatagtattggagatagcatttaaagttgagtcccatcactgtcacattttaggaatgtgccatggaaagactttaaaactctctggacttcagcatgggattcagctatacccaaattcaaactaattgtccaacagtctctggatttaccaccagaggccctcactctgaaataggctgacatggcttcaccattctcaatgcatgttgtacctacttctgcttcaccctttttctaaatctgtagcctatctcttgtaccttctatttctgctagtcagattcttccttcctcatttaggtctaacctaagacttatctctctttttctaatttatcttaaaggactcttatatctctctctgtatgtttcttttgtactattctctctagcagtttccatatatacaagtcttttcaaagcaaatacattgaattgttttaaattcctcaaaaggaaaggctaaatgcacatgctttctctgatatttgaatcctacaaagcacttaatagtgatatcctatatacataataaatagtacaaaggtcaatggtattcaggtgatgttcccccaacataggcattagtaagcccgcttcagtcacctcttcaagaaattatctctttaaatataaattttcctacaatgagtatgtcaacttgataataacttctacacaatttaccccaagtttattgcaaaggagatgcactgatcacaacataggctatgtaaactgatagtccaaatggcatagtagtttttctctctttaatgtgttcaagtttttgtatttttttaaattatgaaaatgctaataaatggcatcccctgagagttcaatttgaactcctttgcattatactgtgtggcttgcacctgaatttagatgaaatatactgtagttaaatgcagattaaaatgagcagtcatacttgattactctgggaattacttatatttcatgtaatagctgaatttggcttaccccaaatgcaaactttaatcagattaataaaagtgtgagttaaataaacattgaacaaactttagcttgagcaataaatttaatgatctccaactctgacataagataatggggcataaaatatcatggatatggcagcttttattcttctctctcatatttttagcctagcaacatttatgctaaattcccctagtcattattatatattttctgcatcacattaacaacttcgtttttaactaatccgtatatatgctgtgtaaaaaaccagtttcattgccttgcaagtttcagcactataacttgaatttgcccgcatctttgtgatagacacattctccagaggactcagaaactccctagactactaaatccctgttgtgctccatcgaccaacagtaggactatttacctgccgaagagttgagagagaaattaaccagggccttcaactggctagacccaggggaaatacttgaggaagtaaattcagacactccatggcactatatgcttatgttccttatggctgtctttctgtctttctgggtgaattagcttccagttccctgcccttaaatgtatctgaaggcacagccacagatgttgctgaatcatgtagcgcatccatactctgtatgtgtgggcccattttgggcctctggccagcagtaccgtgtgcatccttaccagagtggagcattagtgctccaacccctgctactcggatcagccaggcaggttattatggccaataaaaaagaaaactaagttccccgaggtaattttcttccctctggggaaagctacttttctgaaattactagagaaatctaaagcttactttcttctgcagttgtgtgttttagaagtgctaactcctcaaacatcacgtaagaacctatcttcatctggtagatggctggaagaaggactttgcaaagctgactttgtgggagagtgacttctgatatggtgtatatgtctagagaatgtacttttgtgattttcctggagagttctggggtatgaagacgggctttctcaattattcaaatcaattctgaaaatattcattaaattgctacaaagatgagctctatgctggctgagtgactagggacaagactgggcaacccatgatctctgctcttgagaaggtcagagccaaggagaagaatccagcacataaacaggtgtttacaacagaagggtattttggtcactgtggggaacttgttaatataaacatatctacccttaattactggatatataaatttgagccacagctagaagctccagcatatatgaccctaatgtgattcactccttgactaaaaccaaataatgataaaagagctctctaattgatgacatgtttttctttacaaaattgatttattctaatatgattgtctataactttatttctgtaaaaagaatcattcttatattgacttagattatacaatgaaatatgctttcttatagcccctgccaaaccctgcccctccctgccacaaaaaaaaaaaaaaaaaaaagagaaacaaattctgtagagctcggagttaaatatgacatccatttcttcagcatagatcagtactatatggtgcctacttggaaatacctggtcatttttcttcattgcgtttttatcatagggaatatagttataagatccttctatttctgtggaccctgctgtcctctactctctgacaccaatagaagtttgctccacatcgagaaccataactctcgctcctcttctcccttctggcttttgccaatgcctcataaatctgtgaaccacaggctatttgctttgctagccaaggctgtcagctcataagtaacacagcccaacccactaactagttctgaattagaatagtcccctatattttctagtgtcagtcagaagtagcacatggaaagcctgctgataactacagatacttatatttctgactcacaaaatggacagaaactttacagtcataacctccctccaggcagcagctatctgggatgaccagaaaagcctgcagcaacatcaccccaaaaaactggccacatagccatcagcactgattgttaagattacaaaaatattaataaatggagcagctacactggacctcattcattttatatataaatccagtctcaatccacattttaagactattgttcactatctgtctttccaggtcaggaataacaacagatatctctagagaaaccaacttgcagatgaaaacagcctcagaaagacttcattcctaatgtaggacatatatattaagaagtatcagacaacattttaaatattagaataacttggaataagagtgagggaggcattctcaaataatgataaatcttttatcagactggaattatgagagaacatgataatgatatatcattttatatgagtgggtagattaatatggtcttattaatcaatctttggtattagatggtgggggaagttaacccttgaatcataaaagttttatttacaaagacaaggaatgttaatgtcagcaatagactgtaggcttgtagaattccaagatgttgtgtgaactaaagatacagctcaaattaaaacaaaagagaaagatttagaagaagtcatgagtgatggtagaactcttacatggacttaacaaaaatgaggttttatttggttatcaaattacgattaaatgccttctatgctgaaagagagttaggaaccatagaggaaaattatgacatagttattacctcaaggaccatagttctacctgaaactctgaagatgacatgaagatagcatacaggtcccttccacaacacatcctataatgcctttctcaaggatggagttttatttatatatatatatatatatgtctctctctctctctctctctctctctctctctctctctctgtgtgtgtgtgtgtgtgtgtgtgtgtgtgtaggctgtgaatcagactgtatttctagtcttttcaatgtgaccaggaatgctttatgtatgtgggacattttatctgttctcaatacatttatgactgaagtaatctcatactaaaaattttcagcattgtggctgggcatggtggctcacccagcactttgggaggctgaggcgggtggatcatttgaggtcaggagttcgataccagcctggccaacagggtgaaacctcgtttctactaaaaatacaaaaattagccaggcgtggtaatcccagtgggcgcctgtagtccctgctactcggagggctgaggcaggagaattgcttgaatccaggaggcggaggttgcagtgagccgaaatcctgccactgcactccagcctggacaacagagtgagactccatcccaaaattaaaaaaaaaattcagcattgtacacaataatgtttcgtgttacgagtgtgaaaaatcgacacacagaaaactttaagcatgttgaaatgtacgtatcaacaaatcttcacagcaatcctaggaggtagttgttattagtcccattttataggtgagaaaacagacatttaagaagattaggttaatttatcttgcaccatctgacaagtggcagaatcaagatttaaatataggtcctctgactactggtaccctccgaaagtagcaactgacattcaaatcgctaagtagaaaccaggatattgtatctaagtttggagagacaaatcagaaatcatggatacttcaagaaaatcgagtcaagccaaggaataaaaccaagggagctaaatagccaagtggtatgtgtcacctatgccaggaaagccaggtttgatccagaggtgagtctaatgggtaaaaaattaactaaaaaaatgatactatctggatatatctctggaccagaagcctcttgactatgtatttggggcttagttatgtctttcagtgcaggcttttagagcagctgtgtctagcttcacatagtcagccttccaggcttcttgtagcctgagatgagaaacatagagtaggttctctcctccttccctgctcacactctctccaacttacacacactctcagcatcaattactgtttgtttttcttcctctaggttcactaaatatttggatggaagaaagtccctcctcatagtgtatatgtagaatatagtcaagaatggaagaaaaatgcaacctatccaaatgacaagaatgcagtattttagagtaatcctaaaattctctgtaaagttccagttatcgtgatggtatggggttactgtattctgcttggcttggccaaattatcatcataacgtcaaatacttctttttctaacatcatttcagctttaagttttcatatatttgtgtgattttttattaatatccatcttcctcattagagtataactctgttagggcaaggttcaaggttgattttgttattcactgtattctaagcatgtactatagtgttggattctgaataggtatagagtaattgttgcatgcttgtctgaatgaattatgtttttatatttttgtaattcttagttttttcatctgtgaaatgggagaaatgaagccaatcacaaagtgttaatgttaaaatgtttttaaaaatatttaatgtgtaatatttatgtacatatatgccaaatgcagtaggcactagattatgataggtgttattgttcaatgatagagtctttttcctagaacagatacatttcctctcagttggcagaaaaatattaaatattgagcattcaggaaattatttttaaagaaaagatctaggagagtgactgaaaagatcatggcatcctgatttcaagatgtgccaaactcagtatcaattacatgtgcatcatcaatctcatctaagcttttcacagatttaacaaaaaagaaaagtgaaagggaggaggaggagcaagaactgctagataccagagagaaacgaaaatttatgtgaatatgctgctatggcaacctactggtttattgtgctgcttgatacttaaggcttgaaaacaatatgatatcatttattcctaggaacaggttgaagaatatcatgcatcactgtcttagccccaaggggtatctatctttagttgtgcatttgaataaattaatgttattataatatattagaacactttaatgaatctagactttattaagctatttaaaatgcatgtcttatttactttatcaattttaatgaaattaataattttagattagagatatttgggctgctttccttgtgacaatttgattcgcatgggaggatattcccttttaaccctacgttaaataaacaatggctacagtacagatgtcaagcctccctgactgctgtgagttcctgtatccctggcaacctggcctatgactggatttctccccaccacttgaactatttttctaatatcaatatgcccatgattttaatgtaaaatattaccccataatataacagcacaaccatttctcagaaactatattcacaaagaaaaaatcctgagaagccagaattgagcaacagaaatcagcttcctttctctgatcatatattgggtttacaatgtcctgcaatctaaggtgacaggattcatttgtactaatagtctctcaccaacttgaaagtgtgttaaaataagaatggctctactttatatttagtaaaaggctataacgcagtcttccaacagagtgtatcattcatgccaaataccatgataagcgttggggacatgatagtgaacaaggcagaatcctcatttccaggtagatttagagcttagcaggagagatgaaaaagtaaaataggttgtgtttagtttaatcagtgcttgttagatgtgagcccatgagggtacatttgaagagctccctcccaggtagaaaaaatctcgttgtggtagctttcctggagaaggtgacatccccaaggagactgaaggactaggtagtggaaggctgccagccaaaggcagccaggaatgggtatgtgagtggaaggggcttacaaacaaaggagccaacatgtgaagaggcctgaaagagagagctcatatcaaagtctgggaatggaaatatttcaggatagccacagctcctgttgtgtgagggtagaatggcaagattcatagccagagtggaatacaggggccagaatgtgaagaaacctacataccaccctctgttgtgaggactttattccagggacagtgaagaaacaccgacaggcttcatacataaagtgtaagatcaactatttattttagaacgatcattacgcattttaaaaacacaacctaattccagctgtttatgggtagactctgtgtgtgcagtactaaccccttgattctagtatgttccaaaccgaactgagcgtggtccctccctaaactttcttcctgtgttccagcctcagccagtggcttcactctttatcttgttgtctagatggaaaacatagaattacgttcaaattttcctttccttatatccaattagtcacggaaataagcaaatactacctttcttctctcttgctttttaactgcatatctaatactctaagccatattttaactttcccatccatttcttccaactactctaagaaatattttgtgaagacatacaagctgccaacaagcatacacaaaatgctcagcttcactaatcatcagagaaatgcaaattaaaaccacaatgaaataccacctcacaccagtcaaaatggctattattaaaaagtcaaaaaaacaacagatgttggtgtggatgtggagaaaagggtatgcttgtacatgactggtagaaatgcaaattagttcagcttccatttaaaacactatggagatgtctcaaataaataaaagcagagctactatttggcccagcaattccactaaacaaaggaaaacaaataattatattaaaaagccacttgcacttgtatgtttatcatagcagtattcacaatagcgaagtcatggaatcaacctgagcatccgtcaatggttgattggataaagaaaatgtggcacatatattcagtgaaatactatgcagccatataaaagaataaagtcatgtcctttgcagcaacatggatggagttataggccattatcctaagtgaaataactcagaaacagaaaatcgaatactgcattctcacttataagtgggagttaaaaaatgggtacacatggacataaaaatggaaaatagacactgaggattccaaaagtgggagggctgggagaggagtgagggatgaaaaattacttattgagtacaatgttcactatttgggtgtcgggtgccctagaaacccaaacctcaccattatgcaatatacccatataacagccttgcacatgtacctgctgaatctaaaataaataaataaattaattaaattaaactactgctacacacaaaaaagggactagattgttttagtactcttgaaaatcccctcaatagctttccaatacttctggaatccagtccaaatgccttgtaacatttaagaccctccaagtctttccctaaggtgcctttctagccctaactcctgttatacctgatttcatatcctgcacaccaagacatttaaaaaccttccgcataatgcttacatgacattgatcacgttcttctcttgcccatgattattctttttttttttttttttttttttttttgagacggagtctcgctctgtcgcccaggctggagtgcagtggcgggatctcggctcactgcaagctccgcctcccgggttcacgccatccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcccatgattattcttaaccccgtggaatgtttggaagtgctactcatcctttggcatccagcaaaaaagctacatttgccctgaagtattctgtaacccttttatttgagttgaatgggctcttactgtgcactttcacaggtcttggcttagggttccctgaaaattttcttacttagtacttatttcattttgctgatttttatgacaaatcctacactctaagtcacaggatataaactggaggtggcccactttcatctttgtttgacccaatgttttcaatgtaataatatgtatttgtgtctcacacgggcatgtgctcttcagttcccagtagctgaaatgctttcagttatttcatatatttatttgcatctctggccttgaatgttaaagtcgtcacaaacgtggtaagagttgtactgacaccacattggttattaaaagaaatataatcaaatgaaataaataaaataataaacaacataacacgacatagcaaaatataataatgagataacactagaaatgcaagtttcttcaattcaagaacttttctttccttttcaagttatctcacagattaatgaagaagtgaaacttttcaaattatcttacaggtgaatgaagaagtgaaatctgaagttagaagagaagatcactgttaatctgaaatggtaataaggttatttctagtactcttctaaatcaaaacatataactgcctacgttgcatataactgcctacattggtaagaaccaccttgtgaatgataagataaaagcaaaagagaaacagaatgtacttctagtcctttctgaataatcaaacttgtaatgtaaaatctagaagagagatatcctgacataggagtctggaaattaggtctgctttccttcaagtcatttcaccttcaaaagatacagtttttattatcatatgtaatccggttagaattatacaaggaatgagtaagatagtatgtagtaagttgtaaaatatgtgttataagatagcaaagtcagcatataaggtaaagttgcatgttgttaaaattaatcttgaaaattccttaaactccttgtttcaaactaccatactttacaatagtttccaaaatggaaagcaagtatcttaaagtagaaataaatgactagttggagtgtgagaaaaaaataacagaaggtccatttgtattgtattcttatctcatttttaaaattttctgtctcagctcatttaatgcatgaatacactagttcagaaatgcataaccataagtaaaaatcagtatggaaatattgttagtttttgctaatttttttattttactcatgggaacatatgttttaaaaaatgttgctgatccctgctttacctcactgttgatgagtgagcactaaagtagttggctttgtttcagagccatgttacattaaactaacattttcaacattaaaacctcattaaaaatagagagatgctcatactatcagagatacatgggaatgaagacccactgaaagagagccagtttcatatctcccatggtatgtatttttgaagcagtagagtagtaagtcatgccgtttaattatatgtgctatctagcattttctctcttcctctctctgtcatgtagcaccccaggcttaagaattgactctatgtaagtgaacgaatgtgaacattttgcaaagccaccacacataataaagccttgaaaatcataatctgctatgcaaatgtaatgtattcataattttgacataaataaattgcatgaaaacagtaaagaaaggggaatcaaaattttcctacatacaaaaaaattttaactcattttgctggtttcctcaaaaatataagaaggggagaagacccaccctcccacagtcctgcagcaaagtaaatactcacataaaatttatagcttgcttagacaatcaggtagtaaatatttagaatagaaaagaggagaggaatggtcattactctttattatgatttctcaagttcatgttaccattgtaaaatcaggaatgaaaaataattgttatctaaagtgaaacttaacattaaccttactgaaaaaggtcaccatgcctctatgtaaagtgaacatggcatattctacaaggttgacttcaggtattttcctatgcattcattcgtatctgcacacattttgtacttgtctatgcatgcatattttatgcacctagataactaacccttctcaccagggcaaaatgataatgaccatcacatttttttctatagcagtgttataaggaatgacttaaaagagaataggccaagtttgaaatatgttgcttaaaagtcaagatattataggccccacactgccaaatgcaaaaatttccattttgtaggtacacagcttttaaactagtatatcgataattttaatgtctttttcattcattggagtaatttatgtttacctcatttgcaacgttttcatccctatattaaattatattagaggaataggaaagaaatgcggttgcagctaaaaaattccaaaaaagcacttctacaattagccctttgcctaaaaacaggaaaagtaagtaaaatactatttttaaaatctattcatttatttaatactttatttttaattgaccaataataattttatatatgtatagggtataatgtagtgtttttatatatgtatacattgtgaaatgactaagtcaagctaacatatcagttgcctaaaagcctggagcagttaaaatggtcatgagaaatcagaaagcatgtatttctagacctcaggcttggatttgaggtaatctagaaaaagaggagggaattcaacggtgcaggcaaaataacaaaaatctcatctaagacaagacggtaataccatcttcacaaagtaataccaatccatgtttttgtaatacctattgaaatgccagtatattacaattcatgtttttagccttaatcctaaatgaatgtactattctcaaacatagattaattgaatttcatatcaccaaaaacgtttgcttaatgatactttggatgttctgaaattgtcttttcactgcatatgcatataaagagtatatttctacttaacaaccttctacagtattgaggaaaaaagtttaaatatttggctctctttataactctaattttcccaaggcttaaataaatacatagtaaaattaagcccattgatactcttcattccaggtgtgctgaaagaaactatcatgttaaaaaatgactaccttatcctaagaggtaatattttaataactagtatatagcattagccactctcatggtggaataaactaaaagccacatgactaatatttccaatataaaaaatacttagataatgcatgagagagacagtgtgggagccatctttgaagatggcatcagatgactctcacctcttgatattcatgtccctgtgctgtcccctctcacaatgacaatttcagggcatccaaagtcctattaagcaaatgtttttgatgacatgaaatcacattgaataaggtttccccatatagctaataatatattatggatatgacagagcatgacttctgaaactaggttataaaggacatgtcagcttctatctagctctctcctggatcactaatactggattaagctcgtcgcctatggtgacatccacgtggcaattaactgagtccatctgccaataactagcactacttgttgggcatgtgggtcagtcatcttggaagcagattctccagccccagtcaagccttcagatgagcagcaccaggtgacatcttgactgcaatcttatgagagacccggagtgataaccatccagccaaactgctcctggattcctgacccacagaggctgcttgagatagttagtgcttactggttttagttgctaagttttgggttaatttgttacttagcaatagataactaataatggcatcagaaacaagggaaagaacatgggccgagaggttatcacatctaaaatgtcttgatggtgacataaagctgagtgctcttcaggtgaagtcccttgtgtctcagttttgtcaacagtaaattgatgataataaaatcttatttcacagaggtctgaacagtaaatgagataaaagaattcaaagaaactggaaagtgttttttttttttttcctcagtaagtgtatatttctttcttttctttaaattgtgcttaattttaccatccttcttttaaggggttttaagctgattgctcttagcacacagaaatggactttacaggatgttgaagaactgcaggcagagatagggctatgggtgttcaggcactgcctgttttttgtttgtgtttatttgtttatgtttatctgtatgaagagctggctttgaagatcttgatttaagataaatgaatatttataaacattctcttacatagaagtaaagcgatcgtataagttatttctgattatttatgtgagcctcaaatcaaaaaaggtctctaggaaagaaaactctagatcttgcagaaataaactctgttcctctctgacagggtctctgacagcttcatgttcccagttaaagacctcagaggtcaagaagacaactctgaaacatgctgtatctgtttctgctgtgttcctcttgactccatttttctgtgtccttgactaaataaattgggaaattataagtgagtgtttgtacatgcagtttcttattttgcaaatccataaacaacttgaaatgcttttgcccttggtatttcacattgacatttcaaattagttttgatagactcttaagggccttgacctacactaggtgccatagtataggggttaaacccatggactctgcatgaagatttataagacttcctgggtttaaatcccagctctgccactaactgtatgaacttgtgcaaattacttaaaagcattctatgctttggtttccttaggtaaaagttgagaataataatatttaccttacaggtttgttataagagtaaaatgggtaaatattatcaacttagaacactacctgtccaatagcaggtgcttgctaaatagacagctttttatttatttttattttttcattttttattttgttgagagagagtatcgctctgtctccaggctggagtgcagtggagcaatctcggctcactgtaatctccgcctcctgggttcaagcgattctcctgcgtcagcctcctgagtagctgggactacaggtgcctgccaccatgcccggctaatttttgttagtagagatggggtttcaccatgttggccagggtggtctctatctcttgaccttgtgatccacccgtctttgccttccaaagttctgggattacaggcgtgagccactgtgcctggctagcttttgattttgatgaagtaaataattgaatggcctgggcgtttatggtgaatctgcatagtgagcgcaaccattcagcaaccagaatccttctttttcctactccctgcatatgctcaactttgctttacttaagttttgaaacgaaattattcattaccatgatatttgagaatttgagtattgcctcaaatataaccctaaagatgataaatgtatgcttcactctgaactgaaaatatgtttgcctttcacaagtgcatttgattttcacagctgcatttttctatgcgtgtgagtgtgttggggaggacattgattggggaaaatcaatctaccttttcctttttagcaaatggttctgaactcctttgaaaatctaataaaagctgtagtccatctctacagtaggaaaaaaaaaatcactgaagctatgattgtgggcaccaattggcccttttctatatttactataggccaagaaagtggaccgaggattactgtagctttttttttttttttgacaatggttgctgaatttagaaaagataaaaagagagagcagaaaaaaaaaatccaggacattgcttcacaaaatattggaaacaaaatggcctttaacaaaggagctctgattgttagcttttaagaaattaatgacacaaattaaaaagtgactttgaaaggtatgtaaaatagtctgtcagtgttacttatacagtgttttgtagagaaccagggatttggggaactcctgcaatgatgtcctaatttagagaagggttgtgaacaggtagaattgaggctccatttacccagcatcttctcgagaagtgctgtgttcataaatattacttcttgggcttccaaataagattgtacatgaacaaagagttccataacttataaaggattcagaaccacttttctggatatttgtccatatagataattacaaactgaaacttctcaacctaggttatcaaaatctgagaaaggctatattggcagatgtacaatattgtagggtgaaatgagagtgaccacagaccagtttatctaattctcaatatataaaaatatggagtcttctactaagctataaaaaggcaaattcagaattagtaaaaacatataaattagtaaaaagaatttaaaaatttaacaacccaaattatagaagttgcatataaaatagctaaaaaaaattttaggtaaaaccagtcagaagaaatgagactgtatggccgggcgcggtggctcacgcctgtaatcccagcactttgggaggccgaggcgggtggatcacaaggtcaggagatcaagaccatcctagctaacatggtgaaaccctgtctctactaaaaatacaaaaaataagccgggcgtggtggcgggcacctgtagtcccagctacttgggaggctgaggcaggagaatggcgtgaacccgggaggcggagcttgcagtgagccgacatcacgccactgcactccagcctgggcgacaaaccaagactccgtctcaaaaaaaaaaaaaaaaaaaaaaaaaaaaaaaaaaaaaaaaaagaaatgagactgttatggggatattatcccttattattaaggttgatgttaaaaagggatattgtcttccacaaatcttttgattccagttccagaaaaaaatacctgcttgcatcacatacgttcttatcctttgtggtaatatctaagtctttatataatttcaccagttttctgttcagctatttagctgcaattggttatgagccatgacataagtaaatgatattatttggaggtgtccccacccaaaatctcatcctgaatttaatttgaattgtaatccccatatgttgggggaaagacccatgggaggtgattagatcatgggggcagttcccccaccctgttctcgtgatagtgagtgagttctcacaagatctgatggttttataagggggttttccccgatttgcttgggacttctctctcctgccgcctagtgaagaaggaagtgtttgcttccccttccactgtgattgtaagtttcctgtgacctccccagccatgtggaactgtgagtcaattaaacctctctcctttataagttacccagtcttgggcagttttttatagcagcatgagaatggactaatacagtatgtaaaccccctacatatatgttgtacagtatggaattgccaacatttggcttttttgacttcgaaagtgggaatttcatacggtttaacctagcatttgcttgaatatattcctccctagttttgacgcagactctatacagttcacccacaggggtcctgtgattttttgatcgattgataacagaatttgaagatgtctgaatgagcctactggttgaaagtaaagagaaagttgtcaagtcctgtcttatcttattcagtagctcttgccaaggtttttgggtcttctcaagggagtaatcacacagagttgaaataagagcagccctaaaatcccactggttagtcctttaggcatgtattttatctcctctacagcctctttagtgacagaatatctaaaacatagtgttctgtaaaacaaaatgttaaactatcttgtgggagaataaggcaggtgaaagggttgaggcttatcaaggaagccaggcaaagacagcagttcctattgcttttgaagtgctcttgtggaagctgtactcacgtcctttaagagctggtttacttcccaaataaactgagttgccagcaactcagtttcaggagggaggggaagaaatgaaatgcatcagtgatggaggatttgcaggcatttctgagatcatacaaaccaaagtggacatttcttctggatgctattagctactcatccctcccacgtgggccccttcagtttgcttgctggagaggaggctgctgagaatcattcaagccagttaaagaaattgcctaaagtaagtatctgaaacacaagcacgttagctcaaagtgcttagaacacagtaataatcacaaagtcctcacttcttctctcctttgtaccattcaaaggctggaggcggcacacctgcaccttcacatcttatcaggccactgcgtccgggggtcacggtgccagatttaatttcctgaatagtaggagcaactgcaaaagaaacaaacaaacaaatactagtagataagtaaaaataatcctcaacagaaatatgacacacatatatttttattccttctatattcaaagcaatcttatgcctgatagaccaacgcatcacattttcagtgttttatgcttcaaatacaagactagtcattttcagcttcatttttcaaggtgaacaatagatgaatgttttcagggagtgcagagtaaatgcaatacattttggccttgcttcctactggaaaaatggcattggtgagggtaacactccatctgtactccagtccaactctactgcagtaatagttctcatctattgagtgatcacagggagccagtcactgggctaggtgctttacattctcgatttcctcacaaaaatactctaagcttgatggtattatctcaattttacaaatgtgaaaagtcaagttcagagatgttaaatgaattgtcaaggtcacacagctacttagttgcagaatttgcctttgaagtcaggcatgttaactcaaagcctgggctcttgaaatattctgtgttttttcctgcctcctccctatgctttagtaatttagtgattttttctttaatgtagtttcttctgcccgaatgccgttgttccccatttccacagattcaagatccatattaggcatcagtgtccccatgctcttccctattgctctagctggaaaaagtttccccgcctctgagtatctggatctctcataccatcaactttctatcatgtattgatagaaatgtattgcattggccgagtgcggtggctcacgcctgtaatcccagcaatctgggaggccgaggcgggtggcccacgaggtcaggagatcaagaccatcctggctaacacagtgaaaccccatctctactaaaaatacaaaaaattagccgggcatggtggtgggcacctgtagtcccagctactcgggaggctgaggcaggagaatggcgtgaacccagggggcaaagcttgcagtgagccgagattgtgccactgcactccagcctgggcgacacagcaagactccgtctcaaaacaaaacaaaacaaaaaagaaatgtattgcactgtatcatgtactgtatttatgggtatgccagatttccttttcagttccttgaaggcagggttaaatatctgattcattctttgtatattccaagatcattacacagtgcctagcacagtgtgatgcttaaaaagctttttttgtagcataacttttttttttatccttcacatagttattcagctgtcaacatgtgccaggcatttctcaaggaacaaagcagtaaattgccctgacgtgatgaagcttatattctagatggggtaacaaatggggagacagactataaacagcaaatatcacaaataagtagtttaaataaaatgttagaaggtgataaacaatacagtaaaacaaaaacaaaacccttatagttgcaaggtaagaggaatcagagaatggaatggaatactattttcgatagggtaatctgagtaggcctcattgagatggcaaaacttgcacaaagactagatgtaaatgagtgagttagctatgtggatatttagagacagaaccttgaaggaagagggaacagcttgcagtaagacactgaggctgaagctagccaagtttgtttaataaatagcaagattggtgtggccgacacaaagagaaagaaggagagtaggaggagataggaccaattttcagtggattccaagtttacaccaaagagaaacaaaggatggaagactgggtaggacctctcaggtcatttcaaggaattgacttttattctaagacaaatggtgagtccctgcagagtacagataaaatctgattgtttttttgaaaagatgactctggctgctgtgttgagaaaagaccatagtgaggctaggataaaagtctagggataaagtagggaatgcagtaagcaaggcaaatgaaggtgggtggctcactccagggtggtagcagtgcaagtggtggaaagttatcgggcttgtggtctactctgaaattggagctgataagatttctagacagactgaagtgacatagagaaaaaaagaggagtcaagggtgatttaatttggcttgagtagctggaaggttattgactgagatgaaaaggacagtaaatagaagaattttggagggggctgtgtgcagtggctcacacctataatcccagcactttgggaggccgaggcgggtggatcacctgaggtcaggagttcgagaccagcctggccaacgtggtgaaaccccgtctctactaaaattacaaaaattagccaggcatagtggtgggcacctgtaatcccagctgaagcgggaggcttgggaggctgaagcaggagaatcgcttgaacccgggaggcagaggttgcagtgaattgagactgccattgcacttcagcctgggcaaccaaagcgaaactccatctcgaaaaaaaaaaaaaagaattttggagggaaacattaggagttgtatgcatgcgtcttttcataaatatttcctattctgccaagtttttaacatactataattcatatttcaaataacactatagaaaattattaatcaacaactagaatcttgaagatacaaaaactagttcattcagaaatatggcctaagtgtgcactatggatgtattttgatttctttggaaagcaattaaaaagtacagcacttaatggtttatcaatattcagtgaatactgaatatatagttttcaacatatgaaaactataaaaactcttacaatggaacattgcctttcaactaaaaaaataccctaggaaatacatcattttctgttaagggaaatacttctttttgaaattattgcacttctatttctctgtggtgtttttattcttattatttatagttctagaaaacattgcaaggaaaatatttttgctaaagtacttgctaataaattggtgaaaaaaatgaaataatatttccaaaaaatgtttgcatgagaactgttacaagataatatagatacacacatatacacaaacacacacccagttttatatatatataaatcatatatgtataacttttataatgtacatatacatatatacccttatatatacacatttatctatatatgggtgtatacatatacgtatattcacaaacacaagaaatcatttcataattttaaaattgttttgttaagcaaaatttcatgtcacctgcaaaagccaattaaatatattaaaaaatctataaataaaacttcatgtacttgtcaattattatgacactgctcatgacaggtacaggtaagattgtattttcactattgttctcataggctttaatctctctttcctgtcacacaaacagactgtaatcttttatgatatctaactattattgaagatgaaataaccatatgcaacaggagatccatcacaagcttctactgataacctggttagtttaattactctcttgtttgtcaagggggccatgactcattataaacaaaagcatgaaatccggaacattgcctgaaaaccggaacattgcctgaaaacccaggcgtaatgaaccgaaatcaaaatctagttcatcattaaaaggcttttgtgcagtacagtgtacatacggctcagtactgggtgctttaccacacaagttaaagggacatgatcctgttatctagggcttcgtgggctgctatgatggacaccgaaaatggaaagatatctaaaatgtcacatggaaatatggataaagaatgaataaatatgcataagaaaaagtcctaagagcattttgcaaggtatagagttaaaggtccaagtgttgtgaagtaatcaatgtggagagaagattctcatgaggctatccctttgtggctaaaattataaacttgaaccaaaaacctctattgattttacttggagacataaaagttcttattacatactcatattactgtgcatcttttggaaataacttgttcaaaaagaaaaggattcatccatttatttattctttattcctctgttgattcaacacatattttatcagggatcacattaatgaaaaaaaaaatattcctggcctcatagagctgatatgaagtgatacaaactaagacgaaaacagagcagggtgaaagaaaaaggaagagcaagatatgttatttactatgttgcagtctcagagatcctggatgataaggtaatatttgaacaaagaattaaatgatgtgagaaaaggaatcatttggcaattcgtagaaaattataataagaaaaaggaaaggcaaaggtcctgagtggagagcatacttgaggtggaaacatgtttaacaggattaggtttaacacactgttttagaaatagcaaaatggtcatcattgcttgagtagaataggtgagaataatctagaagagaaggtggggcagggggctggagcccagattctatagggtctagtagcccatggtaaaagctttgaattttattctaagctgataaggttttgcagattttgagcagaggagtgacatgatttagttaaaatcctacagagattatttgtctgttgtgtggaacatggtctgcaaagaggcaggagaggaaaccggcagaataactacgaggctgttgtagtaatccttaggataatgagaaagtcattggccaatgcatagaaaaggcagaagctgaggatagaatgtaattaaatagatcattgctcacattggacctgaatcaactcattttagttagcaggcattgactgagaattttcagtggattccaagtttacaccattctgaaccctattactctgtataaataaaaggattttgtgggtacagacatgtctgataatgcccagaggattactttctacattacttcttagaaattgtgatgtacatgtatgtcttatgaatcttttattgcaggggtctgttaggaaccgggcctgttaggaacccgggccacacagctggaggtgagtggcaggtgagcaaatggagcttcatctgtatttacaaatgctccccatcgctggcattactgtctgagctccacctcccatcagatcaacagcagcattagattttcgtaggagtgtgaacgctattgtgaactgcacatgcaagggatctaaggtgcacactccttatgacaatctaatgcctgatgatctgaggtggagctgaggcagtgttgctagcactggggagtggctgcaaatacagactaatgttaacagagaattatacacataggccataataaatcaattgcttgcagactcatatcaaaaccctatcagtgagtggcaagcaacaattaagctgcatctggtggcaggctttatagtggcaaataagttgaggtacttcaattgcacaactgcatctggtggcaggctttaagtcagaatctgacactttagtctgcatgtggcccacacattattttatttaccacttctgtctgtacctttttcctacactgcgcacttgtctcagtcacagttttggtaagcccacaagctaaccctagccaaaatgagtaaaaaccaaacatcactggagagcttctttgaaaaggggaaaagacccaacaactctaagactgccaacaaaagaaagctgcatttaaaagaaaataacaagagtgctacttaaattacaagttctttgtaacaggtgattcacattctccaagcccactttgtataatgtgtggtgactggctatccaacaaggccatgaaaacttcaaaactgctgtaccacatggagaccaagcaccttgcattaaaagacaagactttggagtttttcaaaaggaaaaaaacataaacacaaagaacagaagcaattattgaaggccaccacttcatcaaatgtgtctgcaccaaaagcatgattctcgtgactaaccacattgctaaagctaagaagcccttccctattggtgaagagctgatcctgcctaccactaaggatatttgtcatgaacttttaggagaggctgctgttcaaaaggtggcacgtgttcctcctttggctagcaccataactagatgaaatagcagaggatattaaggcacgattgttagagaggattaacgaatcactgtggtacacaatctaggttgatgaatctactgatgttgacaaggcaacaatgcttgtttatgtgggatatatttttcaggaggatgttcgtgaggatatgttatgtgcactttcgttgccaaccaacaccacagctgcaggactattcaagcctctgaattcgggaaaactgaattggttattttgtgttggtatatgcatggacggagttgctgccatgacttgacagctttctggtttcactattcgggtcaaataggtcacttctgaatgtaagtctacacaccgtgtcatccatagataaatgctggctagctggaaaatgttacctgaactaaaatcattttccagaatgtgattaaaattaccaaccaggttaaaatacatgcccttaactcacatctgttgccacagctctgtgaggagatggacacagagcacacatgttttctcttatacacagaagtgagatggctttctaaaggtggataactgagcagagtatctgagttatgaaagccactgcagagattacttttagaaacacagtcaccaatggcagcacatttcagtgacatagaatgggtcgcaaaacttgcttacttatgtgacatattcaacctgctcaatggactcagcctttcactccaggggagaatgacaactgtgttcagatcggcagataaagtggctgcattcaaagccaaactggaattatgggggcgaaaagtgaacactgggatttttgacatgtttcaaacattagcagagattttaaaagaggctgagccaggaccttatttctcccagctggtgcatgatcgtcttgctcagctttcgaaagactttgagcattacttcctaatcacaaaagacacccgaactaggaaggaatggatctgcgacccatttgtgaataagccaggtgtattgactttgtccctgccagaaaagactcacttacttgagattacaaatgactgtggccttaaaagtatgtttgggacaacctcaaatctccataagttctggattaaggtcaagacagaatatcctgggttgccacaaaggactgaaaaacctgcttccatttccaacatcctgtctttgtgaagcagggttttctgcagtcacagccaccaaaatgagatcatggagtagactggaaaagcaacacacttcgggtgccactgtctcccatcacccccagatgagactgtctagttgcaagaaaacacactcaggctgtcagtgattctacattatggcgagttgtataagtatttcattatatgttacaatataataataatagaaataaagtgcacaataaatataatgcacttgaatcatcctgaaaaaatcttctaccccaccccacagtccatagaaaaattgtcttccaaaaaaccggtccctggtgccaaaaaggttagagactgctgtctttttggacagacccttttccaaacttatgtggtcacagcgttctataaggttttatttgagcattttgtgggtctgatatttcttgggatatattctgcatgtgtcaaattactggaatagtggatctctaagctgtattctacatcataggttatgttgtccgtgacttttaaggtgaactgtcattactggctcaagaggtttctaagggctcatgagctataatgtactcacagatttcatgtaaggagaaggcttcaattatttgtgccataaggatatggtcatttatttccctggaacagatgtacctgacaaaaattatgactagttaaatctccaactggagctgtacagtaaaaaattataaatatatttggccaagttgtacaaaacactcattttccactacaatattccatgttttaagtaatcacagtgggctctttcttagaaagatgatcaaatgaaaaaatctgagtgattgcttccagagcctatttctcttactactacactccctccattgctctgtgaattttggcctggcacctgaagtgtaagctgtttttgctgggagtagggaaataaatttatgcatcttcatgtgtttatgtttccagaactgtttttctttttgtatatatagccttgtgttcttcttagatgtaacctttcaataacattaaagtggcaaggaaagtgaatgctagagtctctcaaattcaccagtagaatagcatcctttggagtggactgtgagctgaagcaattgcacagtggaaataaaatcaatttcagaggaatgttattagacagatgtgagtaagagcaaggaacagatgttggagaaagccagcagtgaaagaaagggtcagcatgaggtatttaatacctgtgtgattagaggctcacaaaggaggagtcttcctttctaatttgctcagtgggattatttctttgcattctttagctagtcatttcaggatgaagataatgaaagtgtcttcatccaaatctccaggctctgcaggtgcaagaaacagaaactctgcacttggcacccaacaagcctaatcaagattcattttcttagttacttgacaatagctaccaaagatcttctttctctcatgccatcctcaatgggagctttagtcatgtagagagtattattattattaaaaacgagtaaatccaataattattttaatatccttactaagttgaggtagttgaaatgaaactttagagttccaatggcaaaagaatttgaacaccaccctatccccttaaagtgatggatgattatgaacacgccatgttaaataactgcaacaataaaaaagggtgcccagagaagaagagtagtaatgtgtttcatgttaaatactgcaacagtataaataacattgcccgtagagcattagtgaatttagagtctataaagaggaaaaatcggtcctacagaatccacatggtttgaaaacgctgtggaaaataagcatgttgaccttagtctgtatttaggatttacatactacattaaggcagccttagtcaaatggacagtctttggaaaaattttaagatttcaagtacctcacagagaatacaaaatataagatgtgttcaatatattattgtttcataggaggagagttataggtagttaaaaatttcttacttgaagacaggttgaaactcagggtgggaaacaatgacaatctttcaaaggtttttatagatctcatagaaacatatcataaggtcaaccaactctttttatgaagcaaatatgtcttcgcctaatgaattaatttcaccttaaaggaagctaagatttaaaaaaatcaaacttccaaaatatagttgaatcacaatctttatgacttagagactttcacattgaattaagcctctggtcagcattcacaggggatgaaaataatctagtttgtaatgtacctccagcttcccccagaccttaaacatttacacagtggtgaaataatgcagtaaaaaagcactgctttgcagtgcaacaaacgtagctctaacatttactgtctgaagtacttaacccttctaaatcccagttttctcacctgtaaaatagacagtacttacttcataggattggtgtatggagaaaataaaataatttaaggaaaatgcttcatactgctttgcactgagttagttgtcaataaaaacattagctattattaaattaggattattactagagaatagagtatcatagtcctgcttccttttaagggcatggaatcatgataagacatgggcaaaaaagaaaaatgaatttttaaaaattcattgccttggcactgcaagcatgtgattaatttaattaaaacctggatgagtatatcacattttactctcccagaattccatccatagcctactttttttagcgtaatcaagaaaatctttctgaaaggcagatgtggtaaaccttatattcctctttgaacaagaaataagaggcttgggttcaatgtgaaaaaatgtgaaaagtgtatgtaacacaaaggtatcctttccaggaaaatatgcaactgtggtggtacattacttgggtatataaaagatcatgtcagttacattaaacatattgatgaggtcattttctttttcacaagaaagacaataagtgaaattttacatgttaacttgaccttaatgtttttttaatatttaatattcaatgtgacagagtactaagctgtgatctttgattcccttatgtttgaaaaggtacagaaaaaaaacaaaattatttggtaaaaaaattttcggagcgcagagatatatgactacatatgaattctgattttaggaggatgaatgaaatctccagcactaactccctaaaccctcaataacaatctgttcattgtttgaaactattaacctaagagattattttcctaagatcaagttcaatgttattatattcaactttttcaaggggttgaatttactaagctatcattagtcattatattgtggtataaatgatctgatactgtgttgatgatgagtatgcacatgttagaggccatagatgatggatgaatggatgagttacctgtgactcatgaagtgaataaaagtgcagtaagaagagaaaggcttacatcatgagtagtttgctgatgttaaagcagaatttattcatattgttcttttgacaacggttagcactggtgaaattatagcttgaaatagctgtccccttgtagtcagcaatgctcactccagtgatgcatccactgtaaaatatgtgtgaaatttattgggccaccagctgtatcaacaggaattaaatggttcactgttttcctagctgtttgccgaactttctttctttcaacttgttcatgatctgatctcttctctgttgtcagtcatgctgaaattatagctgtatgtgattgatttggatatattggacaagtttgcaagtattgtaaaagttgggattctctgaaagtatctctattatcagcaagtacaatcttgtaaataaaattgcccttcagtacaaatcttacaaatcctaaaatatttgaatgcattttttctaatattgaaggcgttataaactttcttaaataaaaattatttttagtgaatcttcaaaaaatgaagattagaaacgtgcagactctttagatccctgtaaaacataagaatttttttgtaatttattaatgaaaatatgtttctacttgtattaatcattcaaggtatgttgttagagcttccatgatgtttattgctatgttttaagccatggtatgccatcaaagactcacattgatctctcaaaatgtgaatgagccaggctcatatatacattcgagataggtgaagtcaatcaattgaaaaagtaatggcagtaaatatacatggggtaatagatgaggatagcattggttggatcttcccttaggccagttcctcactggatcatgtttccttctgctctcagagccagtttcctccaaagatctaatagtaaatccaaaggcagaagggagccttggggtgttatgacttcttccctctcagaataataactggatctgatttcttagcttactgaatggtttattatttcttcttgttactatggccttcaaaaatcttaaaaaagaacatttaaaaagttgattaaaattcagttattatcattgtttaattctataaaatgaataattcattttgctaatatattctaaagaattactttccaaacacactgtcttataagaagaaaaagaaagctttcaggatctagaaagaaaaagaaaaaaataagatttatatcatagaaatatagttgtaaactacccatttctccctgcctcaaccccgccttcagttacgtgacagtgtcagaagtctagcaagactacagaaaatatgttaagcgaatgacattttccaacactacagatatagattccctagtaaaaaatgaacattaaaccactttcacccccccgccatttattttgacatggcaattgcctactcaaacctgcatcttggaggatgtaatgtgataatatttctatatggttcaaagactaaggcaacagaggtagtaactgtgcaaccagtgtgctttatccatgaacttgccatgaacttatgaacaaggggggaaaaacatcctagtgggaagtgatagtagttgtagaattgagaggtaatgttttttctcatttgaaaaacatagttttggacacttctatttatggagaaagaaagctaaatcagaacatgcacaataagtagtaactaacagcaaaagaatgagaagacaaagtaggagagacattttacctataaatagtgtagcttaaagaaatcagaagatgtgggaggaggggtggtagaaaaactgtaattttcagaaagagtagtatgggtgtatttggggccaaagctgttttagaagggaaagaaaatgtcatccttcttaaaatgattaaacaacatggtatgagaagaaaactctgcctaatagcaaaagtaatttgacaagtgaagagaacatcaagaaaggaaaagtctcactgacaaaacagaaattccatgtcagcaagagcagcacatgaataaattattaaagaatatgtttgggttccttccttttttgctcaggaatacatacacattttgctcagaaatgcagctgatactctccttataatctcaatcttatttaatgccctttcagtcaaagtcgccagatcctgtctatttactgctctcatcctgcaaagcttatctgtgaatttgatgaacagttactattaccagttcatcaatgtcattgagaaacatttctaagtcttgagagatgctataatcttgttgattctgcctttaaaatgcatctgaaatcttatacttctcatcactcctatagttatcatattggtgctagctaacattacttcttgcttgaaatatttcagtagtctcctaattggtcttcctggttttggcttttgctcctgttacaaatcattctcagcacagtggccatagtgtttctgttaaaagaagacaaatcctacatccttgctacacacaactatgcttcacttccctcactttttcagaataagagccaaattcattacaatggtttataagtctctaaatgatcaaccctcttgccacttctgtgaccacatctctgtccattgcctcccttgtccaatctgctctagcaatattggactatttcaaattggtggaacacaaaccaagagcatccctacttcagagtctttttacttgatacttcctcagtctggaatagtcatccctcagatattgacatgtcgtgcttacatcctcatttccttccagtctgtgctcaaagtccaccatattaaggaggtgctccctgacctcctatataaaatggcaatcctacccccttactctcaaattctttccttcttaaccatccttactgttctccatccaataatctccatctgacatggtatatatttacttctttattgttagttgtctcccctctcgcattggaatgtacaattcacaagggaacagtctttgtgttgttcaatgatgtattccaagtcctaagaccagtgcctgaagcatactaggcactcaataaaaaataaaatgttattggtgtttaaagaataaagtaatcatcaaactatttgtgttacagaaatgttgcacattttgatgtaggccaaaaaagatgtcataatttcattcacctttgctgagtagaacatttttgtagtattatcatttgaatgtttaacattcccactatcatgtgcctctaaaagaaataatgcaaagtctgcatttatattgctttcacatttttgatttttttgtgtgtatgataccttatatttttctttatacttacatgaatacacacagacacacacacacacacacacaattgaccttttgtattcatgggttccatatttgtggatttaaccaaagagggcttaaaaatatttgaactaaaaaataacaatacaataataaagctacaactaaaaacaatacagtgtaacagctatttatataacatttatatagtattaggtgttataagtagtttagagatgagttaaattatatgagaggatgtgcataggttctatgcaaatactatgccattttatatataagggactagagcatatacagatttttatatccttgaggagatctagaaccaatactccatggatactgagggatgaatgaatatatgtgtttagttgatatttatgtgttatttttctatattttatatatatttaaataaatttaacatatttgttagaatacttatgataaggcaggcgtccccaagccccaggccatggaccactgctggacatatcgtgtgcctctaacatgaataatgcaatgtctgcatatattgctttcacatttttgatgtttcactgtgtaataataccttataatttttttttatatttagatgactatacacacagctgcatagcaggaggtgagctgcagggtagcaagcattactgcctgagctcctcctcctatcacatgagcagtggcaacatattctaataggagtgtgaaccctattgtgaactgtacatgtgaggaatgtaagctgcatgctccttatgagaatctaatgcctgatgatctgaggtggaacagtcccaccatcccctccaacccctcagtccatagaaaaattgtcttccacaaaaccacaaaaccactctggtaccaagaggtttggggactgctgtgataaggaacagattatctgaaactaaatggttaactttatttatttatttttttattacactttaagttctagggtacatgtgcacaacatgcaggtttgttacatatgtgtacatgtgccacgttggtgtgctgcacccattaactcgtcatttaatattaggtatatctcttaatgctatccctcccccctcccccgaccccacaacaggccccggtgtgtgatgttccccttcctatgtccatgtattctcattgttcaattcccacctatgagtgaggacatgcagtgtttggttttttgtccttgcagtagtttgctgagaatgatgtcccttcatccatgtccctacaaaggacatgaactcatcatttttatggctgcatagtattccatgctgtataggcatgggcaaggtcttcatgtctaaaacaccaaaagcaatggcaacaaaagccaaaattgacaaatgggatctaattaaactaaagaacttctgcactgcaaaagaaactaccatcagagtgaacaggcaaccaacagaatgggagaaaatttttgcaatctactcatctgacaaaggactaattaatatccagaatctacaatgaactcaaacaaatttacaagaaaaaaacaaacaaccccatcaaaaagtgggtgaaggatatgaacagacacttctcaaaagaagactttatgcagccaaaagatacatgaaaaaatgctcatcatcactggccatcagagaaatgcaaatcaaaaccacaatgagataccatctcacaccagttagaatggcgatcattcaaaagtcaggaaacaacaggtgctggagaggatgtggagaaataggaacacttttacactgttggtgggactgtaaactagttcaaccattgtggaagtcagtgtggtgattcctcagggatctagagctagaaataccatttgacccagccatcccattactgggtatatacccaaaggattataaatcatgatgctataaagacacatgcacatgtatgtgtattgcagaactattcacaatagtaaagacttggaaccaagccaaatgtccaacaatgatagactggattaagaaaatgtggcacatatacactaaatggttaactttaaatttttatcttatatattatgcaatatcacatgtaacactatataactaggcattaaaatactatatatctgggcatcggagttctagaaaaaattcaagtagcatttgtctatgactcccaccaatatattttgactcagaaagaaatcacagatcactgttagactaatgccattttttagtcagctatagacacagtgatgctgtgtgacaaagaaccactacattttagtgacatgtaacaattattatctatttctcactcctgtgtctctgacatatctttaatgcccattagtcaaagcagccacatggtcaagcctgtcatcaatggggctaagaaagactcttcatgtacatttggaagcgaaggagagtcagtattttccaaggaattgtccagactattacttggagtagagttttccaaagttattcattctcaaaatctcctatgtaccaaagccaaagagagctctatgggtctgccttgaagagaaagtttgttttatcttctgttgagaaaataaactgtctaaaatgaattgtggattccacagtaattcaatgtgaatattatgtgaatgaagataaccatagagaatagagctgcctgtgaaaaccaaaatgacagcaagtgctacacagaccaagagtctggaaaaccagcatgtcaggagggtgttatgagaactcccaagaaagggtgataactcaccatgggaggacttcccatttcttcagtgaccacacagggaatgtatttggaaattgaaaattactttctatttttatatgtcatctactcactctacttttattctgaattattgtctcttcttttaataatttatttactcagtgctcgaggtcaaggatagattaaaatggttcctgccttagagaagctcaagattttagtggaattatgaactggtcaatactatgtcataaacttatgtatttccctaagacttggcccaatatcagaaacataggtgataatttaaaaatgtttattgaataaatgaacacaataaatgaatgcattatgtccataaaatattacagttttatgatcttgttataatttaccctctagactttttaaaaattatactttaagttctgagatacatgtgcagaacatgcaggtttgttacataggtatacacgtgccatggtggtttgctgcacccgtcaacccatcatctacattaggtatttctcctaatgctatccctcccctagcaccccaccccctgacaggccccgtcgtgtgatattcccctccctttgtctatgtgttctcattgttcaactcccacttatgagtgagaacatgtggtgttaggttttctgttcctgtattagtttgctgagaatgatggtttccagcttcatccctgtccctgcaaaggacatgaactcatccttttttatggctgagtagtattctatggtgtatatatgccacattttctttatccagtctatcactgatgaacatttgggttggttccaagtctttactattgtgaacagtgctgcaataaatatatgtgtgcatgtgtctttatagcagaatgatttataatcatttgggtatacacctagcaattggatcgctgggtgaaatggtatttctagttctagatgcttgaggaatcaccacactgtcttccacaatggttgaactaatttacactcccaccaacagtgtgaaagtgttcatatttctctacatcctctccagcttctgttgcttcctttttactggttgccattctaactggcatgaaatggtatctcattgtggttttgatttgcatttctctaatgaccagtgataatgagctttttttcatatgtttgttggccacgtaaatgtcttctttttaagaagtgtctgttcatatcctttgccaactttttgatggggttgttaaaaaaaaagaaaatcaatggtagcttgatggggatagcattgaatctataaattactttgggcaatatggccattttcatgatattgattcttcctatccatgagcatggaatgtttttccatttgtttgtgtcttctcttatttccttgagcagtggtttgttccccttgaagaggtccttcacatcccttgtaagttgtattcctaagtattttattctctttgtagcaattgtgaatgggagttcactcatgattcggctttctgtttgtctattattggtgtataggaatgcttgtgatttttctcaccactcctattcgacatagtattgggagttctggccggggcaatcaggctagagaaagaaataaaggtattcaaataggaagataagaagtcaaactgtctctatttgcagatgacatgattgtatgtgtagaaaacccagtcatctcagcccaaaatctccttaagcagataagcaaatttgacaatgtctcaggatacaaaatcaatgtgcaaagatcacctctagactttttaaaaactcaatagagttaaatccaataagttagaatttaatgtggatggtcttgcaatgctcatgtcatacataactgataagtgataaatacatttgtattatatgaccaaatactgacatcaatgcctttttctcataatttccatttctcagagcatttttcaatgaataaattgtaatgaaaagactatggaaatagcacaatttctgtgtacatttcacttctaatttaatataaagctaaaaatttccctgaaaatgttctaccttctggacatatagagctatattttgctcaaataaatgcatatccttgttaagaaaagaagaatttattggactaaaaatctttgttattagctgaatccaaaatgtatttaggagttaaaatcatttattcagttttaatgtaaactgcaggatatgattcagctagaaagttactctgtgtgtactgggcctattagaagcagtttatgtgtttgtttataaacgatacaggatgaatgattcctgaacaatgttagaagcaagatgtcctgcttctgttatcattttggtaaagtgttaaatggggttcagtgtcttaatttgaattcaccattttaaaaaatagaaatttgtagaaggaggtataactatattgtaaaatgtataaagattggacaagatgatgctccccattggttctatcatctgaaagctctctccaatgtgttctgctgtgtgccccataaaataatggtccattatggttttatgttcttcttcctgaagtaatccaacaaggtagcctagtaatagtatcaaataattttttatgtgggttttgagtgtgtgtttgtgtgtctgtgtgtcttgttggctctgattcttccaaaatagaaatcagcctgcatttggtaactgaaacaaatgtttccagggcattttaaatgcataatttataaaaaccaaaaatggtgaaataatgcaaagattctactggcattcatttagctatagaaaatatgctaaaacactaggtagaacaggttttgtcttttaacattttaatgagctttgggactttcatgcatattagttatgttgccctaattactcattataattctaatgtgcattttatatttaattacaatgcttataaagatttggtatggacagtaaattattataactagcatgtgcatagcgattatgaactgaatttattaacttttacaccagcattcactgttggtaactttcaatttcaccttggtgattaaccacattgtctgattaaacaaatatttgtgtgggaattaattgtaaaagtcaaaatgcagtgtccactgttttgctttttgccaatttttatcaaatttattttgtttccacagctaatttcattactatccaagctcatttcaaaaatatttaagtaaatattattatttctttcttaattacttaaaatattataggtgtgttagcacattcaatagagagcctgatatcagatgattagaaactttctgctagggtaagtaaagctaagtagctttctgagatgtcagctaatttacattctaaagataaaaatatgcagctttttaaaataattctcacattttgtaaacattaagaatagttgtcatctatcaacaagaattctcttcccatctggcataatgcatttccaaaagtcttagatgttatttctttggcaagttgtttatattaaaatcacaaatagctccatattcattttccatccttgaaatttagtataaggctttaccagtgggtaatcaatacatatttattggtaattagaatggtaatataatggtcttataaaaattcacattcacttagtgaaaaacaagactaactagaatttaaatgtgaatgaaaccataactttatcagatgaggtctacatttttggaccccagatggtcttattcttgacccaggtaacattaaccttcagtggacaaaagaggatatgaaagacaaagatcatacaagaattaacaagaaagatttttttgaaaaatttctaaatatgcacgttcatacagtatagcaattaaggggtttgcattaaggagtaattcaattagaatcttaacttccagatgctgggcaagtatgttaatgttttaatactgtaattcctgcctctgtaatacaggaataataaaatctacttcaaaggcttgttgtggcaagtaaatgaggtaatttatataaaaaatgagtacaaggaaggtatggcatataacaaactcttgaaaatgaggtgctattgcataaatactactatcactctggttcaagttattggcagagaactgtaaatatggaacctacatcttcctaaaatccttccatatcagtataatctctttcttgatgtgtgtgtatacatatgcaattatgtatgcacgtacatattatacatttatatatgtatatatgtaaatatatgtgaatattttaataaaattttattaaaaacaattaacttgccatcagctgacaactttggatatcataatctccaaaataattccattgtttactatgtactcaaattcctagctcacctttaacattactcttatgacaacatctatagatgtttatgatattttaatatgatacaaattgattttattgaacttctatgctattagtactatttaataataaaatgattgcataaactattatattattttatatacattatactatatatttttgtaaaaatatacactgaatattgattgatatagcatattatagcaccactattaataattatgctattatctccataagtacattatgcctctaagataaagtttatttcttaattgtcattttattctctaaattacaaaacatttattgaggatttactgtacatctgttatgccttagcagctagaactatgccttgaatataataaatatttgtcatctgactgaacagatgaatgaattatagttttcctactgtacaatctgttaacttatgggaaagcatttccaagattatttttctttcataggctgtgtttacaggctagataaaaataacaaagtgataggtaaaacttctgtcaattcattaagtgattttatggcaagattttctgaataattgctgttatgaattaattaatcaggtattttgttattaagtagatataactgcatatgtctttaaaatatctctaataggatttaattctataaagtttttactttcaaattgagttcaggccaaattatattttgtttgtgctaatttaatatgtaacactctcagtttttagtccatttctttgtcatccatgaatttcaactaacatgcccaatttcacttatgagctacacacattcataaccagtttgtatgttttctacacctacacctccttgccatcagtagatgccacagaaatttttttgtcatctcttcagtaattatatattacagtcccttggcagtcacagatttaatgtttatggttcttaatttaaactgagcaattccaaaagctcactaattgtattgttggtaatttttctgtggcctaaatttgcatcttttgtgattatgttctgggaagaatggaatggaggagtttgagtctaaaagtgggaagattggctcaattcagttcagaagtcaagggctgaactatgacagtttcaaaatgactggaaaatcctgagggaagaaattaactaaacatggaaactggggagaaatgtttattaccatggaaagttagagagggagagaggagagattttcatttaatgtctttggcttctctctacctccttgcttactgccacccaaagaaagaagaacaactggtatttgcaagtacatgagaggaaatgggcatttatagattggccccttcgctttcttttctcctgattggcaagctgtcagcaggatataaccatgttctcagtgtctccctggaggaagttgtacaaaagcacgcagcccatgtggagttattatcttttttagccaaggctgttgtttccagttgtgtctatgactggaatataggttcacttgtactgagtattacaatctggtgcactggaccaaaaaccttgagacttataaacaaggagtggaatttaaggagaaaaaattcacattcatagatataggttttgggatggatccattgttttttggacttggagttataggcacaccatgtggattattttatacttatgtggctatctttgaactgctctgaccaagaatgcagctttaggtcttaggtttaggccacgtgggatttttcacactagctaatgggtctttgttttgggagagtgaccattattctacaggtgagcagataaataacatagaaacagagtcattttgtacaggtgcagcctgagcaagcagatgagccatctctgatcttaagtaaagagcaggtgcacccagtgggtggctcagcaaaatgttattggcagaataagccaggccaaccatggccaaatgcaggcagcaccatggaagcttggcagggaccagccaagctggctttaatgtgtaggctgctgatgctttgaactatactggcacatgtggcctggtaacatagatgaggtaggactcttccatattgttattatgtttttcagccaaggctgcaggatggaaagccagatccttttcatcaaagagatcctgagttcctaaataggtaaaaactagttcagctgccacaaattctgtttctcttttatgtcttgaattgattttaggactaaaagaagagagtatgaaggggtaaccttggaaacacgaggcctgtccacaggttattaagagtcactccacattactgtggtctcaaggtgggtctagacttactaattacatagtcttaggaaatggctctggattgctgaaatccaaattgtggctttattcatagaagggtcttagatattattaacaagtaaaattagagtccttattattaaaatagtccatctctatggatgaaggttgagaagcaattcaataatactactgcagactcacaggtttaagaggcagttttaaaggcctgggcaggaataagaaaccaggtttgctcaaaaagtcaagaaagaaaatgcttgttccagtcttataattgaggaacaatgattaatgaaatagaaggaatccagactgattaaatggtagaagagagacctgcagaaaaatggatgaaatctgagtggccagttcagatagatatcaaggggaacacaggataatggaacccaaaagacaagtatatattggaagaaaataaatgtggtttccattgttctaatcaggatttaagaaaagggagatacacattaattattactggttcaaaacaaaacaaagaagcctctcccgactttaaccaccgcccgcacttccaccccagaaccaacacacacaaacacagaaaaacaaaactaaaacaatctatcactttggctgcagcctaaatataattttggaagagagccagaaaggataggagagaagagtcaggacatattgcagcaattgaggttgaggcatagtagtatagagtactatagagttatagtagtagagatgcaagatgagaaggggtttgagagaagtatttgaggcaaaatggagagagttgaggatagattggatctgagggaaataaaagatggagatgttaaaaattgttcttgggtttgtggctagcacaactggctggacgatcatgccagtccacactgtaaatggttaataatagcagctgtctggtaaacctaacttcagtttgaaaacatgtggagtttgataagctcttcagaagagtcaatatcaaatgaagagatatgtagaatgatctggggcttagaggagaaagctagcctggggttatgaatgcttgagtcacccatgcaaaagtgttaattgatgtcatgggtgggatgagattttgagatatcgtgtccttacttttaatatacaccttaagaatgcttcatattgtgtatattttgtcatattttaggttcttgatctgggataactatcattttataaaatgatgtttataaagttaaaaaaatcaagtaaacacttgacaaataaacaatagaagtaactggtattttaaaagtgctttaatctttctcatatacatataattatctatactatatagcaatagataaatgtttcatcgttttaaaatatttttgaatagcaatcctaagagtggtattgttagggtagacccacaaataactaaacattttgttaaaaatatattacaataagtcctaatgaagaaatattgttggccttgccaaaatggaaagtaaataagagaaggaactaaaatatccaagagatgtgaagaaaatcatttctattttaactagttccagggaaattaataatctggaggttctttaatgagtatttcgtaccttcctcatctttattaaaccatttcatttttatgttatgtctttcagttttattttttatcacaaaatggcagaaacattttttgaaggccacagataattaaaggtaaattaaattctatgtgatgagcaaaacactgaaagtatagaattattattaggggaaggttaatcatgaattgatggattgacaggaaatagcaccgaatcattgccatcaaaagcaagcttctccaatggaaaggttccataagattctatcaggtgctcatgattattttctaacaggcattatcaaatagtatgctgcagacattcagggtatatttgtattcaattttaagaaatgtctgtactattgtggagtggctgtcatattgtttgccattttttaatttgcaaaatgcctattttcataactgaatgctattcaatggagaccttaataataaccaagaattgtgttccacttagcaacaagctagatagtggttcgaaatgttcttggaggtccttagaggaatcttttgccacatacccaaggtactgttttgataatattaatagtagcccaatactttgaagtcacgggaaagactggggtaaatgtgtgtaaaaatccttacaagtatttatgtacggaataggaatagtatgaaaagacaatttattgtgtaaaatttatggtatgaagaggaccaacagatgtttattctagttctcccgttttaaggtagagagcaaaaaataggatttaacatttcccagaatcatggggttcttgtactatagtgtataaatcttagcacatatcattgatttgaactattatagtttggtcttccctactttcatgtgcatgtgtctatcacaccaagcatgccagcatattattacatattttcaagttccatgtttattcaaagcaaatattcattaagtaacttatatgtcctagaactttagggtatttatggatgaataaaacagattcatctcctttcaaaaagaggcttttaccatgttattgcttgagtatatgttcaattatatatgaccataaaaagtgtaatatcctaatataaaattaaaggaggggggttagtttaatgagatgggctttaaagtgatgattattttatgtatataatttggtatcatgcaaccctatttctatagatagcaaagcagcagtaacagaataaagtctaaatgttcactgcttagaggattataaaaaaatctctataaaaatttgtacatgatatgtaattataattagaagatagaatagggaagcagtcgcattgatgtcaccatggttaatcaatatatactatgtatatatttctctaaaaccatgaggaggagaataaaagtataaaaagaaaagaaagaagaagagggtgaagacacagagggagacaaagaagcatcattggcggtaggcatggagaaggcatgcagaggtcacctaacccacgttactggatatctctgggcattatgaatgcaatctctcctcactcatagagtccctatctgaacaccagcaatgataattaatctatactaagcatatactatttgccaaaacagcactaaattctctaaatgcattattttatttaaaaccccatatgtctggtgctatattatttttatcatttagatgagaaagctgaagctagagaggttaaggaatcttcccaagctcacgtagctgataagttggattcaaatccagaattgtctcactcagaaattctcattacactgacaaaatatggattattccacaagcactttaaacatggctatctctgctcaattaatcttagagaaaatattattttcatctcaattgtgccactacctcttctttgaagccccgtgacatccttccacggagacatcctgccctccagtgtgctctcatcatatgaatcacttgagacctattcatgggcagcatgtcatagttttggaatgtatttaaattctcagtctttgagcaagttctctagccttcataagcctgtttattattggtaaaatgagaatgaattcttccttgtagagttgtaaagattagagaatataaaaataaagcattttgtgagtgtctggctcaagaaaggaactcaaaaataagaatttctgtttgacgcttgcttcttcaagtaagatgtgagctgcacagtgatagggacatcaattgagcatgtagtctatgccaggaactattctaagcacatttcatgtgccaatgcatttaaccttcacaacagttctgtaagtactattatgatttccattttacaactaaggcaaagagaagtaaggtgtctaaggtcatattctaaatcattactatcttatggatagtaaacctttgcatttaataaccttttacagtctcagagaagaacgttattaatatactgtggcatctcccataaggttacccatgtgtccgcaatgcaagctgttagtattttctaagtcccctttaaaatgcccttttcccccatattcaaaatatgtcactagataataacacagtgtcttagtactgagagaaaaatagttatttgtagtttttaacagctatactcacattcatttcacctatcacaaggaggaagaataaaataaaataaaataaaataagaataaaataaaaatgagagtaggcctatatcccaaattcatatactcacatgagagctgcaaccattgtgtcaaaggagcacacattgattttctctgccacatgtgctggtgctcagagtacagtgtaagtaaacagaaaaatacaccatccttgcatagaatacttctgcatatttgaagatgaacagatgttcagggaaaaaaaaaaaaaaaaacaggacacaaaacaagttccccatgcccatgcccaatcacaggctttgtcaactaggtgagtttgtgctttatgattttcatcaactgaaaaacagaattgcaattactgagcagttttacagttcttcaatgtgcagctacaaagagctggctcaacaaagccgtatctcatcacaaaggtttgctgctcctatttcctctgttgctactcttgctgaagatgttttgtcaatattttctcaatctctgtgtttcaggcagcttgtgggtgagtctgcatgatggtcttgaagtatagtggaagaatatgtgtatgcgcacctctgcacatgtttgtaggaagttagaaggtgaggcatagtccttggacaccagtatattaaaacattttctcagaatatacactgtgctgctggtgaggggggaaattagagtcaccagccattactcacttgtgtttgggccccaggcatttgcgacctgccaagtaatgtggtataggcccaacatgggcacatgtcattagtgcacctgagtaccagaggcagcatgaatggagacgtacatttcatccagagtgtcttcatgatacattagtagaggggtggaggaagggaatgggaaaacatgaaaccaatcaggacttacaaggagaaaaatcaggccactcttcttaacacacacttcctccattcattcccaaggataattgttatactttttgcaaacaaatatccatggatcgaagcagaactgctctgcttcttttcctgaatggttaattttagccttatatgttgcctgctcttacaagtcatattttccttgccacaattatgagcctactaaatgttctctattattctctaagaactagtaatatttgcaatgtgaatgaactgctctccagccaacagtttccggtatgggttatcctgtgcaggaacaaattacatgtgaaatgcattcaacttgggattctctttgttaatgtgtggccacactgctgtaacaataagacagaaaatcttggccatgaagatggctgtgtagtaatgcaacttttggctctgtagagactcatgggacacagacctctaacctgcttgcaacatggagctccctcgaaactgaaacaaaggatgcattgatatctcagagtgtcaaacggaattattccccttcatacactcctctggccttccctactgattcaagccagggaaacaacatgaatgcaatatcctggtatctgtgaatggtaagaatttcctctcttaacaaaagggatggaacgtgataagcagttggtaagtgttaagtctttttaaatgtgctcacaaatctaaatctctcccaagaagacagtcacttgaaaaataaagttctttattaataactcagtatcagactagaggaaattatctcaacagctgaatatagaagaacttaaatattcaacctcagaatggaaaattaagaagtcatttattatttattaaaaatcgagagcttctgactagaacacaatgtctaactactctaacttggagtgaccaaatatcttctctattaatagattgaaatgaatggctgaaaacagacattattcttatttctttttgtattcccaacacaaaaagtgcccagaactaggagttctggacactgttgagtaagaactcaacagaggcttatgggatggatggtgaatgactccttgccattggataattaaccaaaacttctgaaacaaagaaattcctacaaaatttttagagaaaaccagctgcaaattctgctcatgttgattttgcagaaaccacacaacaaagtatgtaaatccactaactcagaccatgtttctgaggacactgctcattacgactgtataataaatggaagtgcacaagtcaccattagcacagaacagattgtttgcgtagcaaagacagcagctgtcacagcttgacagctttcttgttagtgcatcagctttatagacagcctatttgattgaaaaccactgttcactgacagtgtgttatagctgatatacatatgtatctcatgaaaaatgacaccgttgctgaagactcacgaaaggttgagaaggtacagttctatgaaccacattaaaaaagaatgaagtttctataaagcaggtccctcggtgtataaaaacattttgtgtacagaaaaaacacacaaatgcatgaaaaagcatgatggtgacccagtggtgggtttcctctgtattctttaagctgatcctcctgtcatggagttttatttgcaaccaaatgagactgaggtgaacacagaacccttgggagaggcacattcattccatttcttaaatctccagactgtcaaaggatgaatatgggttgggggaggatatcaccttctcagttttgaacttggggtaggaataccataagcagagtgggaatgacatcagtaagcagaaccagtcatgcataatgcaagcaggtgcggtacacactacctagcacagacttgacaattcatttcaatgctgaaaagctcctgtttcagcagcacacggcccctgtctgagtagagatgtggagataagaatagttcagatattctagggttatttgaagagtgacaagaatgacatcttgctggaacaagaagcaccagatttactcatttggtcttctctgaaaggttcactaatttatgttccctaagctcttctttaggatgatccatatgcttggggccttaggaagtacggtgagttagtgcatttacctgatagctctgtccaagttcccatttgtcatcatctcatattttggcagagtttctggcctctatacaaatgagagacaggatcagaataaccaacatgtctgtgggtcaggggagcgacacagtgacattcagacgttcattgggataggttggcagggctgtgcctctcatcactgccaaactctcagctgtttattgtgtaagtgctgctaataatgagtgtaatatggccaggagaataaaagtgcttaagccaatgttaaaatgtttaaaccatggaaaacagataacttataaagctgataatgttagaaagaaaggaagaatgaatgaagtgtaattcattgaatgtggagaaagaaagaaaagagagaaagagaaggacagaaagagaagaagaaaaggaagagtgggagagagaaaaaattgggggggagagaaaaagagagaatagaatgaaagagatcaactttgtaagcccttgctctctcaaagatgatctcacaatcactttcccataatcttgctgtaacaccaatcagactctatttaccaaggaacccaacttaagacagtaattcaataaaggactatgcagtcaaaaaaaaaaagtgatttgagatcacaaatcaatgaaggaagtacggtttttgttgctttgtttaatctgctttttcatttgtttactcagtagactcactagaactaatcaagtaacatggtctttctttggtatttggtatctagtgggaaatctataaatgtttattctatcttggcaatttataaatatatgtcctataaaagttaaatgtgtatctcccttatcttttgtggtctttctttttctgagagctgtagcagcaagagtcccaggcaggtagttacccttttatctaggattgggcctgtaagtattactgagacttttaggtagggctaagtatattcagaagtgaataaagaaagttcataataaagaaggggaataaaaagaccagacaaaggagtaaaaccataaacttggtgctaccaatcccttcaaatagacagagcagctattcctgctttgagcacacaggtcagcctgatgaagtaggcagccttgtcctcagtgtgatataaaatggattaaaaccacacaaatccccaaatatttgcccttatcctctcctgacctgacttttttccatgcatattcttgccatgatgttaggcttgtcaacatatctacagaacacagttaccagagaacattaatgcaacgtatttgggcaggagagaccttatgtatcagccaacatcttctcagtgatggcgatggtattggtgatatagtgattgtgggagtactttcgtccagaaaaaaatgatatgctggaaaatcagtagttaaatatgggaagacattgcaaagataggcaacaaaagttgcattggatacatagttcattgacttttcagttatactaggttaaatttatctgaaatacatatatcagccttttatgttgactctgtgtttccaagacccactcttaggaagcaggatggatagaggaattagcctcaaagaaagagagaaaaggatattgctattcttaaaattttcaccattccaatcatgatcaaacacaaatgtatatgcatgtaggtggtttctacaacttgtaaactctaaacttcttcaaattcaggctctgaaatattgtaattttcctgactccaataagaattcagaaataatccagactcatcttgtggtaaatagaatgccttcaagactagtatttgatatgatttggaattataaacagtcaatagaaatcattcattagctttcctatggattttgcaaaaactgaatcaaatttaaatgaacaataaacaattgatggcagtttttattacttctagaaagtatgatattaacttcctgtggaaaaaattttacactgccacagagaaagaaaccccaagtaatggaggagaattcttttcttgtacagctaagatctcattccattgatctggtaatggacaggtccttgctgcccaaaagagttccacttttctttggaagcaaaagctaaaaccactacactggtccctatgagctgattctttggcctttgtgatcccctgactgactcttctattctttatttgatttgagttcctctctagccacaccagcttcacctgtgggttttagcactagtttttccccagggttagaatactaatccctagaatgccacctaactagcttcctgcttccttctagtccccgctcacacatcacattctcactgagtcctacactgaaaacaccattaagaacataattcctaaaacccaatctctctttacattctctaggcttctcttttttccataatgtttattgttttctaatatatcatttaccttgtcttcttttctattgcttttaatgctaactgtttatggcctgtcttttgctaaagtggaagctctgtgaagccagggtctgctttatttattcatgtatctcaagactgtgagacaatgtctgacatatgataagtactcaatacatagttgttgaataaatataataggtgtgtgagatcttgagaatgcaacttaaatacatgcttcaatttctgtgtatttcaaatgaaaatgatgtcaactacggtaaggattaaataggaaaaatattaaattacataacagcaagcctggaacaacatttataagaagtaattattattaacattgaaaggatcttcactgggaccagaagcctcttgtgttatttccagtactagagagatgcttatccaggggcttatttcaataacttccccaggctactatctgttcacatgtttattataaatgaagtattctgaagtctgctggaaaggactattttttcccctcaaacaatttctctctttagttattttttctactggctttcctactagctgtactcacacaatttacacatttatacagctctaaactttatataactttgctaccttgacaatctatattaaggtgttcttttttccaccctcaaactcaagtcggaaaccaacctatgtaaaaagtcaggtttgcatcacgcttttcagttttgcttttttcagttctaggagatatctttgattatgttctactgtggagttatttttagaggaaccacacacttgctgattttgaataatgcaagcactttcagagtgctttgcacatagtatgcatagtactcactgatatttgttgactgttaggtaaataaaactttatgatacagtttaagaataacagctcaatatactaaatattcaggacagcagtaatcctctcaaaaagtttaccctttgaaagcagaaagaaatataaacacttgatattagtgctatttatcagataccaacatttgttcatataatatagtcttagaaatacaacacactcctgaataaggggatttttctcattcccacagcagaaaaaaaatcttctctcaataattatttttataatgcagtaacgaataagtgaaataagtcattaccttaggcctttttatgtttttaaaatattaagtagaaccatttttgaagctcttggtaagatttaacatcttttggaggaaatgactaagtctgaagtttctggacgtttgaagaatatactggaagtaagaggctaacatttatctccacattgtctgtagttctttgacagattaggtacagtaggaaaaatgggtattaaatttcaatcagggttaatcagctgacatatattgggctgtagagaagttgagtaatgattgggaagttccatatttaatcactgcttggctgcctagcactgcataggtaatggactctagacaggtatttttggattacaacattcttagggaagaataattacatctcagaattttatcctatccttctattgcccccttaccttaaagaagtggaaatactagtgacattttgccccaaaatgtgaaagtttaccatgacaatattttagtctttccaaactgggagggatttttttgccatttccaacaatatatgtatgtgcttgtgtatgtatacatatacacacatacatatagttgaatacatatgtacatgaatacacatattgttttgtacatatatacacatacatatacataaacacatatatatacattcatatacatgtctatgaataatgcacatttttttaaacagtagttcattttcttttctttgatctcctaaggaatagtgcatataaattagaaggccacctgaactggtgtaatatctcctctggaaaaagaagcatagtctagaaatttataaatggctctgaatataactgacctgaacccttgttacttaggaagtctgccagaaatatcaagaaattaattgattattttttcctgaaaattataggacatgacaattaaaagaaagattgatcttaggttaaagcttttaacacattagttcatcctggctcccctaatttagaatgtgtaccagagagcaagacaatctgtttgaggaatgaaaataattaatgagcaccacacatttgaaaaatggcttctctctttatgtttgaaaatacatgtattatttctcagcaagccataactgagtctgtttatccttgaccagaggtaataataatagataagtctcagagagaaaactgatctttttttattgctgcattactgagagggctcttcagggactttacaagagaaatactgaaatgttatcaatgacatcaataaaggacaactcatacacaattgaattaacaattctaacataaattattgtccctgcatatattaatatttctactaataattattatttaagaaacagactataagcgaatacactaagacaatagtgaactatggatatggtatctcaccttaggtaaaaataatcttcatgtttagaagttgttgactcgagccatgtcaaattcacattatataagaagatatgccaatggaatagctactttattggtaaaagcaaaaccgagagaattctttatattggccctaaagtgttcagggctctttggactcaatcccactcattttttcataacctttattcagccctgagcctaacccacaggaaagtttcatttctcaccattttcattcttgagaaccaactgggtccccaaatacatttggtagggtttctaaatgatcacagaaagtaatcatttttttccagcccaggggtccttaacatagccttacaaataactgttagaagtttgatctgccaaaatttcgctcaattcacaggatttgcattggtctcatgtctagtaaagaaggaaagcactatgtctttcccacatttttatttttattcatattattattggtgaagaaatagtcatttgaccacaagaaacatcattaaacacaataaacataagtagatggtgttagtagatgaatggtgttagcagatgaacttcctgtaagccatttttctttttgcttcctcctccctcctgacaagccacagtgaccattcaacgattcaagtgagagctgttgttcatttgtcagtttcctcatggtagagacagatttatactgagtcttctacagtttttcctttattcacctttatgactaatgtcactatttgcagctaagagtgaaagaaaccaggaattgaacacatgatctcaatcttattagcactatatactgaactacagcagccacttcatacctacaaacattaaacagcctggcttgtgacactgtgtaaacttattatagtatacatgtggccacaccactgacatatttccctgaaattaaactgttatgtcatagctcattcaaatattatccacaaaagcataaacagtaaggaaagaaggtaaaagtctatatatatagtgaaaagcaatggaggacactttcaattccagtgaaacataatatttaatatatcctactagtttttcttgagcctgaaaaatatgcagccaactggccctgtccccattcacagttgtttataactttcttaaaagaatgctttggggtctaaaatatcttataaatcatcttggcctagaaacaattttgctcagaaaattcaatttaaaacaaaaaccagaacagtttctgaattacctgaccacagggaagaagaaagcagttcagctatttaaaggtatatatgcagggaaacacaatgtttttttaaagactagcatggcccaggaaacaaacaacttgagtgtgagctatacacagatgaagtccagtaattctgataacatcaaagaatgttcatgtttatttggtcctgttctctcattttgaagatgagaaaactgagttacacagaagttaaattattcattcaagggacaaacataatattacaactctgcctcaagatgtttccatcttgtaaaactgtacagagagcattcaaaagggaataggaggcctggattctatttctggcttttcgaacaagatgagaccctaggcaaagcacttaactgctcagtttcctcacgtggaaactctatgtaagggttagagcatctccagaggtcccttcccactctaaagatctacggttcaatcacagaaattgctgggttgtttcttgttcctttagtttgcttttccttgagcctttaaatgatgccctgatcacaacccttcttgttgattgctcacaggcctggatttggaaacttacatgtctctctctggcttgttcattatatatctctgctgtgttcaattttcactattatctttccataatgaaacctaaatcttcttttacttcttcattcgttccattcagttccatacttcaaagtgattttccaatgactccttctaaagactagttaaatgctttccctgatcttctcagttgaaattgattattctttttctcatctacaatttctgaattttaccattctctgtagttattgatgtatatgtagaaatatccaagaagcatgtgtaaaaatgtccagttttacttttaataaaagtaatgccaattacaataagatgttattattttacctctcaaacatgaaaatattaggaaatgataatatgcagtactagttgtatgtgcagaaaaagcaaaactttcatattctgagagtataactttaaaccagcatagccttttcagagggacaatttggcaacacatatcagaaggcttaaaatgtatatctgatgacccaggaattccaattcaaagaatctatcctaaggacataaacaaagatgtacataagagcaaagtacatggattatcatcacagcattattatataactaaattggaaacaagctatctagcaataaaatgctgttttaaattgtggtgcacttctacaagataccatttagctattgaaaatcatggtcatgaggcttggttaattacctaggaacaagataaaatacattaaagtaggaagggtgaaaaacagtatgcagaaaatgtgtggaaacatgaaatctaaattttttaacagtgattctttttggatgaatattatttttctctttattctgtaatttgtaaaactgacaatgaacttatattacataaaaagaagaagtcagactataaatgtggagaaacattatgttctccctggcagagtttcctagtctcgtcagcctgaaggctgagataaatgccagttgagaactcagaagtctgcagcttcattcctgtgtctcttatgtgtgagcttaagacaagtcagataacttttgccactcagtctctgtgtctgtaaaatgatgggattggcaaaggatgaactctttgatattcttactttttcattacataattccattaaatacctagtttatggaaaaatgagaaaatacaggaattatactccatatggaatataaaacaaaataagtaacaaaaatgtgcaacaaggagttggtaataatagagaatattttgtccctaaatctgatactgcagatttttatgtatcttcaaataaaaagaaatgaaaagatgaactgcagaaaagcctcggttctccacttatactcttagaggtggaaaaattcgaaacgattgagtcagcccatatggaaatgctgggatgttcaacagaaatttcagtgacccctgaataacaggagctgtgattgccagctcctttctggtttgaactggaagttatagcttacactatttatggtgtaatgactccatacagatggggaaatcagatcaagtggaatcagaactttgggttctaattagatccagctgttccatggaagctgaatctttaggactgaaaactagtaagaacaagtttcacattttaaaaagtacattgaacctgtgaagatataaatgcaaaaatgaccaattttgaaatgtagactgcatttgtcttattataaacaaacgctgtgtttttattgctgttctcaagaaaaggctgtgcaagttttctccctgttgtttgctcataagcatacttgttttcttttcttttttggtcttgactatttcaagaaaactttctatccataaagctttattctttaagttgtatttttgtaaattttgattaaaataaatacaatgtcatcaccatgtgctctaaaatggaattgtgattttgtagtataaaagaaaaaaatacaattttaaaagtgtcagctattatctgctatatggagatcttattttgctttgtaatgactttgaggcatcagctttttcatacttttatttagggcagtagaatgataattagataatacattactttgtgcttttttctgagggagatactaacattgtttacctaccatatacctaactcagtctcgaaaatacttttctaaaagcaaaacaaacagaaacccataactatgttgaatatagctttatctcttttcttggctgatgtacaccattctctagtatagtacctgacacgtattaggaactcaaagaaaaactaagacaaatgaatttaaagatataaatatttgtgattagtgaatgaaatgtgagatgtaaaatatatttacatgatcaaagaataacagtgacctatatatgggggattatgcctttgctaagctccacttgcttgtagagagtctgtttggtagagtggatataacacttgcattgatggggggaaatgactgaagctcaattccaggatcagaatgttacttgtatgatcttaagaaaactcattaaatttttttgaatccagactgcttttccacaaagtatgtatgatgatatccagcacacgggattgttttgaggtctgagtaagaaatgcagagtctataaacagtattatattgagttactgctcattgcatgtgcccattaaaaccttgcttctcttcttttgctcctgtcctttgttttatctttaatatctttcagctgctttaattaaaatacttttcattttatccagatagctcaactgtcatttctctctgaatcctattctgatcccccaatcatatgtgacttcagtatctttgtcatggcatttatcatattctatcctgtacatgttgaactcacttatgaatgtatatatcctgtatattagtatatttaatattaataataacaacaacagcagcagcataagcagcagctaatatcaactaaacacttactaggtgccaagtacctcactaagtatttttcatacgttattgaatccttacaattttataaggtgccagtattacttttgtttcaactttccatactgaaatttatgttacccaacaagtgaataattccctgtaaatttcttgagtgtgcttactaaattccaggaattatactaaatgttttatgccaactcttttgcttcaagtatgtaataattttatgaggtgggatttatttgtattttacaactagagaaactaaggctcagaaaggataagcaacatacccataaaacccataaatgagcatattaaaaaccaagatatgcccaattccaatcctaaaatctgcattcttccattatccaaaaacagcaatgtctatttctgccaattgcttgagaaatacttctttaaaaagctgcattacttctcacacaattatttgcatgatgtcataatattaatctttatcatttttttacactatcaattactcagtctttggtaaaaagtaatttggttagctattttagtttgtaaactgaataaaatgttttctggttaattccagtcttttttctcattttttaaaccagaagtcagcaacatggtcaaatctagccatctacgtttataaataaagttatatggaaacgcagcacagccattttttatagacatatatggctacttatatactacaatattagcattgagtagttactacagacaccatagggccaacaaagcctaaaatatttactattttgcccattatagaaaaagctggcccggtgtggtggctcacgcgtatagcactttgggagactgaggccggtggatcgcttgagcccaggcgttcgagaccagcctggacaacatggtgaaactcagcctctaccaaaattctaaaattaaccaggtgtggtggtgtgcgctgtagtccaagctacatgaagggctgaggtgggaggatcgtttgagcccagtaggtggaggttgcaatgagcagagatcatactactgcattccaggctgggtgagagagtgagatctcatctcagaaaaaaaaaaaagtttgccaccccctgttctaaataatcttgggttcttttttatggtcttattgttggtaaattattttcttctctttgcacttaatatttgaaatcatcttgtcagacacaggtattcactgactcattgacctccctgcccccatttcaaagtacattcactgatgctaggtctgagaactcaaagctctgacttagttaatgcttacaaatattttgttttcttcactttttttgtatttaaaattcaaatgtttttcaggcacataattcattaaaattttaataaagggatgaaggaagaaagagaaaatggtgactgtaaacagtctatgaatctatacctctttactctccttttaatctacagtctttaatttaactaaaatacttgttggaatatttatgaagacatatacacatacttagaaaacatgaagcaatttaaaatatttcaaaatagcctaatattcatgtgcacaaacttttcttttctaaaactgaaaaattacgtcaacaacttaaaaagctttccatttcagaaattcttagccaactctgtgtatgaaatgggagttctttttccacctcattctttttacgttgcttgcttatttctttgtattagattgaggtctttgattttcatttattgtgtttttttaatcaattgactgtacacccttatctgattactagtcattattgttctagtctatctgaatttacaaaataagtaatattcattaaaggtagatatttatcactggataaaaagcaacatctttgtatgccatgcatgttactattacttctatgaccatcacagctactgcttctgttgatgctggcatgcccaggtaccgtgctatggctttacgtgtgattttttttttatcatgaacatttcaagatatatattaatatttttcatttgagagacagcaaacctggaagtctaagatctttaataaattgtcaagttcacacagctgaaacacagcaaagtcactttcaaaacccatggtttcaggctccaaagtcctattctttccacttcatgacacctcagataactctctttgttatgaggaaacaatcattatataaatatggctgtgtattattcaaacttaaaagagatgagctatgaaggtataaaaagatggggaggaaccttcaagtcatattgataagcgaaagaagccagtctgtaaaggctacatactgttatgattcaaattataagataagaacttctggaaaaggataaactatggagtcagcaaaaagtaagtaactgtcaggggctcagggccgggtgtagggaaagaacaggtggaatgtagagtattttaaggcaacaaaactattctgtatcatactgtaatgatatatgacattatgcatttgtccaaacctgtattatatacaataccaagagtgaacctaatacttgattaatattaatgtgccaatattgtttgatcaattgttgcaaatatactacatgaagacaaaatattaataataccgaaagctaggggttggaagtagagggagcatatgaagactctgtatacttcttgcacaatatttttttcctaaagctgcaactgctcagaaaataaaatatgttcaaaataaataaaccataaatatggttgtgacttaactcacattgatatccttcatctattatgggtttttggaaagtgaatattctgtaccctgaacatattcattggggtgtggaaaggcagtgccagtgataagatagaacacaagatttatcataggttaatatcaaataggtcaagtgatagataatttatgaaatcattctgacagaaatgacaagtgatactttttaaaacaagtggatacattctacaaataaataaagttttgacattatgggttgctagttttcaatgaatacataaatttgggaggtctgtctaatatacagctttaatcatggaatactaaatattttcccactgagaaaaaaagttccctggataaatagtgattaaaaaggcaacacattttgtattgtgagagtcactggtgaatttgaagtgaaatcacccatcagagccaatgtatatacatttgaattttgtgtttgtcagttgaaatttcagttctgtttttggccacgtccaattgaaactcctcctgtggaataaaaactacacagttttaattccatttaaagaagaacttattaagtatgcttgtattcatttattcaaggagattttattgagtatctttattttggcagagtctagaactaattgctgtggaggaaggtctaaaagaaattatatttgtgttctgaaccattaagaagcttacaaaaatgttaaagagctatctcaagcaagaaaaatgatagaatattccagaaaagtgtattttagagaagtgatcaaaccacatgtatgaaatagtcagggatacctatgaaaatgacaccatttatacctaaagccttcagatagagtaaaaaatagactccttatataaaaattacatggacacatttacacacaaatatttgcatccaattttaggacatttgtgaactgcctttcttcctacagtgaatgctcctttagtactgggaattccctagcattaatataaacaaatgcagaataaaaattttgcaggaggcagaaatcagtacctaatcacaaaaccaacatcctaaaggatggaagtatctagtgaagcaccaattcttgttttgtgacatatattacttgatgagggtgggttgcagggcaatagatagaatggtaaacaagacagacctgtccttgttctcacagagttctataggtactcagaatcacagtctagaagatactgagaagtttattatgcaaatgattgtctcatttgagttgtgaaaggcatcacagagggaaagtagcagttgccacaacggtctattagagggcatcgtgacttaatccaatgccaaggtcttctaaacagtcaccctagcaagcttctgcttagtaacaataagtgtcattgttattagccagattcacattattacctttttaaagtggctaatctatgttgaattctatggtaacagctctctgcattttattaaccctgcaaacaacctcatagaatatcccatttataactgaagaaaatgaagcttgcccaacttcagagtatttaagagccagaaatgagttcttacttgggcataattgatcccaaactttatccccacagcccacttcccaatctgcactgttagttttaagtatcagacgcagtgacataaaaatggggtcattatcattaaactctcatgacgtagtaaagaaagcagaattttccgttagaaggaaagacagttctgatggcccctattctccttctaacaggaaagaatcccttaacatttctgagccttggtttatctatataaaatgagagggttgactaggcatctcttaggctttttacattgtttgtttgtttttgttttttgttgttgttgttgttgtttgagacggagtctggctctgtcgcccaagctggagtgcagtggcgggatctcggcttactgcaaactccacctcccgggttcacgccattctcctgcctcagcctcccgagtagctgggattacaggcgcccgccaccgtgcccgtctaattttttgtatttttggtagagacggggtttcaccgtggtctcgatctcctgacctcgtgatccgcccgcctcggcctcccgaagtgctgggattacaggcgtaagccaccgcgcctggcctttacattgttaaaattatgaaaacttttattgttgagcttctatagacctgacacaaggggaactctcctcataaaagagagaatttggtgttctatatctatggataatttaagtaaaaccttcagagtcttaattacctggatgcatcttgttaggctctgggatattttgatttcgtttttctaaataattgcaacatatctctaattcatttaacacatgggttgggtgtcccaaaattggcccaaaggtcataatattgcagcatggatatctaataatactgtttggcttcaaaaataatagccaggatttgtcacatggaataaagaaagatgcaagagtattgagcaaggaaccccatggaccactgtagtttgataaaggaaatctgaaacagcagtccacaaagaatgtcttgaaatagctttacactcagacagtgaatcacagtagtataaagaactagtgaattctttaaaaggcaaacaaaacctcatgtttcttcacaggaaccatctctgggaatgggctctaacaatggttcaaagggattctgtctcgacctttaaagaaaatgtaataagtgttggaaaaaaggctcaagatcaagaataaaataaaattctctgtgaaacatcacttctttggggaattaaattctcatgtttgtctctaaacatcacactaataaataacatgaatgctcactttttcattgctttatgtccctatgaaaccaaatcggaagtcacaaagatgctccaaagtttggttactatatttagaaagaaacatttagtttttttctcattagaaatatccaacatgaagaaactaatttagaaacaaaaaaatcattcaggaaagcatattttaataatggcaaacataaaaggcaaggaaacattggggtctggcaggagaaggcagcagatgccaacaagtaggaaaacaaacttacaaagagcaggctggggacgctagccatgaactttacatatgccagttttgatggtttgatcctccctggtgactgccctcctttgataatagataatgaggaaaaagtttgttacaacaaactatttgcaatacttaactagtgctttctttcataatacagaaaagaaatgttttcaaaatctgtagctagatttggaagtaaattaataactatagcagcacagcagcaaaactgtatattctagtactctttcatagtaacattaacctaaacagttttagtgacttgtccaaaatcccactgctaaacattctttttttctctctgccaaatgacttatctttttaataacaattcaaatgtcatctccttccatgatccctgcacagctccagccaaacataattaattgcctcttgctctatgcattcaaaatatcataagcatatctgtattatgttgaaagttgtttttacaatctcttacactatattagagagtgagctccttggggcaggaattgttcatttatcactaaatccaaaatactcagcatagtgtgtgacgtatagcaattgccataagttaaggttttgtttgtttatttgtttagggaaaaattgatgtatgattatattctaaataaaatgagcttctttctgttatctagatgttttattatttattcattaatttggcaataactattgtcgtccttggttagaaataaactacattttttttttaactggtccaaagaatccagaaatccacattttcaagtctgtgccagaattatttgcaaaggtgccagatttctcaattgcttaatacgggccatgtgttaaagaactgctgagttgtttattacggcaaatggtgtctattgcactttcatctcatgcatgtaatttctttttcttctgggtgggacatttttaacatgaagaccctgattaaaagtaggtgtgtttaaaagttaaataaagtaatactaatagacaattagaaaagggtacaaataaaattaaacagagtttctgaaagtatatacccttatcttagatattttaaaataactttggagatcttgttgaggaactgcagactgcagtccttcttagaatttttagaatttcttagaatttttatacttgacagttatgtaaaaacattattgtaggtcacaaaactattattcaaactaattgttgagtaaaactaaaatgtgaagtaaggagtttcagttgaaaaggaaatacttaaaggtcttgattattatttttgtgtcataactgtttagattattaaatcttggattttctgtaatatgcttgacccaatgtgataagacatcattggaggaagcggacctcatggaaagaccattgggttgaggtagaaagacttttactgaagtgcagctttcttactagttctttaaccctagtcaagtacttaacttctctgagactggattacaaactgctttgaatcttcagaggtttttgattttttaatcttcagggttatttgagcaatgcaaccataaagagttaagccaattgtgtgttgtacagaggccaagaaaaagaacaaacaggcttgaaactcagaccgctcttcaatagccaaattgtgagtactgatgttgaactccccaatatggattactcttaagtgtaaaacacaaaactgtaaaaactctggaagacaacctaggcaataccatactggacataggggtgggcaaagatttcatgacaaagacaccaaaagcaatcacaaacaaaagcaaaaattgacaagtgggatttaattagacctaagatcttctatagagcaaaagaaactatcaatagagtaaacagccaacctactgaatgaaataaaatatttgcaaactatgatctgacagaggtctacaatcgagcatctataagaaacttaaatttacaagagaagaacaaacaaccccactaaaaggtgggcaaaggatatgaacagatacttcttgaaagaagacatgcatgtggcaaacaagcatatggaaaaaagctaaatctcactgatcattagagaaaggcaaatcaaagccacaatgagatgccatctcaaaccagtcagatggctattatcaaaaagttaaaaaataacagatgctgatgatgttgtggagaaaagggaacacttatacactctttgtgggagtgtaaattagttcaaccattgtggaaagcagtatggtgattccttaaagagctaaaaccacaactaccattcgacccagtaatcccattactgggtatatacccagaagaatataaatcattttaccataaagacacatgcacatgaatgttcatagcagtactatttgcaatagcaaagatatggaatcaatgtaaatgttgatcaatagcagattggataaagaaaatgtggcacataatatcatggaacactatgcagtcataaaaaaagaacgagatcatgtcttttgcagaaacatggatgaagctggaggctattatccttagcaaactaatgcaggaacagaaaaccaaataccacatgttcttacttgtaagtgagagctaaatgataagaacttatgaacacaaagaaggaaacaacacacattggggtctgcttgagaggggagggtgagagaagggagaaaagcagaaaagatagctattggatactgagcttaatacctgggtgatgaaatcatatgtacaacaagcccctgtgacacgtgtttacctatataacaaacattcacatgtacccctaaatataaaataaaagtttaaaaaagaaaaaaaagtctctttacagagttttatatcctcagggctgcaactgctcatagaaagtatgtttttgtaattcattcaatgtgttcacataagctagatgaggctctgattctgaaaacaaaaacagaaacaaaaccacaaaccatagctgtggaattctacacatatctaacagattactaattttgaacatcttggctttttcttcttattattattattaaactttaagttctgggatacatgcgcacaacctgcaggtttgttacataggtatacacgtgccatggtggtttgctgcagccatcaacccgtcatccacattaggtatttctcctaatgctatccctctcctagccccctactacctgacaggccccagtgtgtgatgttcccctctctgtgcccatatgatctcattgttcaacttccacttatgaatgagaacatgcagtgtttggttttctgttcctgtgttagtttgctgagaatgatggtttccagcttcatccatgtccctgcaaaggacatgaactcatccttttttagggctgcctagtattccatggtgtgtatgtgccacattttctttatccagtctaacattgatgagcattacggtcggttccaagtctttgctattgtgaacagtgctgcaataaacatacatgtgcatgtgtctttatagtagaatgatttataatcctttgagtatatacccagtaatgggattgctgggtgaaatggtatttctagttctaaatccctgaggaatcacaaggaaacaacagatgctggacaggatgtggagaaattggaatacttttacactgttagtgggggtcttttataaggcacattacagcagctggatcaccacaccagggacaagctaattgtgctttaatttaactgtataatgtaaaggatgagtattctacatgtagtgcaaactctgtttttccattctgcaaataaactctagtagagatgtttatctaaaggatggacaagtgaaaatgtaatagaaatttttacaatttactggctttctaccatatgacacaaatattatgtatattgtctctaatccctatgacagtcttgtcatataaatcttatgacccccgttacaaataaaataagtacatgttcaaagtcagataatcagaatgtgaaaaatgagaattagaacacaaattgatctgatgctaagttctgtgtcccttcttttcatactaccatctagcctaactatattaatagagttaaaaatatttctcccattattctacctcttagtagttctacagcttcaggctaggtgcttagaagaaactgtatcatggagattaggattttagcctcaggaaccaaaaagatggttttacaaacccaactctgccactaatcaactgtgtgactggaaaatgatttaacctccttttgtagaacaaggataagggtagtaccgactacctcttagactgctgtaaagattaaatgaaataacatatgtagagttgttagcaccatgtctggcacataataaatggtcaatgaactttttatgggaagcagtatcatctaggacttaagtgagcaggttttagagtctgaagaaatttgtggtttaaatccaagttctgccattaactaggtgcaagaccttgaacaaattatttgatcactctaagcctcagttttcctcattagtaaatggaaataacatcacagactatctcacaataattgggaaagaattaaataagcaaaaataatcacactgccagtagggttttgaactatccacaggcatagatgtttttgttattatcattctcagatttagtggcatctaaaggaatttggaagtggttatgcatggagaacggaactcaaaagcagctattgagaatagctcctccctttgttgtaaacttgcaaatactgaggcatattcaggcattatcacaccttagatttatagactgaaccttggttctaccatttattaataagatatttaagttttttgagcctcagttttttcgcctgaaaaagagtattattaataatggatgtattgcataattaccctgtccatcagaagtgattttaaagtactttgcatacagaaaattataacacaaatgtgattatatttataacgtcaaaatatatacaatcaagaatatatatataatattataaaatagaaatggaaatacacacggaaaacatttctataaaattatattgatgtgaaaccccttagtatctcatagatgacttttaaaaatgtaactaaaactagttcagttttattaaaatttatatgtacacatgacaacttttcatttatacagaaacgcctaaaatatatcaaagtatttatatccagtaatatctacccactctctggaattaattacttctaccagttttgttttttagtgttttttttttctttcttttttgagacggggtctcgttctgtctctcaggctggagtgcagtggcacgatctcggctcactgcaagctccgtctcccgggttcataccattctcctgcctcagcctcccgagtagctgggactacaggcgcctgccaccatgcctggctaatttttttgtatttttagtagagatgggttttcaccgtgttagccaggatggtctctatctcctgacctcgtgagctgcctgcctcggcctcccaaagtgctgggattacaggcgtgagccaccatgaccggccattttttagtttttttatagtggttacgtgtgcaacttgaaatagcatattattgcagcttctacatcttaattcttatcatgttattattttatatttttaatatttgtacaatgcttattttttaaactatacttgcttctttgtctatatgctgaacctagtaatttaattcaacaaactcaatctttgcaattttatgaatagatattcttaattacaaaagaaaaaatgtgttttgctatgtcataaaacccttacttctgaagagatattccaaaatgccaaagtctactggaatcccattgaattatttttgcatttcttttgcttttgtcagttcattcagttgtcgctttttaatttatcccatgccatcttctttctgatagtcttttacaattttactggagtacctctttagaaaattgaactcaattctgtctttgcctatttttaaatatctccgtgtgccttcatacatgattgatagtttggttttatgaaattctaggaccaaaatattgttttatagttgttcatgcatattattgaaggactaggtttgtgaatttgggcaacagttatagctttcctctgcaggtggataaacctgtttctcagacttctctcttgaaaaggtagctgtctctattgagagttaattatggattctatacaagcaatatactgactggtcacttccattttagaatgcatgaaggtaaaatttccatacgtgctgggatccttaaatgtcaaaataagagttggttttagttcaatgatggaaacatctagtgaacttctctctcaagtatagctgacatcctttttgtgtgtgatttaatttgtattatcatttcttctattcacatatggcagtttcaaaccctactcctttcttagatccttgcatctgtaccacaagctcactgtatgtagaaaattctcttcttagaatacaatgcctttacactgagtgaaagcatgtgggatgaacaaatggagcaccaccatggcagctgacctacaaatagttctttcattaattactgcaatgtttgccagaagattctgatgttagaacatgatgtttctgaatttggatatggtagttcctatccttgtaatttctattattttccacttcaatctaattttttctaatactttttcttgtaagatattttacaatttccagttttccatggcctccctctcctgaccaagactattatgattttcttaagttttttacatatcttttttgtgtgatttccatgggaatttagaagagaagggagggagatgagtgtgtcagatttgctattttgtactaaaataaataatattaaatcaattaaatttggtttgaacagaatttataatgaaaccttatgaaaattcatcagtttcctttgccttactatcagtcaaaaccctctcagtgctatttggcttctttgagaaaaaaaaatatatatctctttggtaaggttagagtatattttacaaaatatctctttgtgtttctgacacccttttccccttgatctgtttaagttgatcctactattgcagcagaatagtaggctgccatttggacttactttatctagagaaatgtaagtttctggggtagataacctttaataagaaggtataaacatacattttctattaaaccttcctttggaatgactatccaaatgtggaaatgacttaagtccaacaatatcaggccaaagtaaaataactgtcaaaaggttaggtcagcaaaagaaaatttaataacagcatatcaaatatttaccaaagctatttgcaaagttaaatcattcatgaaaatatattaaacacttttaaataggctggctttcatgtgaaaaatgaaggatacttaaaagtaaaagtataatattctgcaataataaagctaatttttctaaaactatagttttctttacacagcattttcattcatctttgctgtctggggataaaaatacacttcacctcagttaaattctgaagttcaatgtacttcctattgactttaaattacagagaacttgtggagttcctgcaaagaaaatagaggtatatgttaaacatggggaaatgggcagggttacaatatccctgagagatttctattaagcctgtgccatattcattctataaacatgtgttggatcctgccatgtgacaaacaggaggatagatgcaaggactacaacatggtttccccacttgagaaactcatcttcagctttgcttgaatacttgcagtgacgtagcacccacactcaataagcagcctgtcccattgttgaacaattctaaattagagagatttgtttcccttacattgagctccatcattcttcactaaactcttaaccattcattctaattttttctttgaatctacaccagtgtttattcctcttttcatacagtggagcgccatttatttggagactgattatagcttcctaaagccttgtttttctggaataaacattcacaattaattaaattatatcttatagatagaacacgtgttccatacctcctatggctctagttatcctcctctaagagtatgcattttgttttgaacctcagttggttctttggtgcctacaagataaagtcaaaattcttatacaggactcattcatttcttaaatgagtaaatgtgtttatttgacagagcttgtgcttgatgtcttggattcaataaaaaactagagacagcctctaccttcaagaagttaacggtttagtcaactgtctcattccatgttaccctccactaatattaaacactatcactgttcctccatgtgaatgcacaaatgaacgtaaatacttcagataatctgattttctaaaacttaccatcactcaagaacattatatatgactcacttgcaagtgatagttctattttttttacaatttttctattacgaaaatagttaaaatgcttttttaggattttcaagaccactcctaacaatagtcatttgcattaaaaacacgggtctcaaacgaaaataattcctttcttgaagccacaggctaagaaggcccttggttgtaaatgtgtaaaaagtacccatcatggaaatagaatagtaaattgttttagaagctaaagcataggcactcaaccagcattaaaaatgaaacatacaaacacccaccttggatctgttactgcagatctttatttcaattgaggtatagaataggcagtgtttacctttggaaataccactgaagcctttcacaaacatatgtaccatgtccatcgctaaatatttcaaatctgaactgcaattatattgggatttactacaaatctatctagcagtgttaactactcagtagtaaaagttcactctccttttgttctgtaaatttatggcaaagtatagatcttgttgtttctccaaaggtttaacataccagaaaaagttctgcagacagggctgagtaactcctggatttcatcatactttaaagtataattttgaatgatttttttaagtttcattgcaaaccacattcaacccaagatttatttttctactaaagccattctattattttccaactataaaaacagtcagaaaaatgtctcatgacctcatacttaaccaatttccagttttctgcaagcatctatctgtagatattaacaaatattttgtctggtattaacatttctactattatagtatacatttctacaggaaaaaaattatatctggtcatataatgaagtccataacacaaaagaaatgtgagcagggctgtacagagaaggcagtgtcacccatgttacacgtgccctaacagaacaggtgagtaaacagaattttagcaaatgcaaaaatcacataatttattccttggtaggtgtaaggttagaaacacaagagtttagtcttcgatgtgactcttgtgaatcagttgaaaagtaaattctgaatgtttttagtaattcaatacaacctgccacaatgacagtcaaatctggtttctcagaatggtaatgaattaagctcttctgtgcaattatgcaataaaaccaaggtctgtgaaatacacagaagcgagactgtgaatgatagctctagaaatatgacaccagatggaaaaatcagtgttgcaatctggtggcatgagggacagagccctgggtgggattgggagatctgggttctagctccaattctacaccctggtgtctggtaagagacagctgtgtaaatgggggaaaatgtagtacagagtttctgggaaggtcttaaagaaaatagtcttttacttcataattttgttcaaggcaaagaggaagccagaataatgtgtctcaacagtgtgttgtttgatcaaatcttactaaaatttttaatttaccattgaatttagtatagcaaaatttctaaaggcacaatctccaaagcttgactatcgggttcaaatctttccttatcctcactagctttgtgagtgtgggcaagctatttaactcctagtgtcagtttctcacttgtaaaataagggtcatattaggttgcaaagaattaatctttgctcagagcttacaaaaatattttgcatgatttatgcactgtatacattttaactattataggtattgttaatacatatgaaagtagcatataatgtagtcataatacatatgaatgtattataactaaatcagtttatgttttttcccttttttgccaagatactcaatattttctgttatctattttttgtctttaaatacatgctaggaactaacagttgaaaccattattttcattgggtttaactaaatattttcctgataggaatatcttttttgtgtgtcatctggtcatgtttgaacaaccctcagtttatcacagaggttcattcagctggtaaattgtccattacccttgctcttctttctcgtgggagaagaatgcatccatatttggccagagaaaactgaaactccttttattagaggaagagccaggtaattaaagcctgtgccgttccctgggtagcagtggaagcagcaattgagagctagaatgtcatctttttgttactgccaggctgatagaggaggatagagccaaatgctttttagtacaacgatgagcaaacaggagaattaaaagttagggttagggctcattggataactattctttttttaattgatagaatatttgcctttgagagagaaacgtcgttaaagcttcattggtactggaaatagcagttccacaggtctcagtagtgggaagataaaacgtgactgaaaggacttatattcactttatcttggggcctagagtgcatcctttacctagagcctgaaaacatcagatatctagatgacaactgatatttcctggaaacccaggaaaagaacaaaaaatgagaatgccttgtgtagaagggttggcattttcgtaaggcaggggagaaagtcttgcagaaggacatacctgtgatttttggtgagaatataaggatggagagctaggcagggaatggagggaatgttcccaagggcagtctgcttggcgtgagctaacatcttgacatgtgtcaacgtatgttgactgtgttgttttatataattcctgattttttttggtttgcttgttatatcatttatctgctgagagaggtttgtgaaagtcttccaaatgactgtggatttgcctatatctccttttacttatatcaatttatgctttatatattgcaatgttgtgtaattgagtacatgtagatttagaatttttatatattcctagctgtagaccgctttaatattataaaatgtccctttcttctcataatgcttcttagcttaaagtctaatttgatattagtaaaattataccaacatttattggttcatgtttcatgatctatctctttctatgcttttaaattcaatgcaggatcctgctatttaaagtgtgtctggacagtcttttaattagaatatatattctatttacttttaatgtatataataaaatgtttgggtatatagctatcataattctacttgttttttaaaatctacttattttgtgttccattttctcttcttttttactttctgtagagtagctatttttattatattattctttctcaataacttttttagtttagaatatgttactgtcttttgatgtttttactggatagtcaagcttgcagccttgaattactgaagttaaatttcaattattacttttacaatttcacctacaatgctagggccttaggacactttagttttattattcttacttttatgtcattgccaccatatattttaatgctacgtaacttttttttttgagatggagtcttgctctgttcccaggctggagtgcagtggcgcgatctcggctcactgcaactttcgactccctggttcaagcaattctcctgcctcagcctcctgagtagctgggattacaggcatgtgccgccatgctcagttaatttttgtatttttagtagagatagggatttcaccaggttggccaggatggtctcgatctgacctcatgatctgcccactttggcttcccaaagtgctgggattataggcgtgagccaccgcacctggccaatcctaggtagtattttaatattctaaaacattattactagtgtttgggatggtcattatttgtttatatatactacatatttaccctttccattattcttcattctttccttcctttctccgttaccatttgtgattatttttcttctgcctgaagaacatttttaggttttcttccagggctcatctaccagtgatgaattatcttggctttgctttatcagagagtattcttatttgtttttatttttgaataatcttatagggaatatacagttctagtttgtgcttttttaagcaatttaatgttatctttccatgttcttatagatttcattaatttgttgaaaaatttgctgccttgttaatgttcttttgaagatattgtgtgtgtgtttgtgtgtgtgtgtggttgtttttaagattttctcactgtatttgtttttcagaagtttgcctatgatgtacttagcatagatatctgtgtattatccttctggttcatacattttttgttgttgttcttgaaaccttgagttcatgtcttccaacaattttgaaaaagtcttagctattatgagtcaaacaattttaataagttgtaacagttttttacttttttttttgagatgggggtctcactctgttgtccacacacaatttcagctcactgcaacctctgccttcctggctcaagtgatcctcgagtcatgaacatggttgtgtgccaggcttaattcttcaccagtattttctttcttggatcgtgaatctttacacatccattttgtctcctcagctctggaaaaatttcaacaacaattctgtttttttctggcccatagatatgtctctctgatcaaatcagtattctcaggctcctgccctcaacctcaaatcagcagatgcctagaataaaaaaggctgcagaatgctaactcacaacacacacacacacatacacacacacacacagagtatttgcctcagtggctttttgatgcctttaaataatttttttggtgaatttcattatgagcatgagtctacctcaaagcactttgtcactgttggacactgaactcaaagaaggtgaaattttaatatgcgaattataactatttattgttatatttttatactttaactttgcagtaaaagaactttatattgtcatcactattaggtttgttagtctacttgaggttgatgggacaatatgatagggaaaggtgagaacaattccacttgatttgtcgtggttccagaatataagagactgtggtcctgtaatgtatgattaaccttgctcctggcagtagagggctaactcacttggacacactggagaagaccaaagaggaagaaaaagtaaagagcaaccttcagactgcccttagtaaacatcatctttgaggggtaaacagggtaaaatgaaggaaactggcaaaacctgggctacacttttaataatgcactgaaataaggggaaattgatagaaagaaagcataaatgatacagtttgaaagacaaatatgtaaacaaagaggaaataacaggaataaaattgtaaagggaaaaaactattttagggtattatactcaagtaatgatttccaggttattgttcataagccagccatcttgccaagttcatcacaatctcaactccatcttggtcagccatcctttatctttcatcacattgccattacagtgtctgtatctgattgtctgataaataccatggccagggttcttctcactggtctctattctgttcaaccttctttgactgcaactgtactttggcaatcatgggtccccgttagtacccaattaatcatacttgccagacaacatcttatttaactactctcactggatgttttattatttttgtttcaattttgaaggcatattttatttctgttctctctctctcttttttttttttttttttgttttaagagacagctctcattctattgcctaggctggtctcaaactcctgtcctcaaatgatcctcctgcctcagcctcgcaaagtggtaggattacaggtgtgagccttcacacccagccctacttctgctctctatttcaaccatagtaaaaactctactattgaaagtaacattagtgatacggagcatgccaaatatctgctatcatagctaaatatattcaaagattgaaggcttaccagttcattattggtttctggatttaataccttgctgttgagaaagtttggggatataaaccatagacacaatagtcacaatgttatcgctttgtaaaaaaaattaagaatgctttgggtgaagacaaaattaaattagataaaattattgcattcattaaaaattaaaacatgtgacatctttgtaacatttagaaagttaagacactcatgagtagcatttaaaacatacattccaaagattatctattgtattccaaagattatctattctattaaggcagagaccaagtcaatcttgttcaccattgtatatccagatcctggcagagtgatatattataaatccttaataaatatttgttaaatcaatcaataaatgaaagggaaatggtggtgtcagcagggtcaattaatcagtgtgctagtctccaaaatatctcaaagtccttaaaatggggatatgatctgtgattacccaataaagggaaacagtgctcaatgtttgccaaacttaagtttcagaatagcaccttgtggtaagcactttgacagacttaaaaaaaataaaaaacccagggctattccttgagacaaagctaaactgacatcagaaaaatatagttggtgtcaataaattataaaataataaaactaacagatcatgaatgagctaggatgagagtatgttaaattgggaattaatggaatccagcacacaacacctaacggcttggcgggatgttgaggacattgtgggatttgaacccaacaaaagccacttagaaactgtatccatggccgggtgcggtggctcatgcctgtaatcccagcactttgggaggctgaggcgggcggatcatgaggtcaggagatcgagacgatcctgactaatacagtgaaaccccatctctactgaaaatataaaaacaaaattagcctggcattttggcgggcgcctgtagtcccagctacttgggaggctgaggcaggagaatggcgtgaatccaggaggcagagcttgcagtgaaccaagatcatgccactgcactccagtgcatctccaaaaaaaaacaacccaaaaaactgtatccatatactatgtccaggacatcagcctattatcatactaatgggtatctttgtaaacaagttaaccaggcattgaagtgtagacaagagagtccatatatattatcctttgttcacactttatcaattcaacattcaacagaaatatgtttaattcctttttcatgtctgacactgaagatacacagtaaattttaatacaacttggttcctgcttttatggagcttatgatttaatataagagacagctaggaaaacaaattactctaataaagcattataggatctaggatggtttgttcatgaatatcagttccctcaaaattggaaacattatttctcttaagggagaatattttttcccttaaatattgaaagtaaagtataccaaaaattcagaaatcctcaaacaattttagtcccaaataatctgttttaggacactaatgggcatgttacatttaacttgtgacaatatgtgaagcaatcaaatcaatgcttatagtaattacacagagcagaagcccatatgcatttatttccattaatgatatttttttttactaacgaataaatatttgtcaagcttctactatgctctaaacacagttctatggagctcagtctttatggagaacatagacatgtggacgaattacagagaaatttagaggttactgttagaaaacatttttgtacttttttgaatttttacaattaaatattagtattagttttatattaatataagaatacaactgttggtatttaacgtgaaaaataatctctcaacattttctttcttaacactaaaaacacagctttgaaaattgtatttatttctcaaaagtcatatgctgggtagcaccatttatttcttctattatcagacaaatgagtgacctagatatattcttcccaggttgttaataaaatatgtttataaactatctggaagtttcacttctttccactcaaatgcaaacatctatataaaatcaacatctatcaccattttaaataagtcaaagaatgagtcatgtaatttgtcacctgcagaaataccttgataactgcaaaatgagcattaaatcaatgaatcaaatatgcaagaaaatctcaatccaggacacactgatactgcccatgcacgtattattgcattcactagacattacagcttactgaactattcctttctcataaaagatggcatatattttgttgcctatgctgtttagactttgtattacattagctatataacaattctaggtagtgaatattttcataatcctttggcccaatcgaaatactctgcaggcttttgctgggagggcacacacacacacacacacacacacacacacacaaatgtatacagtacttagcactgtattctaaaatgtgtgatgttccggttagctttttcaatgagttaagaggacaaatgtgtagacgagattgctttcaatgaacaatgttctttctatcacattctttgatgtcactcagatgtaaccttatcagaaagggcttctctgaacatgttatgtaaaatagagtttctgtatcactttttatctaacttttactttttttctttcatagcatgaatcactatctggcataggatatatttgtttaatgtatgttttcatccaacagaatgtaggcaccttgaaacctgcctgttttgtattcttagcaaccttacctaacacttgtaacattccaacactgaataaagaaaaactgaatatataccagatgttgtatatattgcataaatatatatgtgatacatacgtatgtgatctatatatgtgatctatatatgcaatatataaaatgcatgtttattcatatatatatatatacacacacacatatgaattcttagaagcaatatttaaagcaggtgttagcatgcccggttaataattagggaaatagcattcagttaagtaaaccttcaggtatagagttaagtgcctttgaactcaggtctggtctgacactagacctactactcactttgcatgaatacccaggagtccttgcataaaaacatccatggcattctgagtcactctatgggagcagtacaagaataatttcccattcaccactagatcagcaagaagagagagaaaggtatatatagatgtagatatatagctatagatatatacaaatatagatatagatatatgtgtatatctatatatctatatgtatctccctctctcactctctctctctctttatatagagagtgagagagagagagaaagacagacagagagagagagagacagagagataaagagagcatgcatgaggaaaaatctgttcttggcatctgggattatgagtttgaacttggattgtagttttcaaagagatagttagaaactgacgtgtactactaagaggaaaccaaacatgaatagggtatacagaaaaagaaaccaagttcttgttcaaagggacataatttcagtctctctagttttttggtttttgttgttgttgtttgttttttgttttttgttttttttttccttaagagacagggtcttgctctgtcacccaggctggaatgcagtgttgtgatcatagctcactgctgcctctgacctcctggtctaaagtatcctccttccttggcctctcaaagtgctggtattataggtgaaagccacctgcctggaccgattttagtttctatacagatactaaacaggtgtttgacttccaccatgttacctaccaaattttatagaattcagttattacatttgcaatataaaataatatttacaatgtaggatgacgatgagagttaaaataatcttattttgtatgtaagtattttgtaaggtctaaattttaattaatcttatttgggaagagggttccaagccactaaggacactttttgtgtgtgtgtgaacatactgtgaattagggaccatcattattttggaagttattattaagaaaaatgttcttctattatgcctcagaggttttgtggtttaattatgaaaatatggggagtcaatgtcttctaaattttaactctcaactaaaaactattatcgtctggtaaaaaaatgatcttgtggcctcatttcatatctttgctaaacctcaagcaccagtgcgctacaaacaatagaaatccatacaaatatggtagcagtacaatgaaatgattgctgtaagacaaggaaacagcaacaataacaatgaactataagtgatctcccatgcagtaggattccttcaaccattgttgggtgtcagaaatttcttcaaccgttgttgggtgtcttgcttggtaaaaattttctaagcagatatctccaccatactgctaaccattatctcttctcaatgtaacccacagggtgtgtcacaggactttgcttactactcttttcttgtcagatatagctgtctgataaaacagataaaaatgtcaaataatttactctctaagccccctttatagatcatggatgcaagaaagagagaagagatatttcaaaaaaattctgagtgaaggaggacattttaagcaaacagctattagaatgcaaatgataaatgtcatgactggcaatcacccagcatattaagactgagggtagctcatttggtagattttcactggaaggagtgtaagttgcagtttaaagcttgggctttccaattagacatatcacccttcccattatgaagtgtatgaccaactatgtgtgagttacttgaacttcatttatttcatctgtgaaatggagataatgatatctactctcttggtttattgtaaagattaaataagataatatatgtaggctgtttagctccaagctggtgcattgttggccttctataatgatggtcattattctgccacacatgttcacagggcagccctctgtttccatttccatcctccatgattcattgatggtgacaggagccatttgttcccacaatctggtctccggataggataaaatcgtaatttactaccacccagacagcattatctttactgcatgcttcttaatgattaacaatcaattacaatatcatcctttaaatccaattcatagcactgtcaaatgattatgtactataattaaattaatgatattgaactttaatttgagttgcatggctgcttttatttgatttctgctacactcactgagtgaacattgggttcttgtgtaaagttatcatatttattttacagccacaaaagagcaaacccttaatataatttaaaaagataaccacaaataggaatatttccacatgagcccatttggaggttcacatttgctattcattaatttaggctttgacaatttaacataaattaaaataaaagcctgtttcacggagcatgtgtttcattcttcactgtctcagcatgaccacgctgattctggggtttagtaatgtccttaaacataatttacaagtgagaaagttagtgaggctggaggaatgcatgtataacttgcagtctagcttcgtatgacattaaaatcttgttaatctgagactcgagttgtgaagaaagaatcaagattattaagcataaatcaacgtttgccttataaaatgcaatggaatatgctaataagatttactgttaacaggaagttggattataacttatctattttaagtcagtttgaacatttgcctcaaaatttgtgtcctgagatggactgagcctcagattccattactttattttttatttttacagagcacatgcagatacatgatgacagatcatgacagatctgtagggcatggtaaaaaaaagaagaagtatgcacacacctccaaaacaatgtatgtaaacaaattacaaaatatgcataattgtacttatactacaaggaaagataggaagctcattgtttgtgtctagttcaaggtaatcaaaagggggtaaaggcaattttgaaccagataattttcatatatgtatttggaacattgagcaagtatgaacatatgtaaactgaatatattaatagcttttctctttactactttacaatgaagcttagcatctgttttgtcagttaattatatgtcatggtaaaaatgtgatttattctataacaaaacaagtataatacagtaagtaatgaactttttgttcagaatttatcttaaatgctcacatgtggacactccccgagtgattggccatcaacacatttaataatattcccttacttactgcttggcaggtccacccagagcaagtctagtttaaatggctacaccaaagtattcagttgtacatgcatataacacctatgagtggacatttccttccactataaacaggctatcaggaatgtgccacttttgtcttatttgttcaacattttgttcaacagttacttgttggttactaggcacagtattgagagcagagttggaattagcccattactggaaagcagaaaaaagtcttcaacatgatgtattcagagtttttaaaatggcaaattcggggaactgaaagtacctttgtgaggatgggataccatattgagaaaagcaaggaaaggggagtttcaaaggcagccgagcaaacagaggcggcatcaagaagaggctaaatgtgccagtcaaaggactaacactctatcctgaagaatggaaaaccactgaagatgtttaagcaggacagtgacggtatcaagtttgtgttttgtaaagattgctctggaagtgacgtggaggaattgaaaatgaaacagatctggcttggagttgcagctttaattttgcccataattttgtttcttgtctctctattgctctatttatctttccttctactaacatcacattgtataattacaatgatgttatcctgtctatccatgcttctttaggaatggatggagtcttctcgaattcttgctttttcatgttaattttagaatcagtttttaaagttcaacaaaatacctgttcaaattttgaatgaaattgtatttaattcacagatcaatttgaggacaatcaacatttttactacatttataatgacttttcatatcaaaaatatagtatacttttcatttaacatctcttaaattcattttaataatcttttttataaaagatttgcacattttctctgatataattttacatatatttgccattgtaaattaaatgtaaaaattataatttctgattgttactggtttattcagcatcactgctaaactcttattaattgaaataattttttttggttttacagtacagaacacaatatcatccacaatgcagaacataaatcagccacacatagaggcaatttggcagctttttattttcctttttcagttcttatgctttttatttattctcctttttactacaatggtaagagcctctattgaaaggttcagtatgagatgctgatgttcaagtcttttccctgatctgaaagagaaagcaaataatttttcaatattaaggtgtttaatgtagatatttttatatgccactcatcaggttaagtcctcttctcttcatagtttactaagagtttttatgataatatgttgttttattaatttttttcttgaatttatgaaatgacctatggtttttctcctttaatctgtaatgtaactcagcattgtactcctaagttaaaatcaacatgatatttttatacattgctggaatcagtatgctaatatcttgtttagaatctttgaatcaattttttaatgaatttggtctataatattatttccttctaatctcaaataattttagttatcaaattattagagcctcataaaattatttgaaagttttctttttatttctttttaaaaatttttcttgaagagtttgtgtaaattttaacaatccattaacattagacagaactgtcatataagaacatctgagctttaaatcatatttttggaaagatattttaatcaatgactccatatctttagttacataggatcgttctgattttttacttctttttgagactgttaaagaaattatttttagcaatttttccattccatttcaatttcccaatttattgattgttattaaggacaacctcttcatatctgctttaatctctgcagcacgtagaattctgtctctatttcatttctaattttctactttcacaagatgccacagataaacattagactaacatcctcagaagtttgtccaatctcatttttctatttttaatattaaaagtagcttttagatttctccttttccactgtatgttcatttctgttttaatttttgacttaagctagtcaatgggtttaccatttttcctaatgatataaggctgttttactatattttaacaccattgctctccttccgtcttcagtgttgttgtcttaacacttcagctctagcctgcttcatcccacagattagacattttaaaatatatagttaatatttattaaagtttgctcatttatttgccaatatattgtatttgcctaatatcttttccttataacagatttccatatggcttccttttgccagaagtttatgttttaggagtgtcataatatatgtcagtatagggcagtgaatgctgcagtaagaaacattcccacaatttctaggtttcaatataacaaaagtttacattcctgtaaataaggctgtgggtccaggtgactctcctgtgcacaagttttccatgtgttggcacagcacttcagactaatttaaaagcacttgcatattaacatacacatctatgattatcaagtctgtgaacaagaaaggtggatttttagatatcagcatttaagtgttttcatttaaaagtgatgtgtgtcattaacatttatttatccaataacataatcaactttaagggggtaaaaaaatacaagtttctattctttctgtaacaataagaaaataagattttggtgttcaatgcaaacatttatgtcaaatggtgaaagtcattttgtgacaaactctcatctgttttttgtcaaaagatctttttatatttttctacataaacataaaatgacagttgttctatcctaagacactaagagtattactatgattctgtcttctggcattcattgttgctgctgagaaatcaacagtcagtgtgtttgctgttgttttacaggtgatctttttttattttaaggtgttttgacattgctttttctttggtttgcttcaaattcagtatgatgtatatttgtgcgtatctttttatttttaatcctggttgcattcataggaattcctgtttcagaatgagaattttaaaataaacctggaaaactgagtcatttctttctttgaatattgcctatttcccacgtccctgtactttctaatatgtcctaatatgtccttatggaattatactttatacattttagacatttacactctattctttaaatttcttcactttcttccttaaattctgtctcttggtttctctggctagcattccatttaattttttttaggcagagtctcgctctgtcacccaagttggtgtgcagtggtgtgatctcagctcactgcaactttcacctccagggttcaagcgattctcatgccacagcctctcaagaagctgggattacaggcatgagccaccacgactggctaacttttgtatttttagtagagatggggttttgccatgttggccaggctggtctcagactcctggcctcaagcgatccacccatctcagcctctcaaagtgctgggattacaggcatgagccaccacatccagccacattccatataattttgtaatatccatcttccaatttgttaatcccctctttagttatatctaacacatattttcttttttttttcagttgtaagctttttaattttaattattctaatcttcacacttggaagttctatggagtggaattttcattcaaaattgcttactgtttgctcatattcaaggttcactctcatttctttaaacttatgtctgataattcttctacaaaaagtttttgtaaagtttatttttcttgtctgttgttttcactgattattattcatgtctaagtgttttgttatatgagactggatttttcagtcttgtaatttttacctcaaagatattcatatacagagttatttttgaggcctaggttgaagttgtatttcttcagagatttatgaggtttttgtttttgttttgttttgtgagtttcttgcagatttcacctatttgggacaacagtaaatttaaataacgcctctagatttttaaaataaaagtgacatgtggatatgtggctatgatatagtttcaatgtttgtcccctccaaatctcacattgatatttaatccccaatgttggaggcaaggccccagtgggaggtattttggtcgtgggggcagggctttcatgaagggcttggtaccttcctcttggcaatgagtgagttattattgcattagttatcaggataactgattgttcaaaagagcctggcacctccttcctctctcttgctttcttcctctttccatgtgatgattgctcccctttgacttctgccatgagtgaaagcaatctgaggcccttaccagagacaggtatcagggcgaggcttcttgtacagcctgcagaatcatgagccaaataaactttttttctttctttataaattacccaatttcagggattcctttatagaaactcaaaatggactaagaggctgcagacttattttgggtaagttgaggttataggttttccgaggagaatttttccataaaatcagagctaaacgaggcaggaaatattccttgcatctacttctgagacatgggatgtatctcttgttcattcttatactacaggtatggcccttcgtgggggtctttgtttaatgtgaagggatctcctctagttttaaagatccctggactttgtcttctctttgcatctttcatagtcatcaaaatgggcattcaaagactcaagagtatactagatactctgagagaaaaatcatttttatagtttcttacctattagtggttctcatttcaattaattttacagctcagaacttacatttttcctcagtaaattaaaatgatgccttttgaaacatactttggaaattgtatccagcatcttagttgtttaagtccaaagtggttttctgggtatctaacatattatacctcaaaaggaaaaatctccctcaggtttaatttttttttaacttctcaagataaatacttagtttgatagcattctttcattttttcataataaaagactattaaaattataaatttgcctctgagtacagctttccttcactctgggttgttttgatattcagtgaatttgcttttcctatttttaaactacccccaccaaaagttacttaggatttttttttttttttaattttcaggggtttgggatcttatttttgtgttttgaggatttaaacttttattattaaatttgagtaagaaattatgactcttacaatttctgctttggaagatgtattgagttctttgtggtttggtagataaacaatgtaaaaattctgtagatgaacaatgtttactgtctgaggatacaagatttaaaatgcggggctgagtgcagtggctcacgcctgtaatcccagtactttgggatgcccaggcgggcagatcacgaggtcaggagatcgagacaatcctggctaacacggtgaaaccctgtctctactaaaaatacaaaaaattagccgggcgtggtggtgggcgcctgtagtcccagctactggggaggctgaggtaggagaatgacgtgaacccgggagggcggagcttgcagtgagcccagatcgcgccactgcactccagcctgagtgacacagcaagactccatctcaaaaaaaaattataacgcatattaattaaatattactaatattattaaaattattttatcattcttttcctacgtaatcttgcaaaggatgagggtttttaattaaaactttctttaagcgtttgtacatttgtatatatttttaacgtctttctaagaagactttatataaacacatacaacacatactaacgtatgtttgtgtgtatgtatgtatctatttttgtgtgcgtgtgtgtgtgtgcgtgcgtgcacattctatattatttcatctataaatgtttactggtatggattgttagggaagaaacttcagtttccctgacctcataattctatatgtagagtctctttcgagaataatctccctgccctgtgtggccattccaatgagaggaagatgaagtatcagaatgttaaattggaagaggaaattaggaatgctgcttggtgctttccttgtttagaaccatccttctcaggaggtacctacattgattcctctccattctcccggtaatatggttggctttcaatttgtcatattcctgcttctatctttcagttggttataaactcatgagggaagattactaggctttgtactgtgttctctcaaacttcacaatttaaaaaaatatcttttaacctgttttcatttattttgaattgcttcaatacatctttattaattctttaaggtattttttcttcattttgctttaggtttgtcttacacaagcaatatatcattgtttattatatcggtatataataaataccaatgtattaaagcacaaacccagtaatttttccctttagtgttcaattaatcatgttagtctgttacattactgatgttttcatttacttttcgctttttgtgcgtgtttcaatttttatacttcatggatttctcttcccatttggctacaagtaaaaagacttctgtttatgtttcctgcattcatttacaatagggtttacttttagcatttagtgatattattcatgtttcctggattatcaaattcaataattaattgacattacttttttttttttttttgagatggagtttcactctttttgcccaggctggagtgcaatggcatgatcttggctcactgcaaactccgcctcctgggttcaagcgattcgcctgccttagccgtcccagtagctgggattacaggcatgcaccaccacacctggctacttttgtatttttagtaaagatggggtttcaccatattggccagcctgctcttgaactcctgactttgttctctgtccgcattggctttccaaagtgctgggattacaggcatgagccaccgcaggccgaggttacttttctttagcaaatgaaagataacatagagcgtgctttcattgcctctccacgtgtgtactccacttcccccttcctccccacaccaaatttatttttctctccattcttctattcacctaaatctgtcaattactggtgtttaaaaaagtataatcttggatttcatatccagatcattggtattcaatttctaaatttatattatataaacgtgaattaaatacttttttgaagaaacttatgaaatcttgtttatgccaattttttggcatcgcgacggagcttagctggtttcaaaaactattgtcagaaaagtttatgtcagaggttaatggccagatgctattttaaatccagttgtgtttctgagcaaaatcataggtagcctcaaaggcatgagactcatagacttttttttttcactatgactcacaaaatttgcaaacagaaatttggtaggctatacttcatataggaggaaagaaaaatccattatctctctactcttctcaggaagctttttatcattgctttcaggcaaaaattttgaagtaagatgtgatgcaaaattttttattgaattcagtatatttggccctatattcttgactgtagtagtcagaggaggctgaactttgggaacaaatagactcaaacatacaatgaggcaacaaaaaaagtttggttcccactcacctaaaagcccataataatttagttcagtgaaaggtggggagtgaaagggggtaggggtagggatattctgctgcacagaatcattcaggggctcacacaagggcagctttgttatcttcaacatgtagctttcaaggtcatcctgaaagctaatgggttagtattcccattaactagaaaggaaaataagcatagcagagcatgcgtgggaagttttataggccttgcctggaagtggcccatgtcacttctgcttacatttcttgcactagaactcagtcacagggccaaagctaaccccaaaccaggctagacaatgtagtccaagcagtaggcgcaggaagaagatgaaaacagtattcgataaattacctttaccccattgaataatctagaaaattctatcaggacactgaactattagtcagaattacacaacttgactcctaaagaattcacaaatcatcagctgttctcagtacagaacaattcatgagagactgcatcctcaagtgaattacatggagcttcaaagtccttttgacatccacagggaaaaacagaagggtttgcaaacccaatatgctcacaaagatgaaacagcattaacaaatgtagcatttctgaacttcagctaattactgatatacttccctccatcctattatgtaaatgtacactagctggttatactaaatgaggaaaacactctcaacatctgttctaggatacagaacacttatttgtttagactaggtcaaagtatgatttattgcagaaaaattaatatgcattaggctacgatgtctcatattacttaaaaatgtatatgttttatctaaattgctaacttaaacctttaaacaactggggaggaggcttaagatattttgtctttataattgccaccaaactgcttttaagttatcggtagactgaatatatatgcttctcaaggcattaagagtagagtagtgaatcttataaacatggaacacacccacagtgccctaaataaaattttgttatctttcattttatctatgaaatacataagtgtttaatgcccctggcacagtgggcattttgttttgtttttatttgtttgttttttgcactgctgttagcttttctgtgtagcagcaagcaggctgactgcatgatgctgggatttcattatattcactattaaacaaaagctcttatttcacacagtatgtgaacaaacctattctgagtgcagcatcgttctaaaggattatttattgtaattgttttctctattcactgggaatcctaacttccgtggttctgcactttatttcagtgtcagccattctgacagctagcacctgcgcacattctggttattgaaatagtttcttttcatacacagtgatcctctcttctcatcctgcagagtttactatctttctaaaagtctccctagtttacacagtttgttgagaataattaggatcctttttcaatttacgtgaaagcaggctagtatagtgaaagcagcctcagacctagaattaggattttaaagtttcattcttagcccttccatgaattccatgaattaatttccaaagctacctaaattcaaatacatacatctataagatgaagaaatttggcaattttatgaacatttttcaactgtagaattgtaggtgtgcatattttatatttatttatttattctatcaacatacattgattatcagttactgtgctaggtactgggaataataatatgcactaagctatctcatgtcttaactcagttaatcctcatgctctcactttatattgaagaaattggcatacacaaagtttaatgacttgaccaagtctgcatggtcgtaagtgacccaggttgaatttaaagccagggtgcccagctacagagcctgacttcgtagtcactgtgttacattgcccggaaaacaaaggtgaactggaggagtttcccttttcatatatatatatatatatagatagatagatagatagatagatagattatatatatatgagatatatacataaaagatatataaaatatatatataagatatatataaaagatatatatataaaagatatatatataaaagatatgtatatatctttttttttttttgagacagagtcttgctctgtcgccccgagctggagtgcaatggcacattcttggctcactgcaacctctccctcccaggttcaagtttctcctgcctcagcctcccaagtagctgggattacaggtgcacgccaccatgcccaactaatttttgtatctttagtagagacagagtttcaccatgttggccaggctggtctcgaactcctaacctgaggtgatccaccttccttggcctcccaagagtttccctttttaaagagttcacaggctacagaggaaggttgacatgtaaacaaaatgctactttctgatactattgatacacaaaatcattggccttgcagcagtcattcttgttgttttaaatgtattatgacaaagctcacaaccaatctttaaggtgtttataattgtctccagtttttttatataggaaagctgagcctctgagaaattagctaatttccccagtatcccatagtttataagtgactgagctaagattaaaactcacgtctgattccaaatcccatttttgtcatcctctgtcacactccattgcataaacagaatttctcctttaaggttctctgaaatttacgtctttattactgtacttattcttcacatgaattacattttaaaggatgaaaagtttgcccagatttgccaacaatgcgtaatagaacgaaattatcatccttattaatttctcaaagaattcacaaagcaaaagtctgagattatccagaatcatttgactgaagccaaacagtggctttatacctttgctccctgcctgttaggaggtgaattcatgcagtctctataaaacttaaataactatcagaaaaacatcagaatgtcaggagtaggtggtaccagagagtgattccctcattttctaaatggggagattgagacctagatttaagtcttttgcccaaagttgtataattagttaagtgactgaattaaaaacagaattcggatcttctgcctttctcttctgttttattttcattatcctgtaatatctaaacccaaaattttatcacctagtaaattttgaaaaagcagttatgctcattgatttataggtaaatatagactgaataattcagtatatttggtgagtgattatttggcaatccatatatttaaaatgtttccaaggtgactgaataaaattcattattaatcttcattatacagatgtctttcaaaagttggtttagtatcactatacatctgagtagaaataagaggaaagagaggagaggaaacgaataatatggcagtcacaaataaattaacattaaataaatttaatataataaatataattaaataaatgtaatgtaaattaattaacattaaataaatgtaagtaaaataacagtaaatatcattaacagatatttaacgttattttaacatttatcatttaacagatagagagaatagataaataagaaagaaatgagtgaagacaagctagcaagcttgaatgtaccaaggatgtttccccacaatttggatgcttttgtcccaaatttatctgccataattcttgtacatactgctattatttatactatttctaccatactctgcccctaatcattccacttctctcccttcacacacatatacacatacacaaaacacacaaacgtgcattgtcagacataagcatatttggcaattcctctgaagtttaataatgatgctatggcgaagacccaaggggattaattcagtattgttcattctataaatggctctcacatattggcttaaaagaattcaatccataaattatcttgcttcacgtactgaagcaaaacttttttttctagaagcactaggaaacatgctgaaaaagctggatttagataaatacacgttataaactatatgtttgtactgactaaagtaatgtttgaaacttctacatcattttgaagagtatatttagcaaaaggcaccctgcgatgattttcagggtttggtcctttggctgcttattagaacatgaatctagaggaatacaccatcacaaatgcacacatataagttatataacacacacacacacacacacacacacacacacacatatatatatagagggagacagagagagagagagagagagagagagagagagagagagagagagagattgagatttgccgttgtttgttctttcctgactttgactttatcacttttcttccgtttggcgtggagtcattttcaacccagagtattttaccctgttagaaattgctttcttactgctagctcatagtcaaactctattattcctattacttcatgtatattttttgaagtgatgattgccaacctaaaaacaactacaaacaaaataaacacaggctcccatctagcaaacattttgctcctgtgttaaaggaaagaaattgttttatttttcacttttaggaaaaggagaaataataaaaatatgcatatttcattactacagaagcatgttgatgttccgtaaacaaaaggcaaaagatcactcatagacccttaacactaaatcctcttaacaaagataagtgcatgggagaatacacttcagttaaactggatatcagactcattaagtaaaaatagtcttggcacactagtcattaattgaactgtatgtctaatatttaaaacaaaggtccaattatgtctccctcaatagaaaaattcatgtattctttaactgcatgtttaataacagtattacttcaactgagggattatagaaatcacagaattaaatgttaactttttacaccatgaaagtcccaaggtgaataaaaaaggtttaattcttagttttttttcaattttgttgtattaagaaaagaagtattttacttattttttgggtgattattgatgtttctaatatttaatgttcagttcttttaggaagtttccttcatatttcttagctcctcatatctcttttggttggcattgttctcactattatcgttttaatctcttctcttactcttgccatgaaaaaaacagaaatcttccaagtattctttgtgaatgtaaactataaaagtatttaaattcatttgattaatattcagataacctctgagcagttctagcatctcaaatttattcttttttcattatgaaacactggatctaagtatgcctatggaaattcactaactctcacctcatccggtcctgcttcactccacaatgcttaaccttcttttctgttttgtgtcttgatctgacccagccctttgtaccctgactaaacaaacaacattctgtcccataactcttatgaagctaagcaaatgatgtttcttctgactggaagatctttctttctttttttttttttaattttagaaatctgttgaattcaatttaatcctttaaactccatcagggctaaggcctattagaagctttcagtgaaaccccaaggttgagtttggtgtatatcttatatccttgcacagcaccttacgattggtttatcaaagcacttgtcacactgtattaaaactatgggtttcttttatttttctcctttcctggataatgagtttgaaaaacagtagcccaggctgtagcaccttgattctcttatagtaagcagtaagtaaataactaagtgaatatataaatgtagatgtaccaaagtgtatcatcattggagatgttataggaactaatactttatttaaaagacaactctatgcctttttctcccctgagttgttccaaataagtgttaattagcttaaaaaaaaacataaaatacagaagagtatcctaaattacaagcagatatgaaagatgaagtaaatgaaaagtaaagttaggggcataaaatggatccagaaataaaacactaaggtgatgactatgaattcaaataactctgttttcttctagtcccatgatagtgcctttgccctactcaaactttgaacaccgagattttccctttattcaaggtgatggccatttgtgatctgcaatttcttctagtcttaagtttgacatattgcctaaattgcccaaggctttggagaaaactttaggaatagctttaaaaaactggtcatttccctagaagcctcctcctcttactccccagtggcttctcatttcaagcttccgtataattgtactaagttatactaattggaacattcaattccacatgtttggagctagttatattggaagataacgtgcatatttgcataaatgaatacgtagcagatgcaaaataatgcacaaatatgtgcctgtaacttattggataaaaaacttacttcacagcacacccaaaaatgactttcctatttatttgatcataggaagaattaatcaattctattttactaaaaacgtgtgtacaaaataatttctgataccaaataaaatggtcaatatttagatctgactttcatgagtaaaaattgaaataatgtctagagctcttttcaccttagtctggttggctctttgtttttttccaattagcagctctttttactcacatctgttttgttcttcaaaatcagggcaattattaaatgttttaatatctctgcatctcaattttcttatctataaaaaatggaattagtgctgcttctctctgagtaaaaacagtatgcaaatttcaggttatctttattgaatccacctggatatttggggagaaaaaaacagtattagaagtatattagtcaagacaccatctactaattttcctgggagaaaaaaaattaattgtgaggcaaacctaatatcttttctctattttgcctagtagaatgattcacctggaggactctaaactgtttaaccctttatttattcaacaactatttttggacacctttttatggaccaggtactattctaagtaacaggaacacatcagtacatcagtgtacaaaggacagcaaaatccgtttccacatagagctgacattctggagtcagttcacttacattcacatatatgtatatatttataacatttatacatttacaaatatatataaatagggtattattgccctgaatttacagaagtgaaaactgagagtcagagaagtaaagtacctcacccaaggtttcaaaggcccagtaaattatggaccagtaagttatctgctaatacttatagtaaattatatctgaccacaaggcccacatttccaaaactggcactcttaactggaagaatacatacaaatggagtggagaacagatggcctctgtcacaagattagggaaccccattcattttactattattagtaaccttcatattaaaggggtaggtcttccactccttgctgatttcttatccctgggattctactttcttacacaaatctatattacttgattcatcacactttctaaatttttcaaattctatatttgatttctaataaatcagctttttgattttcactgtgatcttcccttttctaaccagatttttcctgcgtcctgtttttttgttttgtttttcaattcacttgaatccatgggctttctgagactcattcattctttcattttgtaatttacaataacaactatgaacctagtgtccacaaggcttctgctaagaacagaacatgaatgcaaataaaatggggaatctgtccaagtctacattcactagctccctttggcttaatcaaatgtgtcaatttttttttctcgtgtgtgtgtgtgtgtgtttgtgtgtgtcacaaggtttaattatgataattttcatgaccccttttcattattttaattttttaaaaagtggacaagaaatacacgcatacacaaacacataaggaaaaagttacgaataaggacttggagaataaacacctaatatccccctacttagaaataacccattgcattaatgcttaaaaatttctttctatctatagtaaggctttctgtgaataactcaaaatgaactgatttattcaaccaaccaactagctctatctgtatagtcaattatatagtcaattatatcaattacctcaacaaagtgctaggtaattaaattgaatagaaatccacagtgacaggtatgatgttatttattgtatatgtatattttctatatatagtgaacgtggaaggtgtattagagaaataataaaacattaaacatttctaaatttcagggaacctaaatcttctcaaattgacttaccacataactgaatctaccggagcttatgaaaatgtattatatttcatcttgaaccccatttggggaaaggggcaaagtttctcttcaaattataactcatgaagctactgtaattctatgcgcacaatcaatattgattaataaagatgaaaggaagggctgtcttgaacctggcatgatactgtctttagggaatcttcaggttatcaggggatgtgcaagtccatgctggtaacgtagaccactgtactcaattttgggctttgacaaactaaactttgttcagtaggctttggctaatttcctctggaaaatcagctcagcaaaatctagaagtagctctcaatttttgactttaaagggccaagttcacaaaattaacactttgcaaaccttttataacaagaaactttttcagacatactcacaatcacatcccttcacacctgagatatcagttatatatgtgtggcatcagtattaaacacaattagtactaaacaaaaccagtattaaacagtttttcatggaacatttggaaaagggtgaattatcaaaggtatgactcagggagaagcaaatggcaaaactgattgtttaaatcatttgaaaatcctgttgggtctattttcttaatatgagacaagttaatattatgtctgcagcaatatgtcgacttataactgtacttatctacctgaaatttattgttaaaaaaggtagcctctgtcatgatttaaaaagcacttccctactgttttaaaattttctccctttttcctactgttttccctcttaagttaaagtgattaacaaagtcttattctctacctattctagagtgtctgacaccctgacaaagccactaaaacacctttgttagcccgacagaatgtcttcaggctctacctcaaatgttccagctcccatcttgtgttagaagagaattctgcatgggtctttcacatttctgcacactttgtaagcagagacactgacagcttttgttcctatcttttcagtcttggaagaaagaagtagttctccctatggagtaaagggcagatttgtttacaatccagtttaataaagataatttccctctctatggcaaagggcaggtttgtttgctgccattatatattttttttaaaaagagttttccaaagctcaggatgcttcaactatgacataaacccactatgtacagttgtcacctagccctcatcttatcaccttgtagtaactgggtcttaaggaactgatgcaagaaaatgacaacactctgactacttctattgctatgagtaatacattgccttttgtctttgtccactgtatccatgaaactgctgtagactcttcagcgttcctggtatcttttttacccagtttctgttcttttgctttatggatagactctcttctatctatttagttccctactcaagtttctgcctccttaagttgactttctcggtctaaatttcctgcttgactagggaaaagagaatccgattaaataagtggcaacaaactaaagtcagaagaataaaaagtgttaatccaaaaacaattgtggcttgtatatggagtataggtcccatgcaaatctgtacagcagctgggttttcaatttcatccctatcagagacatcgttttaaagacctcttgggtcttggagtttaagaggattgctgggctgggtgccttgtttatttgatagattttactctgctttttcatttcttagtgctcactgctaaaaatattctttccttagtagatatatgtctctcttccctcccctccacttcccaagccctcaaccctccaacaataaaatcagtatacacatattcagaaaagcatggctagtgataaatgatcaggaatttttacttgtttgttacctcttatttcagagagttccagagggatgagcagtagctctctgcaataagagtcctgagaatcagtgggaacctcttaaaattcaggtttccaggccatacactcccaaccccaaggattctgattcagcatggctgatgtgggtaccaggagttttccatttttaatgagtttctttggcaattttactacaatttgtttgcagaacactccatgagaaatcctgctccaaaaactgcctcctgacttggtatcatgcacatttgtgcagtataatagagacagttcaaccctaagtatatagattagtcactgacaaatgttagttgatgacagtgatttgctctggtgtacagctcaactgttagaagtgttttgaaagttattttttggcccatgagactgaaagactcatattaatatgaaacaactgctgattagctttaacatttctggatatatttggaacaatttcttctgatctgcagcataataccacgtgcacattattagcaaggaccatatatagaaagataagtaagtagaattttaaaaatgaaaactatagtttgtaaatactttgggtaaaatacaattatcccaaaggtattttattggaagaagttaaacagtatgaacattttttagataaagacttaggggagatttttgaaaagtaaaaacgattgtagtcattgctgttgaaatcataagatatataataggatgttactggaaaatcatcttatatcagtgtggtgggagcattgaggaaaagtgtgtaacatactagcattgacggttctgcaggtatccaatttatattctaacttcttaacaacaatgcttatggaaaaattctttcttcactttctttttcccaaacgaaatagaaataagtcacccaactaacagaagcatcacacttcagctcttttctttgagtacagatgagtatacttcattttcatcaggcttgattgggagttacgcacttaaatttagtgttagtgcacttcaggtaaagctcatgaggaaaacaccagcatatggctacagtgcttttgaggtaaggacaccacagtttagaatgccagggattaggagagtattaaacacatttcactccatacatcagactgaattattgtgggtttacttgggacaattgttgttacattaaccaatttaaccaacatttcaacatctacacgtcttcagtgttagtaggtgatttttaccaatagacaacctcttaaaaacagcaacataaatttcagtcagaatttttcaaggtgttttatcttttctcagaacttatcttgataaaaggtgatgacacttacagttgacaacaacttttactttcctcacatctgggaatgacacatcattttccgcactgcattcatattccccagcctggtcccttgtaattccataaatgtccaaatattgtccattttcaaatggttttgctataaaaaagaatacagcatgtttaattgtagccgcctgaggcttcattcaagtaaaacaacaatttcatgacttcctacaagatactgctgacaaaacaattccaaatgaaactggggaattattaaaccttttgttcttctatgttcagaggaaaactcagagaaaaagcagaagcagaacgaggtatattataacaactatttccccagaacaggatatacatgtgttctttttaattgattgtggtctcctaacctcttcacacatcaaatagactctgcacatttctgtaattgagttcaacaacctctgagcagtgtagatgaaattcactaatatgacttggtacatattgacttctctactgtgtgagctagaaacttgacacttaacctaactaaatgttacttttcttttgggggaaatctcctacccttattcaaggattcaagtcagatgtcttgaaaaaagtatatatatttaaccattgctatattttggtttccaaaagtattaatgctgccaagaaaggtacagtgtacatgctatatataactcacgcaataaatcttggaaaaaatcattatgactctctaagggttaagttttcataaaagcaaactaaattatctttatttttaaatatgcatgggaaaacattctatgtgacaaaaaatagcagcagaatagaaatataaagatgtaataacagaagaaagactgcccccaaatgaatgagatttgagaaaataaaggctccttcttttaataatggaatttttgtttatttgaaagcattgagtcattgagcaggatcctaattatcagaagtgtggcaaaggtagaataagcctttgtgaatttcaagagaggagacccttctacctccttgcacaggccttgaaaaaaatcacattccagtgcatatcaaagggaattatggaatgaagcaatgcttccattaaattgtttgttttcaaaagtcaatattatttctatcttcccctttctatcttgtcaaaaccactgtaatgatatagaagttggagaactagtaagaatgttccattttaatgaaacaaacaaaataaattttagttatggccctccaaatctaaagtccatcccaataattttcccccagtgttcccccatgcacttctgtgtctgggcctttattaactgtggcatggtctgccctccagataactatgagtttgctaattgaaacctttagtgtttagaatatatatgattaagtcgtatttccatttatctatctaatccttgtacagaagggaaatgtaaaacttctgaagtggtagttggctcttttagtcttattttcactattataacgaagatactctaggcttaaatgtgtctgtaaaacctactgaaatatatattaaaaaaacaaaacacttcacttccaagaatttttaaaatataacttaaattataaagagtaaggatggtattaaatataaattaaagtatgaggaacattaatatactacatcaggtactgatgtgaagacatgagatttggaggggtcaggggcagaataatatggtatggctgtgccccaacccgactctcaacttgaattgtatctcccagaattctcacttgttgtgggagggacctagcgggtaattaaatcatgggggctggtctttccatgctagtctcataatagtgaataagtctcatgagatctgatgggtttatcaggggtttctgcttttgcttcctcctcttttttctcttcccgccatcatttcacctcccaccatttttctgaggcatcctcagccatgtggaactgtatgtccgattaaacctctttttcctctcagtctcaggtatgtctttatcagcagtgcgaaagcgaactaatacaacaacataatagaaaattcagaaaatttgacatttcgttagagaaggtagatcaatttatttgtttagccaatgattgatcatgtcataaataaaaatatttacctttttaaatttttattattatgtgtaaggaaccatatgctttcttaaattctacagttaaccttaaacttatgaggtaaattccattacatagaataagattatgatagttaaagagattaaatatcttgctaaagagcccagtgacacatatgaaacccagaactaacttaaaaacctacatgccttatttgtatacaactgacagactacattaattctctcatttgtgaatggttacttagctcactaaactaaattaaaacatgtatgtgtcattcttagaactatacagcactatataaatgttaatttaatatctgaaagatgctatttgtacttatatcagttgtctatggctgccataacaaattaccacaaatttactgcttaaaaccagtaaattaaccacatgtcaatttaatatctgaaaaattctattggcacttgtattagtattttattgctgccataagaaaataccacaactttactgacttaaaaccatgcaaatttatttccttatagttctttaggtcagaaatccagcagaagcctatggtaaccagaataataggtcccccaaagttattcacatcctattcactaaagtgattagcttatatgacaataggaacattgcagatgtgaataatgttaaggaccttgagataaggagagttctgggagggacaatactaattgcatgaattcgtaaaagtagaagaggtagatagaagagtgagtcaaagagatgaaaaatgataaaggctctactaaacattgttgattttgaatatggaggaagtagagcatgagccaagaaaagctgtggcctctggaaactaaaatgtccctcagctgacaaaaaaaattaattatcctttataacctccaaaaagggacacagcctatcaacaccttgctttgagtctgatgagaccagtgctgagcttctgacatacagaattgaaggataataaatttttgctctttttagccactaagtttgtggtaattggttatagcaacagtataaaattaacacagtgtctcactggattaaaatcaatgtgtcagaggttcaggattcttttctggagatctgtttctttgtttttcaggttgtagggagaattaagtttcctgatgttgcagcagtgaagtcttcattttcttggtggctgttagcttacagccatttccagcttttagaggctacaagcattccctgactcatattcccctttctccattttccaaaccagcaaatgttgggtcaagtctttatcccactttgaatctctactgcctctactacagtctcaactctctgaccactctactgttttcttctttcacttttaaggattcatgtgattaaactgagcccacctgcctaatctaaagtaatttcctcatctctagctcctaaccttaatcacatctgcaaagtgtcttttaccatgtaaggtaacatggtcatatattccacagactagggcatggacatctttggaagccattattctgcatggttttctaccaattttccttagattttgcagttctacttgcatatacaaattttaatttaattataatatttttcaaaggcaataggtaaagaaagacacgtggtataatttataaattgctgaagttattaatctctctgaataatacaaatgaagttcagaaaaataaatttaatgaagacattcattttgaagaacaaaaatttcatgacactataccacaaatctatcaagtaatgtaagtctgagaagtgttgttagagcacagaaataatggagtttatggagcaataagagggggtatatggatagatgaaattatggaagtcatctactgaaattattctaacaggtttcaaaagcaaataaaagtaactagtaagaaaaacctcaagcttttgatttttttggttacatatttgtaataatccagcagagagcactgaaggaaaatttttaaatcaactcaaaatcaattgtttcttttcttcctgccttcttacctaccttcttttcttccatttatacattcattcaatggatattactcgtgacaagatctctgaccagtgaataagattgtttccctttcaaagtttattgggaagtaaaagtataagtggacaatttcaataaagtatgataactactacatttggggtaaatatagggtgttatgctgtcataatatcactgtcataacttaaaggaagatttctgaacatttggttatgccagaacagtaatttcataggagtaggtagaagtgactctggagctataaagagaagttatagcctagaaggccttgtattccatgtaaagaatttggattataaattgaggaattattagaataatgtaagttaaaaagtattagaatattttaaagaatcacatttctaaatattacatatttttaaatattacattttaaaagataactctggcattcagatcgctattatatttaggaacaatggccagacttaccttcttgccataaaccactaaagaatgagcaaaacttatttaaaaaaaaaaaaaaaacactttcagacattggacagtaagaagcacagaactttgatctctaatggaagagaagtaaacacagtgacccccacaattaatattcatggctttctatctcatgcaattttcaagcatcaagctcacagaggtggaaactagagcccagtggtcttgcattgtcaaggaaagagagattggaattcaggtagaccaaggggatggaagtagtggtgcaggttttaaagagaaggagctcatatagacaaaaagctacagaaatctacatgtgttttcttgtcgttgctgagtacaaggctgtacttgcataggcaaaaaatcccacaaatctgaaaaaaaaaacaaacaaacaactgggcatttgtaagatagacaatttctagagctcagacaaggtaaagagacattgatctttgatgaacaagaatataatcaccagagactgatggagattccaaaaggctaatgccttagttgtatggctgaataaaagccagaataaagactctttttggcctatcctttaaagcttaataacaaggtttaatggaccaaaataatttgcaggtgatacaggagcctgtttaaaaaaaatccaacactctttaagggaacaaaacaaaatctaaacacttaacaacataatgtccaatatccaattttaaaaatgactaaacatttaaagaaacagaaatctctgaactataactagtggaaaaacagtcaatagaaagagacctagaaatgaaaaaaaaaaaaggaaataagagaaaaaaaattaaatacagttggctataactatgttgaagtctttacaaaaaataaatataatgaagaaacaaatggcagatagaaaaaaatgacacaacgttatttacacagcaacacaaaatatatgaaattaactattaattggaagaaattaacagtgtattaaacaccaaagaaaaaaatattgttaacttgaaggcagagcaagagtacataacattgccaaattgaagcagagagagaaaaatacaaaaaaccaaacaagcaaataaaaatacagagcctcgatgatatatggaataataaaatattgtcatatataaatattggggggggtcccataaaggggacagaaaaaatatattaagaaataaaggttgaatggtttctgaatttgatgcatacaataaaaaagcaaatataagaggttaatcatgtcaaagaaaagtagacaaagaaataaaaatcatacaaaagaatatcataactaaattgctaaaaaccagaggaaaagagaaaatctaaaaaggagccagagataaaatacacattttacactaagaaactgaaataagaactattgcagacttcttgtttaaaactatgcaagccaagagaaaatagaatctctctctctctctctctgtcacacacacacacacacacacacacacacacacacacacaagatttaaaatcaattttgtaacctttaccttaagaagttggaaaagaaagaacaaataaaagctaaagtaaacagagctatggaaatagtaaagatgataaattattaaaattgaagatgaacagtcaacagtgaaactcaatgaaagcaaaagctggttctttaaaagatcactaaaatggataaatcttaaccagactaataaagaacaaaaagagatgacacaagttaccaattatcagaagtgaaggagaaaaatagtacacctccaagaaaaattaagtagctattaagctaatattaagacaaactacttgtcaattaatttaacagtttagattaagtgtacaaattttttgaaaaatagaaatttatatattaatttagaaaaaataaataatctgaatatttagtatatgcaattgcaagaaattgactttgtaattaaaagatcactcacagagaaaacttcaagatcatatctctattaaacctttaagaaataaataataccaaacctacacaaattctttctgaaaatggagtgggttaatgctccaattcattttatgtcactattattaccctaatatcaggacaaaaaatatcaaaagaaaaaataatacttcctaagaacattgacacaaaaatcccttaacaaatttttggtataccaatctagggatatattaatatgataatacaccatgatcaagtacagtttattgcaaggttgaaaagatgattgtgttaccaaaaaaaaaattaaacaatatgaatcactacattaacaacaataacaatatatgggtatattaacatgcagataattcattgaaaaattcagcatttattcaatattttaatttttttcataaaaattgagattgaggagaattatctcaatctgccaaagacttctatgaaaaataacatctgacctcatgcttaatgatgaaatgatgttttcttactaatatgaggatgaaggcaaggttatctactctaacctatatctcgtactttatacataaattaactcaatatgcatcattgacttaaatgtgaatcatactaccataaatacgatttagaaggaaacaaagaagaaaatctttgtgactctgggttgagctaaaggtgtttagatattacacagaaagcaaaactatataagaatatactaataagtggatttcatcaacattttataaaaacaaaaacttttgctttggaaaagacaccattaattacataaaaggaaggaaacatttttaaaccacatattaaacaaagaacatgtgttcagaatgtataacaaattttgaaagtcagtaaaaacatacaacccaattaagaaacgggccaggcctggcgtggtggtgggcgcctgcagtcccagctactcaggaggctgaggtgggaaaatggcgcgaacccaggaggcagagcttgcaacgagctgagatcgcgccactgcactccagcctgggcgacagagtgagactcagtaaaaagaaaagaaagaaaagaaaagaaagaaaagaaaataaaagaagagaaaagaaaagcaaaggaaagaaaggaaaagaaaagaaaagagaggaaggagaaagaaagaaagaaagaaagagagagagaaggaaggaagagaggaaggaaggaaggaaggaagcaaggaaggaaggagccagaaggcaagagcagaccaagacagcagaatagaaagctccaggcatcattccccaacaaggacatcaagttaataactatctacacagaagaaaaacactttcataagaaccaaaattcaggtgagtactcacagtacctggttttaacttcatattgctgaaagaagtactgaagagatttttaaaataacagtcctaaatcaccaatgccagccacccccttccccaagtctccggatgcagctgtgcggtgcacagagcatctttggacgctgggggagggagaccacaacagctgtgaggcattaaactcagtgctgtcttgttagagcagaacggaaaaccagatcaaactcagctgatgcccatccgcagaaggaggatttaaaccagccctagccagaggggaattgccagtccaagtggtttgaatttgagtgcctgcagaccccatgactaagggccaaaatgctttcagtctctaaataaacttgaaaggcagtgtatgccataaggactgcaactcttaggtgagtcctagggaagaactaggcccagacacagtggactgggaggcacacaatatactgagataccagtaggggtagccaagagaatgctggcatccccattcccctaaccccaggctgccacagttgctgctccaaaaaaaaaaaaaaaaaataccccttctttctgcttgaggagaggagaataaagagtggagaggactttgtcttgcaccttgaataccagctcagcaacagcagaatagggcatggatcagactcaaaaggcccccattccaggccctagcttccagatgacatttctagacacaccctgtgtcagaaggaaacccactgccttaaaggaaaggacccaatcctgccagcattcatcacctgctaactaaggaacactgggccctgaataaccagcaacgatacccaggtactacattgagggtcttggtgagcttctgagatttgctggattcaagtgagactcagtacattaccagctgatgattctgggacactgggggagggagaccacaacaactgtgaggcattaaactcagtgctgtcttgttagagcaggaaggaaaacgagatcaaactcagctgatgcccatccgaagaaggaggatttaaaccagccctagccagaggggaattgccaatccaagtggtttgattgagagtgcttgagaaaagcaaaggaaaaaaaggggtctttgttttgcactttgggtccctacactgccacaggggttggagcaccaagtgggctcttgggctctctgattctaggagctgactcttgggtggcatttctggacctgccctgggctagaggggagcccactgccctcaatggtgagttccaggtcaggcagcattcacacaagctgacctaagatactttaggtcttaaggggacatcagtggtaggctgagagtgctcctcatggccaaggttggtggtggctacagggtgaggctcctctgcctttggaaaggggagggaagagtgggaagaactgtgtctttcagtttgagtgccagcttagccagaatacaatagaagatcaggtatacttctaaggtttctgactctagtccctgactctcagatggcagttttggacccacccagggcctgggggacttcaccatcctgaaagaaaggacatgggctggctggcttttctgcttgctgactatagagccccagggctgtgagtgaacacaggcggtagccagggagtcattacagcaggcctggggagaaacccagagctatattgacttcaggtctgaccttatgcaatcatagtggtggtggccacaggggtgcttgtgtcactgtatccccaggttcaggtggctcaggacagagatggagatgattgtatgtttgtgagaaagtaaaggaagagaacaagagcttctgtctggcaattcagagacttctcttgcatcttgtccaagaccatcaaggcaattcctctaagagtctgcaagaaccacagcattactgggcttgggatgcccgtaaagcaggaatagcttagatcacaacaccaaagtcctttcaaataaccagaaagcctttcaaaaaaggattgctacaaataagcccagacaatgaaggctacaataaatataatacctaactttttaatgtccagacactgaagaacatctactagaatcaacatcattgaggaaaacatgccctcagcaaatgaactcgaaaggcaacaagtaccaacccaggagaaatagagatatgtgccctttcaaacagaggattcaacatagctatgttgagaaaactcaaataaattcaagataacaccaagaaggaactcagaattccatcagataaatttaattatgagattgaaataattaaaaagaatcaagcaataattatggagctgaaaaatgtatttggcatactgaaaaatacattggagtgctctaatagcagaatggatcaagcagaagaatgaattagtgagcaatctacagattcaatgcaatccctatcaaaataccaataacattcttcacagaaatagaaaaacaaatctaaaatttatatggaaccatacaagatccagaatagccaaagttagcctaaatggaaggaaacaaattacctgacttcaaattatattacagagtttttattttttttttaagttcaggggtaaatatacagaatgtgcaggcttgttacataggtaaacatgtatcatggtagtttggcacacagatcatcccatcaccacatattaagcccagcatccattagctattcttcctgatgctccccctccccacaggtgcccagcatgtgttgttccccactatgcatccatgtgttctcacaattcagctcccactttataagtgagaacatgcagtgtttggttttctgtttctacattactttgctgaggataatggcttccagttccttccatgtccctgcaaaggacaagatcttattcctttctatggctgcatagtattccatggtgtatatgtgtcatattttctttattcagtctatcactgatggacatttaggttgattccatgactttgctattatattataaacagtgctgcaatgaacatacaggtgcatgtgtctttataatagaatgatttatattcctttgggcagatactcagtaatgggattgctaggtcaaatgtatttctggttctaggtctttgaggaattgccacactctctttcacaatggttgaactaatttacactcccaggaagagaacaagagcctctttctggcaattcagagaattctctgcggagaattttgtggagaaaagcattcctttttctccaccacctcaccagcatctgttgctttttaactttttaataatagccattctgactggtgtgagatggtatcaactcattgtgtttctgatttgcatttatctaatgattagtaatgttgagctttgttcatgtttgtcggccacatgtatgtcttcttttgagaagtgtctgttcattatactactgagctatagtaaccaaaacaggatggcacgagtatgaaaacagacacatagaacaatggaacagaatagagaacccagaaacaaataaacacacctacagtgaactcatttttgacaaagctgccaagaacagtggggaaaaggcagtctcttcaataaagggtgctggcaaaactggatattcatacataaaaggatgaaactagattcctgtttctcaacatatacaaaaaatcaaataaaaatggattaaagacttaaatttaagccctcaaactatgtaattactacaagaatacattggggaatatctccaaggcattggtctgggcaaacatttctttagcagtaccctgcaagcacaggcaaccaaagcgaacatggacaaatgagatcacatcaatttaaaaagcttctgcacaacaaaggatacggtcaacccagcaaaggatacagtctatgagttgaagagacaacccatagaatgggagaaaatgtttgcaaagtacccctctgacaagggattaataaccagaatatataaggagttcaaacaactatataggaaaatatctaataatctgatgaaaaaataagcaacatacttgaatagacatttctcaaaagaagacatacaaatagcaaacaggcatttgaaaaggcaatcaacatcattggtcatcagagaaatgcaaatcaaacctactgttattacaatctcgccccagttaaaatggctaatatccaaaagacaaatactagcaaggatatggagaaaagggaacccttgtacactgttggaaatgtaaattagtgcaaccactgtaaagaacagtttagagattcccctaaaactaaaaattgagctaccatatgatgcagcaatcccactgctgggcatacacacaaaagaaagaaaatcagtatatcaaggaggtatctgtactcctatgtttgtggcagcactgtttacagttgctaaaacttggaagcaaactaagtgtccatcaacagatgaatggataaataaaatgtggtacatatacacagtggagtactattaagccataacaaaatgagatcctttcatttgcaacaacatggatggaactggaggtcattatgttaagtgaaatatgccaggcacagaaagacaaacaatcgcatgttctcacttatttgtggtatctaaaaataataataataataaaaacaccagaacttgtggtcataaagagtagaaggatgattaacagagtctgggaaggggaattgggagagaggtggggttagttaatgggtactaaaaatttagaaagaatgaataagatctactgtttgatagcacaatagggcaactatagccaataataacttaattgtatattttaaatagcttaaagaatgtaattggattgattgtaactcaaaggataagtgcttgaagggatggataccccattctccattatgtgcttattttgcattgcatgtctgtatcaaaatatctcatgtaccccataaatatatatacctactatttacccacaaaaaaagttaaaaaaattttaaatggccaaaatatttgaacaaatactttattaaagaagacacccaatgggaggctgaggcgggcagatcacgaggtcaggagatagagaccatcctggctaacacggtgaaaccctgtctctactaaaaaaaaaaaaatacaaaaaattagccaggtgcggtgccaggcgcctgcagtcccagctacgcgggaggctgaggcaggagaagggcgtgaacccggggggcggagcttgcagtgagtggagatgcgccactgcactccagcctgtgcgacagagcgagattccaccaaaaaaaaaaaaaaaaaaaaaagaagaagacacccagatggtaaataggtgcatcaaaagatgctgcacataattagtcattaggaaaattcaatgcaaattcaggaagacattccactattagaatggctaaaatttacaaaaaaaaaaaaaaaaagattagtgctgttaggaagcagaataacttgaattctcctacactgctggtgtgagtgtgaaatggtgtggccactttggaaaagagtttgtcagtttttcataaaactgaacattcattgaccatgtcatctggcagtctcactcctgcataaataaaaacttaaaatttcaacaactgtgtgaatgattatattagcattactgacaattgctaaaaactggaaactgcccaaatatccttcaatgcatgaaagattatgctacattcatttgccagtacatgcaatccaatttgctaataaaattattcatacatatgaaacatggatgaacctaagacatgtcttattgttttcaaaatctataaatacatatttaaaattattttatttaaacacatgcacaaaataaaatagattcaaaaggctatatattgtatgatttaatttatttaacattatagaaatggcaaaactatcaaggtgaagaatagatcagttgttccaagagggtggagaaggggaggctggtttagtattgaaggatagctgagggaatttcttagaattataaaattgttctgtatcttgcttatgttcatggatacatgactatgcattttcaaaagccataaaactgtatgctacaaatagtgatttttactttatgtaaatataaaggcaaaagcatattgatatactactatacatttactaaaatgactaaattttaaaagatttacaatatcaaatggcaatgaggatgtgcatcacatagaacagtttttcctaagaaaccacatcaaaatgcttctctcccaatccttgtagtcccacagggagggacagagttttaggagtattctaattggtttttagttaatcatgtattacaggttctataaaggtgatgtgaattacaactcactttgctatctgtttctttaggattcagctgatggttcactttaacatcctattatattagctttgtgacttggggccctcttgagcaatatattctgtactcccagttctggccagagaatataactttgacttttctggcgtttaattcttatcataagttcaagtacagagataatattcataaaaaattatgtgaggaaaattcatttatttctttacctatttaaaattttcttttcagaatatgtcagtgatatagtttggatttgagtccctggtatccctgcccaaatttcatatccaattggaggatggtcctggagggtggtgactggatcatggggtcagatttaccctttgctgttctcatgatagtgagtgagttctcataagatatggttgtttgaaagtgtgtggcacttccatcttaactctctctctctctctcctgccaccatgtgaagatgtgctgcttccccttcaacattctgccacaattgtaagtttcctgagacttctcagccatgcttcctgtacagcctgtggaactgtgagtcagttaaacatgttttcttcattaattacccagtcacaggtagtcctttatagcagtgtgagaacagactaatacagccagtatattataaaatgattccttttgactgccttatcttggcacttcatcaaattttctttaacaactgttcctttggtggtacaccagttttcactgagaaacattataagaaaggccttatgaaacttcctattctatttttgtcggaaagattattgaggtccttttctgccatatcgatgtgtctacttactgatgacctacgggaaaattatttgtgcattttagcactaggaaaaggtctacctctggcatcctaatttcctcttatattataatcctataaattagttgtttatagaatcctataaactagttgtttccctttttgttctaggccactaggaaatttaaagccaaaatgaagggaaatatacttttgatgtctccatcaaaggagtgttttgaggatcattaagttatatgtggatagatcaggatatcataaataagaatataaagacacagatatttggaaaatagttttgttacacataatgtagcagaactgtgctaaaattaaatcaatcagattatttcctattggatattactgcaaagcttttggaccttactttatttacaagaagaaacatttgctaacaggcaaaaagcaaataagcatagtgtctaacagaaaagctgtaataattgtcacaccaccttgacaatgcaagacagcattcaaggaactctttatggagaggcttctaaaaaccatttagcatctgaaggaagtatacatataacacacacaatgtgttcttatagatgtctttgtaaaaaaaagatattttataacaatatagataaacaagtgattaagaatgtgggcctcagggtcaatgcagtgggtttatgtgatctggggcaaaatttttaacctctgttagggtcagttttctctttgaaaaaaggaaacagtacctattgtattagttcattctcacactgctatgaaaaaaataccagagactgggtaatttataaaggaaagaggtttaattgactcacagttccacatggctggggagacctcaggagacttacaatcattgcagaagggacctcttcacagggaggaaggagagagaatgagggccaggaagggaaatgccagatgcttataaaaccatcagatctcatgaggactcactatcatgagaacaggatggggaaaaccatccccatgattcaattacctcctcctggtactgccctttacacctggggattattacaattcaaggtgagattggggtgaggacacagagccaaactttatcattctgcctttggcccctcccaaatctcatgtcctcacatttcaaaacaaaatcatggccttccaacagtctgcaaaagtcttaactaattccagtattaacacaaaagtctgaatccaaagtctcatctgtgacaaggcaagtcccttctgcctatgagcctgtacaatgaaaagcaagttggttccgtcctagaaacaatggaggtacaggcattgggtaaatacaccatggcaaatgggagaaattggccaaaacaaagggtctacataccacatgcaagtctgaaatccaatagggcagtcattaaaccttaaagttccaaaatgatctcctttgactccatgtctctcatccagaccatgctaatgcaaatgagaagctcccatggccttggccagctccagccctgtggatttgcagggtacagctgctctcccagctgctttcacagcctggcatttagtatctgtggcttttccaggtatatggtgcaagctgttggtggatctaccattctggggtctggaagacagtggccctcttccaacagctacattaggcagggccccactgaggactctgtgtgaaagctccaaccccgcatttcccttctgcactgccctagcagaggttctccctaaaggctctggccctgcagtaaacttctgcctggacattcaggggtttccatatatcctctgaaatctaggcagaggttcccaaacctcgattcttgacatctgtgcatctgtaggcccaacagcacatgtaagctaccaaggattggggcttgcaccctctgaagccccagccagagctatacattgatccctttcagtcgtggctgggatgcagggcaccaagtcctgagactgcacatgacagcaaggccctgtgcccaacccaggaaatccttcttttctcttaggcctctgggcctgtgatgggaggacctgccatgaagacatctgacatgccctggagacgttttcctcattgtcttggcaattaacatttggctcctcattatttatgcaaacttctgcagtggtcttgaatttatactcagaaatgagtttttcttttctaccatattataaggcttcaaatttcccaaacttttatgctctgcttcccttttaaacataagttccaattccaaaccatctctttgtgaatgcataaaactgaatgcttttaagagcacccaagtcactccttgaacactttgctgctagaaacttcttctgctagataccttaaatcatctctctcaagttcaaagttacacagatctcgagggcagggggaaaatgtcaccagtctctcagctaaagcatagcaagagttgcctttattacaattcccaacaggttcctcatctatatctgagaccatctcaacctggacttcattgtccatatcactattagcattttggtcaaagccattcaacaaatctctaggaagtaccatactttcccacatcttcctgtcttcttttgaaccctccaaactgttccagcctccgcctgttacccagttccaaagttgctttcacatttttgggtaactttatagcagcaccctactctctgtggtaccaatttaccatattagaccgttctcatgctgttgtaaagaaataccgaagactgggaaatatataaaggaaagaggtttaattgactcacagttctgcgttgctgaggcggcctcaggaaatttacaatcatggtggaaggcacctcttcacagggcagcaggagaaagaataagtgccagcaggggaaatgccagatgtttataaaaccatcaaatctcatgagaactcactcagtatcacgagaatagcatgggggaagctacccccatgattaaattatctccaactggtctcgcccttgctacatggagattattaaaattcaaggtaagattttggcagggacacagagccaaaccatatcacctatcttctagggttatcatgagcatcaaatgtaaaaatatgtagaaagcattgtggaaataccaataaaattgaaatttcaattttaccccaccaaatggggtagaatgtagaaaggccagaaataatcacaaaatccaaactgtatgatagcagtgagaaattttcattgttaaaaatttattgaaaaaataagattaaaattatgaaacattgttcagtgtctatggtatttttatttgacagttaagaattgtgttgtaacaacacaatataattttattttgtaaacccaaacctacagagccagaaaagcagtttaatagtgaaaagttggagaaacaacacatatgtctattcctatgaggtaaagataatatttactcaatatagcactcacagggcctttctcactgctatcatacattttggattttatgattatttttctggcctttctacattctatcccatttagtggtctaagaagtgttttacctggacaatacatgattcaatttgcaatggcaagtttagccattgtttttcccttaaaaatttaaattgcaaaaaacaaaagtgaaataacatattatttattaaactggggaagaactgcctccccccaccatccaacacacacaccttgttcaagagagataaattatggaaggaaagtgcctgcaaaagtaccggctgttactgtttatgtcgttgtttccagctaggttctgttctgaccaggttgaattcattactagcaatgtattatttactgtctctctgaacagaaccatatgtcattggtctgcgccatgtgaaacccctattatgttacatttgtaagaattataacttatctgaatatatttgtctacatatgctgtagcctaataaaactatcttcctcaagtgacaatagttccagctacagaagtttcaactgggtatcagaaaatactgtttacatgtcctctatgcctgtaacttgctgttatgcattgtatgtctctcagcatatttgtttttattgtcacatttacacaataagaattcttttgttcttagtattacttttttttgagtaaacctcagtcacagacattccttttctgccttgtgaaacagcccagtgcctatatagatctgtacagctaatcctatttatgtgccatatctttcctgattgtctgtacattattcacaatttcaccaagatcagggacttaatctactagtatttttaagctgtacttgatatctaatagcattctgcttctaaaaagaaatataattcttcaataaatgctatttgagtaacaatgctttagatgctgttgtggactcagttgtgtacccctgaaattcatatgttaaagtcctaaagcccagtacttcagaatgtaactatatttgctggtagggtccttaaaaaggtaattaagttaaaatgaggtcattaaggtgggcctaatccagtatcactggtatccttataaaaaaaggaaaactgaacacaggcataggcatggagaaagacaatgcgaacacactggaagcaaacagctatctacaagtcaaggagagagacctggagcacattcttccctcatagctctcagaaggaaccaacatggccaaatcttgatctcagacttatagcctccagaattgtgagacaatacatttctgctgttgaagccaccccatctgtgatactctgttttggtaggcctaccaaatctatacaaatgtcatatgaaaaaattttgtaaaggcgaatcatggctgttaagatgtattactgatatagtttgagtatttgtccctgtcctaatctcatgttgaattggaatcctcagtgctgaaggtggaacctggtgggaagtatttttattatgtggaagatccctcatgagttggtgttgtcttcattatagtgagttctcctgagagctgctcatttaaaaatgtctgcacctctccctgcccccaccactctcgcttgctcctactgttgactgtgatgtgcctgttccccctttgccttctgccatgattgaaagttccttgagccttcaccagaagctgagcagatgccagcagcatgcttcctttaaagcctgcagaactgtgagtcaattaaacctcttttctttataaattacctagtctcaggtatttctttatagcaatgcaagaatggcctaacacaactattgacatttaaagtacttgaaataagacatattgccttattttattgatttcatttttttaacatcagttgttgactttttattttgttttacaaagtttaaatatgtttttattatttatcctcaaatagcactgaaagtatcacaggatatataaaaaagcctgccatttttttaatacaatcagtttttctctagaaaaaaattacaacatgtaaaaaataatcaaatcagtaattccatttctgcttctctcatatttcccttcatccttattcttatatttcattctctttccagtaaactagttatcccttctgtatgcttaagagtgtgcctatttgtaccaatcccttgatccttcttacaaaacttcagccaagtctaaagaaaaataatatccataaggttttctgttgtgagcaaaaaaagtattgttttcttcatatttgaagctggagctgaggaaatggataagctaagggtttgagttataaggtgttatggaagagtgttagggaataaaattgtgtcactctctggggaaagagttctacagcactttatatttttttccctaacatattaagcctttggtttctgtgaaaggatcatttgggttggcccttctcgaatttgaaacaacatgatgatatatgaggcttaataaaaaggtctgttcttactctctacacttgctacagctgataacagagaaataaaaagttatgtcttattcatacataacaaatgttcatttcatttgtcacatgaaagaataaaagataattaaatgaaagaacaatagaacaaataagcaaggaataaatatacaaaaaaattaattgtctggcctgtccagaatgtaatcattaatgcatctgctttttgccactcccctgtatatcatgccctattcttggtggatctagaattgatggctaagaatggatgcaaagcaatttttatcattatcttctggtgacgtcacactagcagtgatagagagaccttccatggtcactgagtttccagacgtttgaaatgtttctggacagactagacaggagccagtgtttttttttttattattattatactttaagttttggcacacatgtgcacaacatgcaggtttgttacctaggtatacatgtgccatgttggtttgctacacccatcaactcgtcatttacattaggtatttctcctaatgctatccctcccccaggcccccaccccctggcaggccctggtgtgtgatgttctcctccccgtgtccatgtgttctttttaggtgtaaagaccaatgtgagataagcagaaacattactgtacttaagattcaaaaatttctagttttacaaaatattatgtcctgaccctataagagtgcatgtactcaacataatggatatatctcatataatgccattatgaaaaagaaacattagctgaaaaggtagttgtcatagaagtatataaatggaatacaatcttattttctgttagactattaggtactaccaaacaactacaagaaggaaatgacaactatattgaagaaagatgaatacagagatgatagccagcagcaattaattttttaaaacaaataaagtaagcgttatcaacactttccattgaacaatgttgtaatagtgtatagaggaatatattgcttgctgataggaatccattggttcaacaagaatgaaacaaatcgattgactctatcaatgccattttacacacacaaaaaaagtaaaaggaaactcctttgaagccataagtgcctgtgtctatatagctaagttagtagtgtaccaacgagccatacatatgcatgggtgatgggcatcaaaagcttcatcagctatcaaatacatccactgatggcttttctgtctctaaaattcctctcattattaattattctttcagttgaaggcatttttttccctagaaactcttccttaaaatgaatatgctcaaacggagaagtaacacatataaacctgttggtacttttttcccttaaggcctaaagacaagtcctagttccaccattctgtgagcctaagcaaattacttggcctcatttcaacaggcatgattttttttctttgataaatttgtcagacctaaggaactcatagcgagagaagcagatattggcaaaataaagcaaaatcaggtttttaatgagggttactgaatagatgttttgatgacttccaaacttcaagtttcatcacagtttgcctacatgtgagcacctaaatgtgagcattatttatgatccttgcttcctgtggattctttcactacagaaaatcaacagttaaaaactattacctttacttggaacaatgaggccaataatcatttccctagagaaaacatcagtcagcactgcaatatcctttcaaatataacaggtagaagcaagtcaggttagagaaaagtgttaatttatttatagcatgacagagagaaaatcagagatgcaataagtttgcacatttcaacacaagtcattgaccctgccaaatatttaagaaagtagatttatttcataagctatgaaaataattttagtcttaacacttgcttggccacccacctaccctgaaaatttctggcatttacaccatttttttctttgaaaacttacaaaaagtcgaatcccttgtccttgattctcaaatcatactctggggaaaacatgccttcagctaatgatggaggtcagttgcaggaatactcaacaagttatatagaatgttttttaatggaagatgtggttggcattcagtcaatcagtaaatataaactgaatgacaaaacattctgtgtagtcattactttaaaagctgggaatataagggtgaacaggtcatccaaggtccctgttctcattggtacaaaaaataaaataaaaaagtaaacatagactaggatatcagataattacacatgctttgcagggggaagtaaaatagagcaagttttctaaaagttggcactactgctattttggaccatataattctttgtgtgtgtggctgtggtcctgcacattgtaggatgtttagagcatctgtggcatctatcattaaataccagtagcagtcaacactcaacaattttgtaagcatttccaaataacctgtaggaggccacattgcccccgatggagaaacgttgaagtaaaatgatgtgatagagagttactgcctgctcactggatgaatgcaatttgatggtcactaaaagtcatttaagtggagaccttaatgtcatcaaagaggcttccatgttaacatagggaaaaaggaatcttggcaaagagaacagttagtgcaagtgagtccaaggcagaataagaataaaaagactgaaaggaggcaagtaggggaagagaagcatgagatgagtggaaagtggaagtcagttcacatgtagattttaactagggtaagacgtttttattttattctaagcataacgaaatgacattaggggacttttcaacaattaagtgctattatctggttgtgcttttagaagatcactctggcttctctctggagaatagattgaggaggcatgagtagaaaatggaagataagttaggaggtaacaactcacgaactgagatgatgattgtctcaattatttgcaaatagaatgttttcttcccattcccttcccttgtacatagaccacctcctccgtttcctaaccttagaaaaacattttcttaccttcagaaatatggtaaattattttaatttatttttattaatttaatttatccacgtattattttatttttaagtaaaattacatagcattaaaggattgaaatgatatatgatctctgtcattaagggtatcttatacttttcaatgagcatgcttcatatgataatacgtcatgtatataattttcatttcctacagtcaaaaataaagtttagaatttgctaatcttgtctgtgtaacagcaaaaaacaatgggaataaatagccgttgaatttagatagatgtgggttttttgttaattggtcttgggcaagcctttttaacattgctttatttctttacttagctacaaaatataggaactattgtgttgtgtgggtcagaaaaaaattggcatacattttttttattttttaaaagctttatttagaaataaccataatacaataagctgcacactcttaaatgcaattttataagttttaccataggaatacacccattgaattatcaccacattcaagatcaggaatatatccatcacctctaaaagtttccttgtgtacctttgcaatatttcccttttgttcctctctgtaagtcctacctccaggcaactacagcttcttttgtcatcccacattagtttgtttttcctagtattttatataaatggaatcatagaaaatgtacttttcctagaaagtttctgaaaaaaaaaactgctgtaatttttatctttgttcctctatattatgtctttttcatctagctgctattaagatattactctctcttcactggtttttagtaatttgactgtaatgtgcctggttgtgattgctgttgttttaatctttattgggcttagaattcattgaacatctttggtctcttggtgttgtaacataaaaatatatttggtatttgtccccagtttctggcacagagctcctaaaacccttggaatttcctgagtgataataagagtgtcatttgtcataatgagacaacttttggctggcccctgatagattcaggttgggggctgctcagctaaaagatcaaacctcaattagaaatttggaactttcagctccacctgccagtctttggaaaagggcaaggggctagagaacgagctaatcatgaatggttaatgatttaatcaatcatgcctgtgtaataaaacattcataaaaccccctatccaacagggctcagggagcttctgaagacatccacatgccaggactgtggtgtaccccagctccacagagacggaagtttctgtgcttggaaggctttcagacctcaccctatgtaccccatctcactattcacttgtatcgtttataataaattgaagtgccttacaacaaagtgccttcttgagttctgtgagcctctccaggaaattacagaaccagagagggggaagtgggaatcccctatttgtagccagttgggcaaaagtacaggtgtcctcggatttgtaattggtgtgtaaagtgggggcagtcttgtgtaactcaactctaacttgtggtatctgacactagttgcaggttgagtattagaattgaattaaatccttggacacccagacggtgtcagttcaagaagtatcattggaaaagatacctgtatttggtgtcaagagggaaaaaaaaagtcctctcaccaggcttatggttttcatcaaatttggaaaattttctatctacgtttcttattttaaaaagaacttatctctctttcctctccctatgggtctccagttacatgaagattacagtgtttgaaattgtcccacagcttactgatgctggattcattttttaaaattctcttttctctgtttcatcatggacagtttctatggctacatctccaaatatattaaatttttcttatgcaatttaatctacctttaattgcatccagtggatcacaccatacatcgtagtttttatcttaggaagttcatttagggtcttttaaaaaatcagatagatagatgatagttacatagatagaaatatatttcatgccttattttttgtataaacagaatataggtatagaagtgattttaatggtgcttttaacacatgtcagttctggatcagttttgattaattgatttatttcctctttttgcatcatattttcttgcttctttgcattcctgatgatttttcattggatggcatatgttgttagttttatttcattggttgatagatgcttttgtattcttatgaatattcttgagctttgttcttgggtatatttatgtcacttgaaaacagtttgatctttttgaatcttgtttttaagacttcttcattggaaccagcacaatgctcagcccagagctaattatcccctgttataccaggcacagttatgtttacatcttttgtgtaattctccagcctctggtatttgcttcatatgtcagggaataccctcagcatctctccctttatctctctctctctcattttcttctttctggtactttttcttgtgatctctaaccaccttgctccctctggagtcagctttatctcctttcttcagtgagtctgtgaggctcgacttggatttcacctccctaacccacagcctagttactctctcaaagcagtaaggtgaagcagcagtgtggttctcccttgtttcctgcctctgaggaatcatcaaccttcattgcctaatgttcagtgttttccaaactgtttcatatattcttgtcaattatttggttatttcattgcaagagaaaatctggtatctattatattactctttggctagaaacagaagtcaagatgtattttgaagatctgatcgatagaagaatttcaataactaataatagctaaaatttactatgtatcagacttttatacttggtcttctagaaacagtagaactaatactaggtcttttacgtacattgtgtaatctctgatgccctctcaccactcattgcttccattcctctctttcggaaaattttattgttatagaacccacaccttgatccgtcattgcagatactcttggattgaacttttatccatgctgataagagttaaggaaatgagttaactacaccatcagcattcatcaattctggagctcttttagttttccacttaatttttagtgtaagcacatagttgcatcacaagtaagaagcgtatgctgaactttacgattaataattttctattttaagcaactgttattttcaaattaaaaaaaatactcttcaaaacacaatgttagtcttctcagtattttgataacttatttccagaatgcatcctcacgaaatctctgtaggctgggcttttgtcattattgttattattttctttgaaaacactctgatggatctaaacttgccatccttttcctcctctttctgtttgatacacacttggattatagcatagtttctagtttttattttgaaatcttgaatagaacaatattctatgccaaatgatgtcaatatcactgctcctcctcagtgatagaagaattgactttatctgctcagcatctctctacttctacataagtgacatttgtttttgtgtctctgatcaatctggttaaaaaaattaacaaaaatgccatcctcaacaagtggacatgtgctgaaaaatttatcaaagataacttcttaatactgatgcttggaaagaatgctggatgacaaattgctgctgttgtgagttattggagttagtatttagaaaacttagacagtacttacgtgatccttattcaagtacagctgttactgtcaagtgttagctggaatttatttttttttctgtgaaacccagactctaagtagttcttttatactttctgcaagtaatcataaagtgtggatttttttatccccacccagtttgagagtgagtaagaaaaagagaaattctgagagatccttctgattttgctctgtgtatcgcacaaatacaactacttctttgctctgcagggtgccacatgataactgcattaagcatgattctttgctttcgaagtgctaggaactcagtttaaactagttaaacaaaaagggaaatttactgttttaagtactgaagattccgaagttaggagctggtggtaagaactcagacattgtcatcagaattcacaagccctacatttcttggtaatgctttcttttatgttgtttttactatcaagaaggttctctctacgtgattgtaaagatagatcccacatcaccaggctcatattattcttaatgtctttaatctcagaaagattgaggcttcttctttccagcatcaatatcaattttcccccaaaagctttgataggtcctgcagtcacatgtccatctctagggcaatcagtgtagccaaaggaatgaggtaataggatgaagtccccatcccatgttcaacttggacaagacagagtagagtcagcctatcctaactacgaagagcagttcctcccaatacatactgaattccacagaagaaaaaaaaatgctacgcatgtaaaaaatacataccactaatccttcaggtatgcttccctgacatgtgttactctacgtgacctaatatagtgcatagcctgaaccctcttaggttcagcaaatatgggacctttactatggttagtatgtgactgagagctacaacatcagcaagatgccagaattcttgctaacttgtttatttctgccccttatcaataatcaatagctccaattaggtaccatttgtgagatgaggctagattttattttctgcattactgtataaaactttgttattttgtcccctccattcctacctacttcctttcagtttcctatctggatgctcttctatttcttataatttatactttttgatgttaaaaatgttaaggtgatttctaagtgtgcataattttaatataccatataaaaacaaataagtaataaccactttgaattaaacatcaataaaataaattcaggatatgccaaaagattcataaactgagaagctgaattgctaaagctttgataaaagattgcattagtactcacacttcagacatttattaggaattactaggttactaaaatatgtcaataatccatggagaaaaaatcaagagaagtagctatcactcaattcattttcaaggagattgcagactgacttggaagaggcacaatcaccaaaacaagcacaaatacaagaaagaacagagtccattttcttctgtgctgtggtgcaagcataacagaaaataaattcataaaatggacagaagtcctcagagtggagtgcactggtaggaaaagcaagacttgtgtagtctgaaagaaaagaactgtattcatggagggcatttcaggctaagggcaaaggataaaggtataacacaaaggcaaaagcgatcttattccacatgtggttaagggacagtccttaatctgctaaagtggaatattgagtttatgttaaagaacagtgagaaatgccttgagaacagccagtggggtgcgaagccttgtaagtatgaaaagttaggaagcaactggagaggctgggattagaaagagacacattagaaagaggcaacaaagtttggcataacaaagtttggctaagcaagaagtcataagcctggaccattcaatacgggacaggtatatgaaatccattcaggcaagtcagcatttaggctcatgctttgcaacaaaaaagagcttagaagagtttctaatgtgagcaggcagaccagaattatccagtcaaaaaggaaggcactgactgaagtgggttgcttatataggcaacgatccaagagaccagggtgggtggaatgttgatttatttcaattcaactcaatcaatatacaaccaacatccagaagtaagagacatgtgcaaaaattttggagacacagaggaataaaataacacattggagtccaggcagagtaactggaagggtaaattagggagatgaaactagaagcaggaccttccttgctactgagaaaactactgctgaggtttatgtttcctagtgactcccatctcatgacaaactgaagctgcatgtgggtaagatggagaccacagacttaccccattagaacagttctatattctgactttctatcttttcttacatgttctcaacatattttttactgacactctttcaaaaaatctttcaccaaaatctaacgttgcttttttctcttttgattttcgagtaggaactttactggctgtgtgatttttagacaattttcataagctctctgaacttcatattactcctctgtaaagaaaggaacattgattgcctctcagagtttttagcactaaataatgtaaaaatatatcacagtaagcagcacagagttatacaaggtatgtgctcattagcgtaagttttcttcagctcttcactactccctttctcaaaagttattctttctgtagtgatagtccacctgggagggaaatttgatggtccacctgggagaggaggagaaggataagggagctaggagcaggcatttcttgcagtattaatgtgacagtgcatacctaccatccaattctgacagaagaacatgatagagaagaaatggaaactttttttttaccacggcttaaaacttttttgtgatctggccagttctgtgacctcttattctacttgctcacaccctctcctttttctcctctactccaagcatactggcctcctttcctctcgccaaacataagactctcctaccccagggattttgcacagggtgctgcctctgcctgacatgctcctcacaccaccagttgtgtgcaaaatttctctctgcctttacagctttgttccaataacaccttctcaatgaggctcctctcacaaaagtatttaaattgaaacatcttcttccttgccctatcattcccaatccactttaccaggttttattctttttcacctaaactaatcataatcaaatcaaatctagtctagccaccttatattatataatgtattattatgcttaatatttatcttctgtcttctttactggagtgaaagctctagaagatgcttttttctattttgctcactatttgtatcccatgctttggcatggggtaggcttttaataaatacctgttgattaatgaaggttgtgatttacggtaaaaatctaagagatttgcattggtaaattaacaaaactcattaagagatgtagctgaataatttttgttgttgtttttgttgtttttagacagagtgttgctattgcccaggctggagtgcagtggtgcaatcttggctcactgaaaactccgactctggggctcaagtgattcttccacctcagcctccctagtagctgggaccataggtgcatgccaccatcatgcctggctaatttttgtttttttgttttgttttgttttgttttttggtttttggttttttttttttgtaaagatggggtttttccatgtttcccagcctagttgaatagttttaatgagaaaagaatcttttttattgagagacaataacttatgagagagtccaaaactaactttgaaataaaaattgataaaaattaatcaaagtaatttcaaagtggaaaaatgactgttaaacctggtcattgaaataggggatcagaaagattaatttggtgacagatacaaattctaataccaagaggaaaaggagatctcctttaaaaactggtttttacaagaagatacaaacaaccttgagtcattagttggaaagataactagaacatgtacaagttttttggagaaaatattatttgttcagataagtagatggtaaaaataagagcagcagagggagctgctttgagagttgattacattagtagtgaaaacaacaggaaatgatttggaaaaagagacaatagtcagagaccatagaaataggtctacatgtctaacgtgcaattcatgccaaaatgatagcaatggtaaccatgactttcaaaaaatgaatcgagtaaaacttaataggacttctggcttgaactaagatttctgaatgatagttttcaagtcatataagatgcaaattactatcataattttattgaatatatatgttttatatatataatttgacttttcaaattatatgtgtatatatagtataaatttatatatatatatatatatatataaatttgaaaagtctgtatggctttccatactctgcaaacacatttttgaaagccattttaaattcacttccacattttccaaaatagtatcaaacagactattaccttctacaattaatatgaaaagtcacaaaatgtaaataaaaagttattctcaatattcacaaacatctgttttaactagctttagtatcaaaattgtttggcatttaaatctaagagtcttcttgagacacccctacagttttcatagggacatatgctactggtgtagtgaagcattcgtgtgtgtgtgtgtgtgtgtgtgtgtgtgtgtgtgtgtgtgtgtgtatgtaacttgattatacaaagaaattaccatggaaaagaaagctaaaggtcaatagcaagtaagaaattgtttaattttgtcattactgggctttttactttttttgttcctaataagcattgaggctcagaaagcacgaatagaaacttgtgggattttgttcttaaatggattagtgctttcaacaatttaatgaagataagatcaaggttatcattcttattaacaacatattctaggtccagaaggtaaattttacatggtgaattttatgtggtatgtattctagagcttctcctctcatttttgaaaaaaataccatatgacatattttgtagaataatacgtagaaatcaactctgagcactgttcttccagaagccccctctactcagagtggctctactgccaaatgaccatcactgcatgattacatgatggtggaactcagcatttgtgattagcacttagggtgaggagtattcaccctggtgtctgaaattatacttttcaaaaaccattctgggtctttttaaaaaggcagagccaatgtaagggatatgttcaaaataaacttaacagaactattgctaatagagataattattttggttaagagcaataagtggaaaaggacaatttcttcaacataaagacaagatttttctttttttaaaaatacaaatttcctttaaaaagcacacatcttttttcttggctgttcatcagtagagcaggcaaaactggacttgccgaaagtgatcattgctattaccttcctctgcaggagaagatgcaacactgatatattgttttcatatacagcatcttctgactccacaggctttgctagtgcataacaattacacagcactgatataaaactgtcaagatttagttttaaggtcgtttaagtttgggattagtactttaaaaacttgatatcttcccttattcaccagtgaacaaaggggagagtcaatttagcatggtcacttattagacttctatttgcatccttattgtggagatactaattgactcaaattgaagcctccagttttcatgaggcattggtgtttattatcaatgataaagaattcacatttcgggccgggagtgatggctcacatttataatcccagcattttgggaaaccgaggcagtggatctcttgagtcgagaccagcctgggcaacatggtgaaacaccatctctactaaaaatacagaaattagctggacatggtggcacacgcctatagtcgcagctacttggaggactgaggtgggagaatcgcttgggtccgagaagtaggggctgcagtgagccgacattgcaagccgagattgtagcactgcattccagcttgggtgacaaagtgagaccttatctaaaacaaacaaacaaacaacaacaaaaaaaccccatacatttcacaagtatataagaaattgaagatatcttgattttctatcatggacccagtctcagccaatgtgttcaattttatactaatcagttactgccttaaattaattagccacattcgacacattactgaatgctgtgtgtgtgtgtgtgtgtgtgtgtgtgcgcgcgcgcgccagcttgtgttctttttagaggcattcgtgttgacattgataagatgcaggtgtttcctgctagttagcttcaaacctctgtgaggatgcagtgcttttagaagaaaaaatcaagttttttttcctgacactttccaaagatttgtccattttatattactaaaaatataaattgatatgactgacacataagtcctcaagaatgttcaattttctctttatgctattgtactaagaaatacagagcaaatcagagaatgtggcatttcacaaaatgggtttttgagaatgggaaggatactacaaaatatctaccaccaataaaattccattttatagaaagttctcttaataggattaaggacaaaatgtttttcgattttcaaataaacctgggaagtatgaattaaacaaaaaacaaaccccacataattccttattactggacttccagagcctttaatatgttaatgtgcatcgtgagtctccaagacaggtgtgctcagcttttctcaagtcaaatatggtcacaggatagctctttttttttttttttcctacagatcatctactggaattattattccaaagaaagcactcttcaaaatgctgcacagtgtgctgattttagcgtcagagattagagtgagatttaaaaggcaagtgtatctacattttaatactcaaacatctgatatatctgctgctctttggagaaagaaatattgtctttacagaaatgataagaatcagtgagggttttgagggtgggcgttgctcagattgtttctgtgggaatagtttgcagatgtgcagtttagcatctgagtgagaacattcctccagtaaacttgaattacatatattagccaaatgagaaagaacactcttagaattttagtctgtattgtaactgaagtttactctgttccaaatattctcttatttgccatcatgcctccagtttgttaaaattgtaaatgtcacttgcccagattgagtagaagtgatctgatgtattatttatcttccagcttcatactatactttctactgaagagcccaaggctctgagaactttccaataaaggaaaaattatagaagttagtgggggagtggagaagctaggataagtagaatgaaaatgagagacccaggaaaagttaaatactggcaaattcatcagagctcatttgttaaaacagcaaaatataatacagtagtgatataattgtagaccaaaataaaatggtgcagaattatatatgtcatctaactgcctgtatagtactgattcctaaaaaaatccaagaaacttgatgtgctacatcttccccccactatcaaatggataacttgttcattgatttcaaccagtatgttgaaacttctcaacattggaaactattaaatctttcaacactattcagatccagacaatctgattattttacatactttattaatcatttgaaatgctcataaaagaccccaggcttcctcaaattattgtgagcaatttattcacttattgtagtacaggaaggttgggactgatgcattccaaacattacctaggaccctaaggatagggcagagcacagaataaataagaaaaagcatttgatttttctcaggttcaacatcttcaccaaaagaataggaccggcaattactggctgcacaagtaagacccgcagaatggtttgtttatagagctggttggctgaagccagatggtctcagttcaaattctatctttatccctccctagcaggtactttgggcaagatatttaaccactcttaagcaagcttcagtctccttatctgtgaaatggatataagaatacttacattgacagaattgttggaaggctattgacttattttatataaagtgacaaaaatactgcctagcatgtagtaagagctcaataagtaattgttacaattattttgattattccaaacaacttttctcctttctttctcctatgttaataactcttccacaatggcttatccctttttgtttaattttactaaagtaaaaataaatgctgatttaactatgcttctaacacaatctatcaccccatctttctttttctccttattgccacacttccttaaagactagtctccctcattcctcccaaatgaattctgcctttctactcctataatctgactcttaccactagtgtaccactgaaacagctttcattaaattcatcagtgccctaataattttaaatgcagtgggccgagtcattgtcttgccattgcagtctttgatcatcttaaatgctttcttcttgcattgtcctcttcagttctcttgtctctgcctgctcttcttcagttaccttaacttttttttcccctccatttccatttaattacagtcatttccccaaggctctactctctgcatctttaagttcaatcaatacactttttacccggaaatctctgttactctgttactcctttggttttaatttgccaacttccaatttttcttcactagatgtggcctatttcttaattttcagttaccagttacatcaacatgttcatatggatgccacaccagcacttctatctcagcatgagtttttcatttcttgatcctctaattcatccattaaaatgcagccaggtttagtattcatctttcaagacacacttaaaatggaacttcctttacaaaaccctaagagctccaagataaattttatcactatcccaaactttgcttgagtctctttcttatttatggttatttttacctcgatagtgatttttaacccaccactaactgtaagctgttgagagcacaaaatacatcactataattttcaaagtacttcaaaagtggcagggtgaacctgaaatctgatatttaatgaatggttgcttaattgggtggctggtaaagggggacattgcctcttaaaatggcaaatgacatggagtgattacatgatttatagaaaaacatataggagcatagtacaattacagacactggattgaaaaaaataagcaagattctagtagctatgataagaactgcaaaaatgaatacacataaacacacacacatatatacacacacatcgtgggtatacatataattaagtatataaaatgtaaaagtacataattatataaataattacgtgcaatagataaaatatacttttgaatggtatttcagatattccattctctgtgctactttttgatgacaggtactagagggccacaactgaaggtgaggcatctgagaataatatcaggtgcttaaaggaatttgaaaaaaaattaaattgttacatatgaattaaagggttaggaagtactgagaaagtcatctactttgtaatcatgctgtagactataaaaagtccttaccttttattgaaatgatcaattaatgtttagacaaagagaatattgacagagttcctgataatacacttcacaacctccctagattattgttttaatatttcattaccctcagtgtagaaagctcaaaattatcaagtacattgaccaaagccaggctagccaattagaaaaaagaattttcttatttttgaaaagcaaatactatcttctaacttttaaaattatatttaaaagtttcttattgattattgtctattagttcagtcaaactattagtttcttcccactttgatgtatttgttgaaaatgttttgatgaattttatgtctaaaatgtggtctgggatttaatatttaaagatcttgtatactttcacaagaactatttttttccttttgtttgcatatatttagagattttgaaaatgtaagcagcacctttgattttaaatacctactttacggttaatcattaaattaccatttaaaatgtattttttcccctaagttcgagcagcaatcatagagaaagtcataatgtgctgcagtaattattaattgattaaaggctttgtaattggcactgagtacagtttcttgaaaaggcttatttcctatctgagccagcaaaagctgccacctttcaggtttcctcaagtcatgaagtaatctgctggttgccttcaggaaatagtttgaatggagtcagaaaagtgctcctggatcagagttttcccaggatattaccttgtgatgaggaacctcaactgtaactagttcttcagattaatgctttccaatgtctcgtataataaaagaactaaatatttgctgaagaattgaatgcatttttagatatgcagaaggagaaaaaatgtggttaactatctgcctctttcacaattaagaaaagcaaaattctgcaattctattccaaccaaactaaaaatgccaactggtatttaacatcatgaaggcacattttggatgggctctgtaagaggagtcaggaaagaacacttgaaaatgcaatgtagtaaagttgggtgcttcctaaaattgttctcaaatatctggatgagaagaaatcagaaaccattcatgcatgttttaagcaaaaaagttttatgtgtaaaaccagtctttcaactataataaacctcaagcaaagtagagatgtaacctgaattttaaaagaaatccttttgatttttcaacttttgaaaagggaaatgaaataggctcgaccatatcatatcccaaaatgtctgttaaactcttacctttgctcaactagtttttcaatagttctagaattacaaattctggtcttgatttccctacatattttacattcaaacacccgttggacagaggtgagaaaacagcctttttttttttttttccttgggagggaatgctaatgttgactgaaagtctaggccttagttgcatccctcgaaatggagattaagatgtagacatgtttttgttgtagcaacaaaggaaaaaagtaatgaagcagataggagaactctctcactatgcaagttggtcatttatcttgccattagtttaaagaattttggggtatatacatgccaaacaaaatagagactaaaacttattttattttattttattttgatttactattaactctattaatttgttaatttgaaatgatccacaaataaccagtgcaaagtaaccaatacggatataacacagaaattaagagaagatttgcaaaaagattaaatatttttcagtctttgttcttacaggcaaagacaaaaaagatagctaatttccttacattgccgttttcctgaagaaggtgaaaagtggatccaataagtgactatttctccacaggtaatgccccctctttctttgtgacccaattttaggatctctctggctcaggtttttagtcctcacgggtggcaggaattacagtcggtttaggcaactgtgtctcttcccagagccagcacctgctgggtacatgagttcagctttcctatccatctgcataactaaggaggaaacagcccatgctgaagtaatgaagtatcatccttcctcccactccttcctaggctgctattatcccatctctttgcccctgaaatgaacctctaaaaaacctgttcacttcatttgttctctctgcaaagcattttatggacctcagtctctattttcagttactaaaaagaccaagcagccggactatggcctggagacatttgtgaacgaagtggaatccgctctggcccagcaagtcaagcacttctcagccctgacagatgtcatcaaggccttgagccctgccatgcagctgaaagagcaggttagcagacaaataagcaacaagaaacatccccagtgacaactgcaaataaagatctgcttgatttgacacccagcctcttcctccaccctccccagagaactttgggcaactggtggacctaggcagggtctgagctgagacaggctctggtaaatgtcaatatgagggcatctggggccagagcagctggggatggggatcagagtgacatgggacactactttccttttcctcagttgtcgccctcaagggaggaaggagctcttagtaacccttatatgttgccctgctttccataagaagggaatgctgtctggtgtagagttttctgtcagtagtgtcctgcctgtgtgtcctggctctggcggggagccaggacaaccccagggaacacagctctctgctggctctaaaccttccatacctttggttcgagcactgatatgtcttatattttaaaaaatgtttctgggacctctttcttctttgctgccttcctagggatgcacgaggatccctactgttttctgttttaaatgtttatacattgtatgtaacaataaagaaagagaaaaaaaattacatagcatgagttcattgtttccttattcagtttaaattaccaaatgtttatgactaaggacaaaaaagagcctcaaagtgacttaacacaaaacaaacaccccccacccaccatgatggttaatactgagtgtcaacttgatcaaattaaaggttgcaatgttcctgggtgtgtgtgtaagcctgttgccaaaggaaattaacatttgagtcagtggactgggaaaggcagacccatccttaatctgggtggataccatctaatcagctgcctgtgcagccagaaaaaaggcaggcagaaaaaaaaaaaaaaaaaacaaaaaaaaaaaacgtgaaaagactagactcgcttagcctcccagcctacatctttctcctgtgctggatgctttctgcccttgaatgtcagactccaggttcttcagctttgggactcagactggcttcctcgctcctcagcttgcaaatggcctattgtgggatgttgtgattgtgtgagttaatactccttaataaactcccctttacatatacaacagtcttactagttctgtccttctagagaaccctgactaatacacccccaccaaaacaaaaaacaaaacaaaacaaaacaaaaaactaaaaaaaaaaaaccctcttaaatcattcttactcttttccgaaaaatgagtatttccctcctattctatctgtgtgcaattgcacatttaaaaaaaattctaggagtatcaaaaataaaagtttactttcatttcatggccctcacaaaatcaggaaattgattcactcaagcaataaaaagtttattgagcacctacactggtaaaacaaacagctaaaaatcactgccttcatgaagtctgtagaattttttgtcttcctgctttctattccctataggttttgtctttataaagcatgtctctacttagattattaatttgccaaaaatatttaatagcttttaagttttatttaataaaaacaaagtctagaatctctaccatgtaccttaagcatcctcatgttcccaaaacactccttgtacattaccacttcatgacactccactccagacattcttctcttccacagtctctaatacagaaagattattaacaagttcaaattcttcatgataccaacttaaatgtgttctatttagatctggtttatttcatctgcgacttccctggaattgtgtttattacttatcttatggaatttatatcattcagttctacaacatagctgtttatatccttatgttcctaatatgttataaacttttgaaggcagtcgaaacgttttgttctacgtcacaaccattcttctccatttcggcctctaatggagaatacagatagttctcagtaaatggtgaatgaattactactccattattgcaatgtaatatttgcattattctttaggtttgctctgctactctgtatcttatatggttgttagatactgagattaatataaatatgatcaaagagaggaatatatggtagtagtggaattaaatatcaagttcacctgaaaaatatgaagctaaattttcctaacgagacactatccacatcctaggaatgaggttgcaacctatgaaaacaaaatgaacttcatcccacaaagatgtttcctggggcctgtctgctgaacacaggaaagtacagtgggggtttgggtagctcatatgtattcagctataatgtaattttcaagatatattattttaacattatttctggcaaatctcaagggactgtatcattggtttctctggaaaacagcaggaaggcaatttaatgaaattaaataaattaaattaaataatgaatattgcaagtgtatctgccatcttttgccaatactgattagtctacttttactagtacttgcattgccttcataagtaaggaatggggatattttaaataacaattcttatggtcaagttatgctttggaaatttcagagttgacaagaaaatattgattttcaggtattatttggtcaggctcctgctttacttcagtgtgactctgtggagtgaaagcgacaccctgcagaggttggctcaagtgtctgatttacactcagaaaatgggaatgagtttagtcaccaaaaaaattttgatttagtgatttcttccattcatggcgtcttaggcattcaatcatttgatttcattttataccaaatctcagagcattcattactgctctaagaagaagacacccagagtctggggttgatctgttaattctccatttggtccctcttgagctggaggtttggcaattgtagctgcagaacatggtacaaagttgcattaagagcttagagaatatctcaaatcattttaagcaatatggtactctgtgtagccatgaacattgcaaaaataatagcaatgacaatgaatatcacaactgtatctgccatcttttgccaatactgatcagtcttaattcatgtgatatgtgtttcctcctatcaacccaattctcccattcctttgtttaatttatgtttcagttctttcaggttgatctttctggaaaaactcattaatctctccaaatatccattcacccttcctgccagtatttgccaagcacctaccatatacattttgctatggattaaatgtttatgttcccccaaaattcatacaaaaaaccctgatcctgaatttatgttatttggtggtaaggcctttgagaagtacattagaccattctttcattgctataaagaagtacctcagactggataatttataaagaaaggaggtttaattggcttatcgttctgcaggctgtaaaggaagcatgatgctggcttctgctcagcttctggggaggcctcaggaaacttaaatcatccagaaggtgaaggaagatcagacactttacatggctagagcgggagcaagagagagcaaggagccacacacttttaaacagccagatctcatgagaagtcactcacgactgtgaggacagttctaagagcatggtgctaaaccattcatgataaacccactcccatattccaatcacctctcaccaggccccacctccaatactggggattacaattcaacatgagatttgggtgaggacaagatctaaactatatcaagaagtaattaggtcatgggagtggggctctcgtaagaggattagtgcacttatgaaaagagacataagagagatgatctctctctccaccagatgaggattcagcaagaaggcatgcatctacaaattgggaagaagacctgcaccaggaaccaaatcagcctaaggatcaataggccagattgcctctgcccaaagccttcatggtgggggctcttggagctataggagaatgacccctgtcaagtagagccctgggaatgtgaccctcacctagaaaatctatagagacaggataactgccccagtgggtgcagaaagtgggagttctgccccactgggtttgggagacaggatttccactctagtgggtctggatggcagggccaccacttctagtgagtctggaaaacaaatcattgagctaaagcaggctattcttaagccttatatctcatgaagtttacatgctagatcttggcttgcttgggaactgtcacccctttctttcccatttctcacttttggaatgaaaatgtctatcctatgtctgtcctgccattgtattttggaagcacataacttgtctgttttcatgggctcatagctggagggaaattttgcctcaggatgaattaaaccttcagtcacacccgtaactgacttagatgatatttaaatgaaattttggactttagactttagtgttgatgttggaacacatcaagacttggttattgggattaaatgaatgtattttgcaagtgaaaaggacatgaattgtgggaggtcagaggccagatcttatgtacacaatatttgtgttcccccaaaattcagatgttgaagccctgactcccagtgtgatagaggccatgaagtcatgtgggtggcactcccatgacagaatttgtgctcttaaaagaagacacaagagaggttatctctctctctccactatgtgaggatacatcgagaagataagacgacatccatctgcaacccgggaagagggccctcaccaggaaccaaaatggctagcaacttgatcttggactttccagcctctgaaactgtgagaaataaatgttttttattcaaaccacccagtctatggcatttgtaaaatcagtccaaactgactaagacatgttgcttcttaagccaggatctatggaggatcaaaaaaatgtaatacagaatatttttcttgaggaaagtagaatgtagtttaatataaacataaaataacagaggtgaagatagtacatcaatctaggaaactgcagttacttgtttttttcaggaagatttttatttggatagctaatgattcagctgtcattggttttttttttttccaaaggcagccggagaaaaaatttccactaaaatttttataactatatcagcctctttgttaataaagaattttaattttaactaatgctgattatgttgaatataaaaatgtctttcagtatggtatttttaaaaataatctcatctatactgaaaatggaaccttatttatagagtccctttaaatgctattgttgttctctcaggctctctaatagggccctaataaccttcagcagcatctccaaagggtcaaatctttcccaggttctctgtgtcagtgtggctgaagatcagcctgcaattgcagagctctgttgcctttctgagtgtctttctgccctgaaattgtgtagcatgcttgagtttttcatttacctaattggtacttaggtcttatgtattgaattgtcctcccttagtcagataattgaagtagtagactgcactctttgctcctcttcattcaagcatcacctctatacagggaattgcttataaaataactcaatgttttctgtcaagaattggaaatatgatctgtcttgtagttactagccctcccttctggttaattttgcaattctctcccactcatggcttagatgacccgaggattaattatttaaaaagtgctgacagtgtatttttatatctgggaagacagagttgtcaattaagcttaagcagatgacatttgaccttatttagtattatttattttttagcctcagactacacgaagtttaggagaatgaacttgatagctgtaaagctcagggtccaaatctttactctgctctgcagccataatttatcctttgtaaaggaagggtgataataatatgtttatgacaaataacatatatatatatatatataaagtgcttggtaaatggagcacatagcaagtactctgtaaataataataataataataataataataataataagccaggcaggtttaaaaacaacatatccatgtcataatatatccatatttacatctgtctatatccacatatacctatatatccatatccatatatctttgagggatcaaggttgactttcatggagccaataaaaagcccgttagaataactggcctagtatcgtgtctactcagttcccttttaagatctttgatcttctagttagtaaagaaagtcattttctgataggcccagtaatgaggaccttgagaagggtgaaattcacctaatgcatacaggtatgtagacaccatctgagaacaagtcaaattcttggcttagcttcctagtttgagaggttttcacaagttcaatcttagttttttaagaaaaaatttcatcaatgccaactttaaaataacctatattaaaaatcattattcttactgcactttatgcaaataatcatcccaagttaatgaactaaatttactttacaaagaaatagttttatcataaatacctttggtggaaatgggggaatgaaacagagaaaaattatgtggcagaagaaaactatactgcacttattagattctaggcattgtttttgagtgttattattatttgaactgaattctgaactttctgttttttccattatatgactgtgactctctggactaaggtttataagctttatcttatccttcttccttgaaatcattaaaattaaaacttctctctttttttgaggtcctacaaactgaagttaaacaatttgatataaacttcaaataaatcaccacaatggcttatgtataattaacctttgtgcctactgctgtatcgactattcacaacatttatctgatgcaaactataaaccaggaaaagctgtgagatttccactgtctactctttttccatctatacatgcttccagtgcaacgtctaaaaatcttggctggctgctctctggactaaaacaaacaaacaaacaaacaaaaaccctgagttttatagtttgttctaaacataaagctttgttttcttctttcaggagaaattcctcttattaaatatttgattgctcacactatatagagccctgactttggtgggtgatctacaacatcactgcctgagtgagacacatctgtaaccaatttaactggactaacctattcttgagactgagagactgattcagtggcttatgagacaatctaccaccccagtttctggactgtaaaaattttgggaaagtttcagaccagggaatgatgggcctcagaaaacaataactcaaagtgaaggcttaaaaagcagcccctcagaagcaaagtctctctcaccattgcagtgagccgagattgtgccactgccctctagcctgggcgacagagcaagactatgtcaaaaaccaaacaaacaaacaaacagaaatcataacctgtttttcccaaagccaaccataaagcctaaaaatattactctaatcttgcatcctgcctttctgtgtaacagctggccataaagtaattaagatgttcattccaaaggggtcctactctagatctaggaggaggaaatgctctaaagagaggccaagaacactctaaacagaccttgctgagtttcccccctcagtctggttgcattagatcattccctttctacatgcctgtccatatttcattgaacctacgcataaaaatggatagttttcccttatctttggatcttcattctgaaggctcctgtgtcatataaaagtatgttcatacaaatatgttatgcttttcttgctaacctgtctttgtcacacaggtgttggccatgacccttatgatgaggaggaaagaaaacactcttttctgctcctgtagagccatgtgtcaggctttatataaatgtttaattaatgaataaataaaataattaaatctgttgtttaaggctgcaagaggcaagagttcaagattacctagaggaaattgtgagatttctaacacgggatagcaaacttagataggtgtttcagcaaatctgaaatactctttagtctaagattatctggttataactgacagctatgaaaaatccttaaaaatcacatttttgagtgaaataaagtgccaattatcttcaactgctcattatgtaagtccttaagtgactatcatttgagaaatcttctttttttttttcttgttaattctccctggaaattagcttccagcatcacagctaaatccattttcctcaatgcatcttcttttttttctgccacttctgtcaaaatactcacacaatgtctccttacttgaaaagaatatttataaatatgtatacgtatacacacacatacacacacatgtacacacacacacgcgtacacacacacacgcacacacacacacacacacacagatttctaaagtttccaaaaagaaatgtatgaatgttttctacagttccagttcccttttaattgcatggcaaattccctctctcaaatgcctttcaggcagcctggatattagccatcaaaaatggaatattggctgtctcaattatgtaaaaagcttatctgattctaagggtcactgaagttttcagtcctcttccaaaaataaaggatatagctagtgtaaatgattcagttgcattactggctttcaaataacaattaaattgagtgtaggagggaggctatcttacttatgactatttcctctagtgaatagtaaaatacatcagctttttatcatataaaggggcaattgacttagtgacaaatagacacactggaaaagagctattctgaagtcaggcatataaatctcattaataaaaaaaaagaaaaaaaggatgaagtatttcctttatagatatttactagacaggatcagatatcatagatatgcagaacagtcaatcttcttccattaaatccatctcagtacagcacaggatcaatattaaaacataaaaataaatgtagaaatcacttagtctttcttctgagtgaaaatagccatgtggtgaaaacttcttacatctttttttttttttttcagacagagtcttgctctgtcacccaggctggagcgcagtggcatgacctcagttcaatgcagcttccacctcctgggtttgagcgattctcctgcctcagcctctcaagtagttgggactacaggcatgggccacaacaccctgctaatttctgtactttttgtagagatggggtttcaccatgttggccagtctggtctcaaactcctgacctcaaatgatccacctgcctcagcctcccaaactgctaggactataggcatgagccactgcgcccagtccgttttcatataataatagaaacaatcgaagagaccaggtagaatgggtggatttctcatttttataataatcttgaattcttttccacccataccccatccttcaccttttttttttttaacatttatatttgattagagttagagggatctggcttccaaagttttagggaaaaaaatagagttagaaaaattaaaactaattcctatcatccaggttctttcaaatccaattgtattggacagaataagtctaccaatatattttttacatttgctgaagccttctgattttgtaaatactttcatgttgattattctgttattaaaacaattcagttgaacaagtgtaactttcctcatttagatatgagaagaccaaatcccaaagacattaaatactctgctcaacagtacaaggtaaaatagaagaactttgagagaaaataattattttgacacacaatctagtgttctttccattttccctactttaccgtacatactggctgacagtatatgattagcttcctaagtaaagtcctctacaaactcagtgttacaaagtttcttgataattaataatgttagtacacaatgtagttccccatgcctaaatttgaagttcatttctgatgaaacatacaaataggtctgcatgaattcactgagtatatatatgtatacatatcttcacttttgttcttttaatttaaaggtagactgctatattttcttaggttttaaacaaacgtcagtttccaaataaagggagaatagtgatgacatattgagaccttattaatgacctatgatacctgtatcctgaagaaaacatataaaaagttcagaggttatgccctttggtttgcatatttacttataatatttcagtgggcttattagattttagttagctaatgccaatgaaatttatttctgccttttaaaaaattgtattataattattggaaaaaatttacctaaggactattcggtgctcacatgatgacataatttaaaataaatgaaattaaataaatttcactttggcatgaaaaaatggacagtgtttctgaagctctaatgcatagaaggactgtggtctataaaggactgtaatatgtttcttatgattcacacaggaggaacaaaaaaaaattagagacttatcaaagaaaattatctgaagaaaatagtcaaaacatttccacaaggagaatgaagtcaaactatgaaatagggctcttcataaatcaaataagatcatagtatttttgtttttctggaaatcattgagaacttgttaacttaaaataagaatgatgctttcaatattctttgatgctttctatcaaaacacacttacatcaacaaaactaacaaaaaataatgtttataatcacagcatcttgaatggaatgttctgatgcaatatggaagaggatgtttaactaagaaaacactttttcctgttatcactattactgaggtatcacaatttttcacagaatcaccatttagttagtgtaatcttgaataaaacacaagatagaatattatctccatgtaaaaatactcaaaatttatataggcaaactattcaacaatggtgtctcttaatattttcacttaacttacctaaacctcagttgttatttttcgtgagtaaaatgaacataataatatcagtacatctttgtgtgttattacaagaatatgtagtatagcatatctgcagcacttatatcatatttgctatgataatcatacttaggaaaggatagttattaattttattaattttgagctcgtgtccctgacatcctatttttgacagctgcttgggccctttcatttgcttgtgtgtttttcttcactgtacttggcctgactccccatctcgcagaagctactctcgtcttaggtaagaacaaccagctcttgctccatttcatggaacttgatcagatagttccaatgtcactttttcattatttgaagaacaattcctgttcaatatttagaagaggcaattagttgtgttggatattttctcctccagcattttaaagctgtattattttgttgtcagaccactgtaaagtaccaaaaaatgcttatttttaacatttaatgattaatacagaagcagtcactatagccctgtcaacagtttaatgtccctatttacagacacatataaaaatgcctcacaaagctacaaaaatcaatctctcctgatgaaatggtttgctcctttcttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcccgccaccgcgcccggctaattttttgtatttttagtagagacggggtttcaccttgttaaccaggatggtctcgatctcctgacttcatgatccacccgcctcggcctcccaaagtgctgggattacaggcgtgagccaccgcgcccggccctgctcctttcttttggacgataagccactgtgttatattctctttgccctatatgagcaaaggtcagattttagatttttactgagctgctactgatttccccagaaagtatatatgtattagtctgttttcatcctgctggtaaagacatacccgagacatataaagaaaagaggtttaattgactcactgttccacatggctggggaggcctcacaatcatggcagaagggaaggaggagcaagtcacatcttacatggcagggaagagagaacttatgcaggggaactcctctttataaaaccatcagctctcatgagacatattcactatcgagaacagcatgggaaaaacccacccccatgattcaattacctcccactgggtccctcccataacatgtgggaatggtaggaggtacaattcaagatgagatttgggtggggacacagccaaaccatcttattgtgtattacttaatcatttatatttttaagaagcttttttattttttattttaccccaaagttttctttaaatggtttcatcaaatctccatgtttctgtgtgtggacatgtatataaattgatttatatgtattttaggacaatataatgggaaaaaatgttatatattccatctatagaacttagtttatgactagatttacagaattgaaggactttggagtgcaaaataccttagtgatgatcttatacaggtgtactttcattttaggggtgagaatatagtaaaatatttggtatgaatctatcattctttgttttgttttttttttgttctttctttagcctgtatcccttttttagcctgatattacacagagtaatatccaatatgactgagtaattcagtagtttcagtttttatctccccttcaataagagatgaactcttagctaagatcagtaatgagcatcccaagatctgttattttaatctgcaatttcatatttatttatacagtttacttatttcacctctaaagcatagagatagtgcttattatagtttagatttcagtataatttgagcacttcaagaaaagtatttgactcatagaacagtgaatgatcaacatttaacacaatgaatccctgttaagggcatttaagaggctctgttgaggatgtctctgaaaaccaatactattaaatcacacatttccccattgtttgacttcccaaatcccaaacagagaccttactgattttatttgacaactttttttctcccactgtttgtttcttgtgctttctctacccattggatgttagtcaaacagtgacttttaccttactacccaggagctattcagcccagagctgcttctgtggctgtcaatcaatggaagcccacaggcctcccaggcaaatgtgctaactccaagctacctttccaaaaaaaaaaaagcctgtctcataagtgcctattgggctcagagcagcatttttcctgaagggaaggccagaagacacattttctccatcaatagaaaaatgcagtcaaggatatactctttcagaattccatttaaaattattattgacatatatgtggaggacattatgtgaatggaaaatttatcgtcatatgagaatatgaaattttaaagtcatagaatttgctggaaatgtagtggtcatctgggtcattggttaactggattggcaaaattgaaaacatgttgatatatttaaataattagttgaagaaaaaatgtagaaacatttctctataggaattatacaatacgctggagtagtaaccacgaaataaagtattgcccttctaagatgcaatagaagtccatattcagtgtaatactgagaaggaaacaagttctttaaataagagatggggtccttttataatttctgtaaggggtcactaagctttttttgtaaaatacttggtagaaaacattttcttacttgcaggccataggttctctgttacaactactcaactctgctcttgccacgtgaaagaagtcatagataatacataaacaaatgggtgtgattatgttctaatacaactttatatacaaaaataggtagggaaagggatttttcccacatgtagtttgttgactcctgatctagaggaaacacacaattttggttttactggccagctagctatgcaaacaaacagataaagattaatatctgatgtaagattatcaactattcatttttgcatagggctgtttttattctaagtgtatgctatgttttcctcttttgcatgaacctatctttggtttatgaaataatggtgagagcagatggcaaaattttgtttaatatatttcttggtcaaataaagaccttctccacattagaaggaaatatctccccggtctataaatcaaatactatggaatcaatcattcatgtaccctctcactttcatagatgccagagttcacttaggcagcattcctgataagagattattcagtctttattactatttccaggaacaggagattcgctacttaacatggtttcagttctatgttatactagctctctatattggaaattcctccagaaaatcttagtcattttgatgtgaaaattattctacaatagtaagcccatgagctggagattctaattctactttttagcaagtccatgtagctagtaatttatattctatatcttcctttagtaatggttaatagcttcggctttggggtctatcagaattgagtgtgaattacgactcagatactagttgtagtccttgggaaaatgatgaaatactaagagtcccaggttctttcactcaaaaatgcaaacatactacctataatataggtattttttgaggtttaactaagaaaattaatatattgcctggcagacaatagtattcacacaaagatactgttgatatcatattgctaccaaggatagtgaaagaagagctcaaatcattatgtaaaattacctaaattattttgggttttatcattcattcaaatatattaggcacatactatatgtaagtataatgaggatcgaggtagaagtatattcagctcttacagatcttgcactctagcagagataaaaaatggtgttgactacacccacatgaatccttaaaagtggcagcagtcagtggtgtaatatatctcaggagtcttttgcccatgtctcaatacttaattcagaacagtaataatcatccttataattagtaattatatacctagatactactctttccatcatttgctatagggaatcactgataccaagactgtcttctgcctggggattgttaacaagatttctcccctgaattttctagtggttatacattcccttctttatattcggagaatgagctgtcattgtttctttaatagatccatatcacttttcatgggtagatttctaatttgtaatttgtaatttcctgattaactctgcgaatccaacatatgctctgtaacatttcagaatggtgatgggagcagttggcaatatgtgacggctggagagcagaagaacacctgggaagagaaatgctgactttttcgaagactgcacctcctgttacagaccacaaggaaaggaaaatgatggtgatttctttgagcaataaactgccaggtgacagtcccagtcagcagcagcagacacctggggtgatgaattgagcataaagcacacatgatttcaggataaagcaatggaacagaactaagagagagacagagggtactatcaaaaagaggagactcgaaggtttcctgaaagagctgccactgaggaactttgtgttcctcagaagtgacaggaaaggctccagtagcagagctgaggaagtggagtccaatgaccagcacacagtacccacctcagaggtgctgggctcctcatgctctctgtgttggtcaaacagagcgcctcactgaagacctctacatcgtgggtttacaaagaaaatataaacgagcagaggaaatcacttctacaattgctactatgtccgttttcctttaagatacattagcgtttcagtgttctgcaattgcttatggtccattattattatggtctttttaacataaatatttttggtgaaataaggaaaaatcccctcttaagttggggaggcagtttagatgaacaaaattagctatgtatcaattactgttgaagccaaatgatagatacatggtgttgccatactattctctctcttagaatagcatccctatctggaaccctaaacagcagtccagcaaatatcccacttttcttctctacctcaccacaaaactccccacccccacctgcattccctattcagctcattcaatctggctccagttcccagagattcactgaaagtgcttttatgaaggtcagaaaggatctccatgctgctaaatataatagacacttttccatatatcttattctatcttttgttatattttaactcattagatcactttctgattactaaacccctctcctctctgagtttcactcttctaggtcttcatctgtcacactggaaactctttctcagtctcttgctcttgtctttcaaatcttcagatactggccttgggctctctgctgtctgtctactctgcctgcttgggacagatttacattcatgattccaagtttcatttattgtcctgacctcttccttgagaaaaagcttcatatatccaattattcactgacattttcacttgagtgtctaacatgccttacaattaacatagcaaaacagaaattctgatttttctttcaaatatccttctcctctcctctattctaccccatctcattgaatggcatgcctattttccacattgatgaagccagaaaactaagaggcattccccatctccaatctatcagtctgttggttttacctgtatattatgggattccccgagtcctcttcacctccactgtcattaccctcaagtcaacctctcagctactactcttgtttcctaaatgatatccctcttctgcttcatgctttctctgcaactcgttctctacatagcactaaaaacatcttctaaaaattaaaattaaatcacatcatttacgtgctccaaaactttctatagcttccttttgcatttaggggaaaaatatactaaactctcaccatggcctgttatccttacttgatctgtccagccccaactaaccttctccaagcccaacttaagtcgctctcttcccctcctctcagtttgtcccatgcccactgacttcagtcttagaacagaacaacttttgtcttgccttcaagcattttaaatgctgttcccatcaattagcaacttcctgtccttaaacttcaaggctcagtttaaaagacaactctgcaaaaatgcctcattgttgtattgttaatgtgtaatttttttcactcttcatattatgtctcttctggcaagattttaaactccttgatggtggtagctataatttttcctcttattgctatatacttaaattctggcacaaagtctgacatagtaagtgttgaatagatgagttttgaagaaaacagatgtaaaataaatatttataatataacctttatgtaatgagttaaggatattttatttaagtaatctatttttgcaaaacatgttaagtttagattgaaatctttaagcctcaaatgtatttgtcatatgatgaaattgagtctcactgttttttaatacatgagagatatccaagaaaaagttacactagcaagaagacttattgatcactccaggcagcagaatctagtggaaataagttctggctgaaaagtgttggttctctcatttgttgcctgctgatcactttttagttagccattgttcctcttcacttctgtgtgaaaatctgaaaagtgtcatctaagacttttttgaaagggtaacattccttattgccttatatcacattttagtaaactaatctgtagggcaactgtatactgtggattaatatgttgaataaatagcactgctttcacaacttccccttaaatcaaatgcctcaaaaaaacaaaaaacaaaaacaaacaaaaaaaaaaaaccaaaaaaaaccacatcaggcctctactgagttaaacagcgagggttgagaagccattttatctctacagacatgtgttcaaaatccataattatttcttgtcatgtcacaaaaggaaaaatagaatatacttccatgaaatacccagttgtaatcaactccacagagaatcttgctctgagagttctttccttctcttcaactggttcttttgtactgtaattgaattgaatttgctcctgtctccattcctcacagacagcttctcatttgaggggtctgaagatgtattacactaatacatcgtcagaatgacaatgctatgatgatgcatgggtgtaatacatcttcagagcttcagcactgttcagaaacaatacggctggtactgaattacattcaaatcaaatgcaaaatgaaaataaaaaaaaaaaacctggctaacaggaaaggtgaaaaaaaccctcaaaaacaaaattgtttaataaattccataattctatatattttgagggcaagttctcaagactttagaatggctttaatttataaatttatgcaataatattctctataaatttctgaagattacactgaaacagagccttagacaaaaaatatacaatgaatctagttttttaagtcatgatctctcaggcaaaatttacatacagcatttatgtgcaataaatgttgcattttacctcttttgtcgaactgtcaaaattagcttttcaccatttcatgagatatttgtattatgctaggagacatttcatgggttttgactgtcttccctctggacaaaattccctttgagacattttatagggagtcaaagtgctgtcttctgatagagaatgctctccataaaatttttaaaactttaacaggccaaaattggaaggcataacaacctaagattagataatttgccaaaattaataataataagaagaaaaacttggcaccatcattaacagccctctggtcctagtatcctttacatctttttactttggctttgtttaggttaatagttatatggaagtctcagagagacttggttcctttattctaatgccaaccgcttaggaagctatagctgtgtgaaagactcttttcttttgttcttaattttgacagattttttttctatagcacagaatgaaaccagataaaacattctcttaaaaaatgtaacccttctctaatatattccatttcttgtcctcccctctcatcacccagagtttatgaaatctgaataagtaaaaattttgtgtctggaaatcattctggtgattgcccagtaaacattctcctcttatactgtttatatagaagaaacagaatacaaaataaaatttcaccagtttagaagggcaatcattaacttgcatttacctgattttatcacataagaacacagtattcatcacgatcttttattatctgtcctcaaacaacttctacgtaaaaaatgaagtatatggtaaattttaataataatagctaaaaagttaaagctcttaattttggatgagtttttttttaactctttgcctgtaatatctcttttgtgtaacaaccctgttacattgctgctattattatcatcttcatgttgtagataaagaaactgaagcatagggagcttaagaaatatactcaggctaacacatgcagtgactggcagaggaggaatctgaaaccaggtaacccaagtcctaaccatagtccttttaagctctatataatattgccttttcaatagaagtttaataatcataaaaatgatgtttattctgtaacttctttagaaaatgatctagtcatgtaggttatgagtataaataattattagttttattaatgtttaaaagattaatcagatacatttattagtcacattaagattttacagtattctaaaatatcttttcttgtaacaaatatttattgaatgcctactgtgtaattgtaattgcttaaaacatgtagtttcacttgcccgaatcttaaagagatagcatactaaaagtgagaatgattataattaaaagtttaacacagttttattgatatatagtccaagattattataatcattataattttctactagtgatgattattcctaattatggtcaagttaaccaagaaaaacataattttaaaatgagctgttgcacaattaatattccatagcaaaatattcattttgagtgaagaaaaaattgatatagtactctattacaccagaggtcaaaactcttctaataataatttactgcaagccaaccatgtgctcttctctataattgccaaggacacattgggtcttgatttttaaaaaatcgttattaagctattttctctttcttactcatatatatttcaataaggatccaagaacagcacaaaattccagtaggttttatctgtgtataaaattagccttgatgaatacaacttaacatttatgggtgagagcaatcaaattatacctccattgactatggggttcaaatgatcagcacaacttgtattcaaattaacatcatgctgtttttctcctgaatgtattgcatggttataatacttcacaagaatactagttactatgtgctaacctatgttagagcagtgcctgggctatactaagtgctgaataaataatacttaatgtaagtattagatggactcattgtatacattggtagtacctaatgttccttccggatacttatagtatccatctaatattatgaatggaatttccatctgtagaatcccacctcagcatgaattagcatgaaatttataaccaaagtaaaggttgcattttccaagattataacttttttttttttttttttttttttttttgagacatagtctcactttgtcgcccaggctggagtgcagtggcacgatctcggctcactgcaacctccgcttcccgggttcaagtgattctcctggctcagcctcccaagttgctagaattacaggcgcatgccgccatgcctggctaactttttgtatttttagtagacacaggacttcaccgtgttagccaggatggtcttgatctcctgatctcgcgatccactcgcctcggcctcccaaagtgctaagattacaggcgtgagccactgcgtccaggctttttttttttttttttttttttttttttttgagacggagtcccactctgtcgcccaggctggagtgcagcagcgccatctcggctcactgcaacctcctccttctgggttcatgcgatccttctgcctcggcctcccaagtagctgggattacaagcctgtgccaccatgtctggctactttttgtatttttagtagagacggggtttcggcatgtcaccctgactggtcttgaactcctggcctcaatgatctgcccacctcggcctcccaaattactgggattacaggcatgaaccaccgtggctggcccaagataataacttttaaacaaactcctaacttgtttagttataatcacttacatactactttccctatacatgtaacatgagatgaaaatcaataagggaaagactcttgaaaaaatcgaattcacaaaatgtggacagcctaatgttaagcattatctgctccccagattcagtgcaccaaggggaaacaacgtggcatgtcattttttaaatgcccctgctctctcagaaaataaaattccataagaaaaaaaatcttttatgaaatgtttggtgggttcctcctttttgtttttttatgggtaagcaccttcctcgaagtattgtggatttatttttatagtgattcatcatatcaagaggcccattgttctggcattatatgtgtcttaaaatactagaaattttctttctttattcaaatcacaggtattaacagctctgaatttaaaaattagcatagctcaccacttactggttagaagtagaggggactttggaaacagacaaatgaaagttaaaattataaagaaaactctcagaaaaaagagtcaattttaactgcatatataaattattggtgtgcagtcttatggtgaaagtttaacttgccatcattatgtagattcattcattatataattatccattatgtaaagccattttggaaattcacaaaagctccacatagaatgcaactctgcaatggaactagaaccatagtttgtaatctaaagatctggtattgttgaaatgtcatcagcataatttgccggttttactgaatttttttttctactaacatcaaagagcagagtgtagtgtcaggattgcaacctgaagcaaggttcataaagaattacagtgtttgggtgacaggctgtgtacatgtacacagtctgttcataacacacttggtgttggtccagctctcagcatttctaagaagtcttcctttgaataaagaggaaaggcaatggaattgagagcactaataagaaataacactttctggtttataactgtaatgacttaaactattttcgtaattaatttaaacaatagatcccagcagtgttcatagattttagctcataattttcatgttttactgtctcctagtttttcagataattaggaattaacgtttgctgtcttaagactctatttaagataattacagaagttttaatatgctaaatctatatatctcagctgggaaacaaaacttaagacctaaacctcttttaaaatatctgatgcaggagtcagcaaacattttttaaaggacctgatggtaagtaacttaggctttgctgtccatatagtctctgttgcaactattcacttctactgctgtagagttaaagcggccatagacaatatataaaggaatgagcatggtgatgttcagtaatctttacttacaaaaaagacagcaggacactttggcccataggctttaagttgctaatccatggtctacagactattttattttgtttactccgtttatcctgaagtaaatctcatggaacagtttcaacatctttaaaatctcctactttggaaactattttgtattcttgattgacagtttacaatattaaacttatagctgaggtatatccatagcaatacttgtgaaaaacatagaaaatactgcttctttatctttctgagtttctatactttaacccacatgatttccaaatattgctatgtggcccttttaaggctccctcaatgttaaataatgactgacatcttttattaaactcagtattctaacttaaccaaaatatccttcagaaataaagaaaaaattaaaacattctccgacaaggaagactaagagaatcagtcttcagttgaactgccataaaagaacggctataaaaaaattttctaaatagaaataaaacaataaaagaaggaaacttagggcatcaggtaggagtgagaaaaatggtaaaaatataaaagataggtaaatacaaaatactttccttctcttgagttttccaagtttgcttgacagttaaaaactatagtacattatcataataaaaatactttatcatgtatgcagagaaaatatttaagatgcatatattttaaatggggtaaaggaatgtaaagggcactaagttttctatactttgctggaactagtaaaggttggacatccttagactatgataagtaatgtgtttgtaaggcaacacatagagcaattacttaaaaagctgtgcagagatatattcaaaaactctggcaataagatagagttctaaaaaatgctcaggtaacccacaggaatgcaggaaaaagaaaatagagaaacaaaaatgagaggcaacaaacagaaaaagaaaaaagaaaaagtcagacttaagtcctaatgaatcaataattaaattacatgtaaatggtttaaatacatcaatcaaaatagagaggttggcaaagcagattaaagaatgcatatgttgtatcaactataggctgtctgcaagagactcacttaaaataggacaatatctttagcctgaaaaataaaaagatggaaaagaaacatgattgttcatagcagctttatttgttataaacaaaaactgaaagcaatcaaaatattctataatatttgaatggtttagaaaattgtgatgcattcatatcatgagatactattctgcaataaaaaagaatgaacttgatatatactataactgggaaagatctcaaggacactatgctgaatataaaaagctaatttcaaagattatgcactgtatggcagtacataacctttgtacacttacatgtaagtgtacactcaaaggacattctataaatgacaaaattacagaattggaaaatagaatgttaaataatgagtgacatcttttattgaactcagtattctattctaagccaaaacatcatttggcaataaaggagaaatcaaaacgttctctaatgaagaaaactaagtttgtcttcagttgacctgccataaaagaattgccagaaaaagttctgaacatagaaataaagcaataaaagaatgaaccttagaacaccaggaaggaagaacaaaaatgctaaaaataaaaagggggttaggcatggtgcatgggggaggaatgtatgtaactataaggaaataatacaagaaagatctttgtgctgagggaatagccctgtatcttgattttggttctggctacatgaatgaactcatgataaaatggtatagaaatatacacaaacattgcactaatgaccatttcctagtttgatgtcatatatgttatacaaacattgggtggggggtcctccttccacagttacatagtactttatgccaccgcttgtgtggaattaactccctgaacagtagtaactggctttatttgtctttggtctcaagggacaggggactccttgtgactagagaagatctgttcatcttcatgccccattgggaaaaactgggtgaagagtacatgaaaactctttgtactaactttggaacttcctgtgagtcagtaatcatttcaaagtagaaggtaaaacataatttatatttatttgggttaatttatgtaaacactctgagtatcatgttcatctgtacaatgagtttggttttgaggcttaaatgagataagtatgtgaaaatacctctccctcattgcctatggtatggaaggtaatgaaaaagttagttgaaccatgttggctaaaattgattggtgtgagctttatgttaatagggtgtagccatattaaagctataaggaaaataaagggctgatgcatatttaggagtgtgtgtgtgtgtgtgtgtgtgtgtctgtgtgtgtgtgtttacttaggggaatagggaagtgagaaaacatcaggaaaaaaaacacttgcttgtgtgaatacctcattatctccatcccaattttaatatctagttcctagaagccatgtaggaatcaaagacaaagaggagcattcattggttcagcaatctttacagattccctactttgtgccaagccttgtgctaagccatgtagtataaagaagaacagattatttccggacaaaaggactcccctggcccatgagaccaaaagcaaataaagtcaattattacaattcagaaagttaattccatacaagtggtgacatgaagtactatataactatggaagaagaaacacacaatttttcccgggaagttttggaatgattttttgaaaaattgaagaataaatagaaatttgtcaattgaataaaatgacaaagatattcctagtagaagaaacaacatatgtaaaggtagaaaagcaaatttctaacttgactagtaggatgcatagttattttaggtgagtgcaaaagtaattgtggtttttgcattgttggaagttgctgtttgatattggaatacattcttaaataaatgtggttatgttataaatcattttaatagacattctctctttactttttttgctaatgacttattacttgcagtttattttatgtttattttagactatggaaatgatgttagacaaaaagtaaatccgagtgattttcttattcaagttcaaaacgggtcataaagcagcagagacaactcgcaacatcaacaaggcatttggcccaggaactgctaacgaatgtacaatgcagtggtggttcaagaagttttgcaaaggagatgagagcattgaagatgaggagtgtagtggctggccatcagaagttgacaaggaccaattgagagcaatcataaaagctgatcctcttacaactacatgagaagttgctgaataattccacattgactattctatggtcactttgcatttgaagcaaattggaaaggtgaaaaagcttgataatgggtgcctcatgagctgatcgaaaatcagaaaaatagttgttttgaagtgtcatcttctctttttctacacaacaacaaaccatttcgcaatcggattgtgatgtgcgatgaaaagtggatttcatacaaaaaccagtgatgaccagctcagtggttggaccgagaagaagctccaaagcatttcccaaagccaaacttgcaccaaaaaaagggcatggtcaccggtggtcggctgccagtctgatccactacagctttctgaatcctggcaaaaccattacaactgagaagtatgctcagcaaatcaatgagatggactgaaaactgtgacacctgcacagttggtcaacagaacggcccaatccttccctatgacaatgcctgactgcacattgcccaaccaatgcttcaaaacttgaatgaattgggctacaaaattttgcctcatttgccatattcacctgacctcttgccaactgactaccactacttcaaacatctcaacaactttttgcagggaaaacacttccacaacaagcaggatgcagaaaaactttccaagagtttgttgaatctcaaagcaaggattttttttaatgctacagaataaacaagcttatttttcattggcaaaaatgtgttgattttaatggttccaattttgattaataaaggtgtgtttgagcctatttataatgatttaaaattcaggatctgaaaccacaattacttttgcaccaatctaatatgcctccacatctaagttcttcatttactccaatcttccatattctgtttctgtcccattatgacactgaattgcctcactgaccaccaaactacttaacccagaggtatctatatggtttgtatcttatttgacctgattgacattattcactattcctaaaaaggttttcatcttttgggtccttaaaatcatggcattctgattctatccctatgccttagatcacttgtttaaagtctcctttacaagtgatcaatgactgtttattaaacaaaagtgagcagtgtcaagtgattgatttaagaaataagagacctggccaggcgcggtggctcacgcctgtaatcccagcactttgggaggccgaggtgggcagatcatgaggtcaggagttcgagaccaacctgaccaacatggtgaaaccccgtctccactaaaaatacaaaaattagctgggcttggtggcatgcgcctgtaatcccagctactcgggaggctgaggcaggaaaatgcttgaacttgggaagtggaggttgcagtgagccaagatcgtgccactgcactccagcctgggcaagagagcaagactccgtctcaaaaaaaaaaaaaaaaaagaagagatctgagtctttctaaatgtgagcaggatagggtcagtagaaaggaaaaagttaaagatgtaagaaaaagataatatttaataaaataaggacctgacaaataggaagaaaaggaatctcaaacatgacaggagaaaaagaacataaattgagcattctttatcttgagttaggcaatagccttaatgcctatgataattaagttagtaatgccttatcaaaacattaagcatacggaaattagacaaaaaagtgtttgagacatatagcccagtgttgtgctcacatgtttagcttcagagccagtaacacctttatcaattaataaaaaccaccaggctaaaggatgaacatgtctggatattccaggtaccaaagaatagaaagaaatgaacttggaaatagacatcaaaataaatagccacaaataagtgaatatttttaaacggctttcaacatgcttctagatttttttatctccttgatatggttttgatctgcatccccactcaagtctcatgtggaattgtaatcctcaatgttggaggtggacctagcgggaggtaactggatcatggggggagttttcataaacagctgagcactatccctttagtgctgttcttgtgagagagttctcatgacatcttgttgtttaaaagagtggagaacctcccccttctctctcttgctcttgctttgtccttgtaacatgtgctggctttccctttgccttctgtcatgaccgtaagtatcctaaggcctctccagaagcagaagttgctacgcttcctgtacagcctgcagaacaaggaaccaattaaacttctttctttgtaaattatgcagtctcgggtatttctttatagcagtgcaagaatggactaatatagaaaattggtactgaggagtagggcattgctataaagatacctgaaaatgtagaattgcctttggaactgggtaaggggaagaggttggaagagtttggagggcccaaaagaagacaggaagatgagggaaaatttggaacttcatagagacttcttgaatggttgtgctgatagggatatggacaatgaaatccaggctgatggggtctcagatagaaatgaggaatgtattgggaactagagtaaaggtcacttttgctacactttagcaaagagcaaggctgtattgtgcccctgctctagggatctgtggaacttttaacttgagaatgatgatttagggtatttggcaaaagaaattttaaagcagccaggtgttcaagaagtagcctggctgcttctaacaatatatgctcctatgtgtgggcaaagaaatgacctggaactggaacttttatattttaaagggaagcacagcataaaagtttggaaaattttcagccttgctatgtggtaggtagaaaagtaaagcccatttcagaggagcaattcaagatggctgcagaaatctgcataattaaaaagaaggtaaaggctgatagaaaaatgaggaaaagatctcaaaggcatttcagagaagctcatggaagctcctcccatcacagacctggaggcctaccaaggaagaatgattttgtgggccaggcccagggccgagctgccttgtgcagcctcagaacatagctccctgcatcccagcaactccagctccagacatggctcaaaggggcccatataaagctcaggccactgcttcagaggctgcaagccataacctttggcagctttgatgtggtgttaagcctgtgggtgcacagagtacaagagctgaggcttggaagcctctgcttagatttcaaaggatgaatggaaaagcctggatatccaggcatccaggcagaagcccactacaggggtggaaccttcatgaataactctattggggcagtatggaaggcaaatgtggggtcagagccgccacacagagtccccactggggcattacttagtggagttgtgagaagagggccccagaatggtagatccactgacagcttgtaccctacacctggaaaagcagcaaccactcaacattagcccatgagagcagccatagggactgaaccctacaaagtcatgggacagagctgcccaaggccttgggaactcagcccttgcttcagtgtgccctgattgtgagacatggagtcaaaggagattattttgaagttttgagatttaatgactgcagtgctgggtttcagaaatgcatagggcctgtatccttccaattttttttgtttttggctgatttctcccttttggaatgggagtatttacgcaatgcctataccccattgtatcttgcaagtaactaacttctttttgattttacaggcacataggaagaagggacttgtcttgtctcagatgaaactttgaactttggacttttaacttaatgctgcaataaggttaagactctgggggactgttgagaagggattattgtattttaaaatgtgagtaggacatgagatttttaggaggtgtcagtgtgggaatgatatggtttggatctgtgtctttgctcaagtctcatgtgaattgtaatcccaatgttggaggtggagtgtagtgggaagtgattggatcaagtgggtgatttttcataaatggtttagcaccattgccctagtcctgctcttatgatagagttctcaggagatctggttgtttaaaagagtgtagaacctcccccgaccccctttctcctgctccagcattgtaagacatgcctacttccccttcactttccaccatgactataagtttcctgaggcctccccagaagcagaagctgttatgccttgcctcctgtacagcctacagaactgtgattaacatttttaacaataaaacttttttttttttacaaattacctagtttctggtattttatagcaatgggagaatggactaatacactcatctataattgaaatttttttcctttaattttttattttttcttactatttctaggcttattaatacaatcatatgtaatacaatttttattttttctttatttttaaaatcagaagcctcatgtatacttgtcgatattctccagaagtttacagtgatttttaccttcatggtaacctcatttgtgagcagctatgtgaattacattttcaagagtcataaagaggccccttaatttcaggaacagagttacaaattctatctggttaatatgacttggctgtgtcttcactcaaatctcatcataaactatagttcccataatccccatgtgttgttggaagggacctggtaggaggtaattgaatggtgagggtggttacctccatgctgtgctcatgatagtgagtgagttgtcaagaaatctgatggttttactagggggttttcccccattttgcttggcacttctctttgatgccaccacgtgaaggacagttttgcttccccttccaccatgattgtaagtttcctgaggcctccccagtcctgtggaaccatgagtccattaaacctctttcctttataaattacccagtcttgggtatgtctttattagcagcgtgagaataaactaataatctgttcaaaaatttaaacacatttcaaaagtatattaacagctaagaatatgaaatgtttataagtcataaactctgtccaatgttgcatactattccatttactgttcatataacaattctgtgaattgggtacaattgttactgccattttgtatttgaagtttaaggaagttaacaattttttctaagatgttacttttgataagaggaagatctggatctcaaactcgactgaaatcaaaatgcattatcttaatcactaggccctaccggcaccatctcataagtaaattcctggtagaaatgaaatcatacacttcacactaggaattttgaaaaaaccttgaaaaatttgaaacagataaagaaccagtcatagatgagcagaagcagtaggatcacatgtaaagatctatgagcctacttgtatctctagccataggacaactaccctctttattttccttgagataaatatttttcttactagttctggtgctctttgcatacacacagattacaggctccgttccaggcttcttgttagataaaaccacacaaaatattttttctatccctcaccctgaagttatttaaggtcttattgtggtttagaagaatatcacaggaagtagcctagacttctgagtctttgataattttactataaagcagttaagtaaagttacatttttaaagcaaaatgtaatgattctaactccaattgtatggtataaaatcaatcaaagttaaatgaaatggttgattccagaagtaaggcagaaaatatgagcctgttgtattttcttatgccagaaagcatagaagtaaacaaaatgatgggttcatgtcataaggacacaggagaccgatttggtgtgactcctaatggtcaaactgaagacaatttgaccaagaaaaacattaaagactttttaaaaatgtaaataaaaaccacaacgagataccatttcatgccagttagaatggcaatcattaaaaagtcaggaaacaacaaatgctggagaggatgtggaaaaataggagcacttttatactgttggtgggactgtaaattagttcaaccattgtggaagacagtgtggtaattccttaaggatctagaaccagaaataaccatttgacccagcaatctcattactgggtatatacccaaaggattataaatcattctactctaaagacacatgcacacgtatgtttattgtggcactattcacaatagcaaagacttggaaccaacccaaatgcccatcaatgatagactggataaagaaaatgtggcatatatacaccatggaatactatgcagccataaaaaagatgagttaatgtcctttgcagggacatggatgaagctggaaaccatcattctcagcaaactaacacaagaacagaaaaccaaacaccacatgttctcactcataagtgggagttgaacaacgagaacatggacacagggaggggagcatcacacactggggcctgtcagggggttcggggctagggtagagatagcattaggagaaatacttaatgtagatgatgggttgatgggtgcagcaaaccaccatggcatgtgtatacctatgtaacaaaactgcacgttctgcacacgtaccccagaacttaaagtatcataaaacaaaaatggaaggccgaggcacgtggatcacctgaggttgggagatggagaccagcctgaccaacatggagaaaccctctctctactaaaagtacaaaattagccaggcatggtggcgcatgcctgtaatcccagctacccggaggctgagacaggagaatcgtttgaacctgggaggtggaggttgtggtgagccgagattgtgccattgcactccagcctgggtaacaaaagcaagacttagtctcaaaaaaaaaaaaaaaaaaaaaaaggtgtgaatccacgagttcatgccataaaaataaacaaacaaataataaataggagaaaggggaattctacagtagaatgtcaagtgctaactagtaaaagcagaaggactgctgaatctagaaaaaaatcatcagtttgatcatcagagtgaaggctgagtgcaaaagaatcatcaataatgtcaaatctaagggcagagttgacaaagagcagatatttggatgtcacggtcttaaaatctctccctacagactgtttattggtagcatagggaagaaaaaggaataaactatatgatgtggaaatcagacaacacactgattgattgaaaataacatcacaaatgagggacacatgaatattatgtgactccggatccgattccctgagaaggatacaacttcacttacttccataaggacataactagaaatctcatgagaaaatatgagacaacccacaaaggagaaatattctatttaaaaaggggtcaatatggtgaaaccccatctctactcagaatacaaaaattagctgggtgtggtggcgcacgcttgcgatcccagctagttgggagactgaggtgggagcatcacttaaatccaggaggtggaggttgcaaggagccaagatcacaccactgcactctagtctaggcgacagagtgagacttcatctccaaaaaacaaggaggggtggggagtatatacattgttgaaaaaaaatgtcaatgttcagtaatgacactgagaaattaaattagaggagcctaaactgttatgtcaaatacatgcaatacagagttctggattggattctgtactagacaaaaaagtattctataaaaaaactattgtattagttgaccaaattggaatatggttgattaattgaataaacgtatgataccaatgttaaatttactgaaattaaaaattactgtggttatgtaaagaaaatgtctattcttcagaaattaacacggagatatctagagataaaaaacacctagagataacaaaggccaagatgtatgcaacttgctctcaactggttcagtgaaatatatatatgtatatacttagtctacccacagagaaattgatgaagcaaattgacaaaatcccaatgaatctaactgggtaaagcatacagaatattctctgttttatttctgtaaccttttaaaacataaatttgaatttaattctcaaatatagaatggaaaaaacagaaaaaagaaataatcattgataaggtgaactgtaaggaagctcacatatccagaaacatctcaggaaaggtgtttttttttggtgaaagtatagttgagttgcaagagttaaaaagtagaatggcaactgtagctggccccagtgatgtttgtgatgtggttgaacacacagcctcatttttctgtaaataagggtgaagctgtatggagctatcatcctgtgaccaaccacttattactgatttttaaaactggaattgaccatgagtgagtcagcaagaattaccatgggcattgctaaaaaccctaaatcaatcagacacatacaaaaactagccattacttctcgtgttgacatgaggtatatctacatctgtttttatttacttatttatttttataactgcttttaacactcaacatgttcacaggttaactgctgttttgggacacattttctttcataatatagcaaaagaggagctgagaacatgcaaaatattgatatttcttaggcaaaatacaaagagatcaatgaattcataattttgcttttaaatataaattaataagtcaaaaaagctaatagaattatcggacatgttccttaaagcaggaactccagcgttgtggggttttctttttcctttaggtgctgtgaatttgaatgtagatcattaataaattataatttgaaattattgtaagtgtttataaaaatctctgccaagtctagttattcattggataatagttaatatttatgctaattttactcatttgctcagtatggcagaatcagaaaaacaaatctatgcacagtttaacttataaacccaatctgtcttctttcagtttcatgatgttatccgttatcattattctaataacttcactaaccaacattcctatttaattaaactaaaatgtatccaagcacttttaaaaagaagaatgtgcataataacaagcactgcaaagcaggagagttaaattcataatattaatcttaaattatatgaagatagagattatgtgttttgctcttacaaaaattatattaccatatcagatttaaattcctggaaagatgattaagaatcagctttacatttacatattaagttttactttttaaaacacatttatgcctattatattttttgagtcccacaatagccaaggattattatcatgcaatttttgaaagtaggaaactagctggtggtaactacagctaagagatgtgcacaaggattggcagatttgatgaataaggaacttgtcttaagagcacatgtgtataactcctggttctgaatttgctgcacttataccccacggagagtcctgccatgaatttaagtgctcacatatcagttttatgatttttcagtggttctagagagtgaagagttggcagtcaagagcacactcatacttcagaaatattgtaggggacataatgcatattatataaatatatattgcagatatattgattttttctcacataataccaatactaagcatgtgatgtgggtaagattgattagacacactgcataaatgagtaaactgaaagtcgctgaagggtaatattaaagaaaacattagcagataaaatacatgtttcaattgtgcttgttctacacctgtataaaatatgcctttctgatttcattaaaagcagtttcattgcatcagccttgctcagggtattttcacaaaaaaaaaatatgaaacaaaatcaaatttcattcatctgaaatgaggtggggtcctatttattaaaagtacatctctgactcccagggtgcacccaaagctatgtagttcaaagttaaatttcacacaacttgataattctgttagcattgtgactttgaaaacagacctgttttgatgatgactaaggtcgacttcctgaaattgacttataatctctttgggaggatgtgcactatagcagaagtactggaaatctataaacatgttatatatttcatttctactagctatgcaatcctgcacaagctacataaactcttggatttttagatccctcatcagttaaaatttaattctaactccaaagtctttgattgaaagctgcagtttgaaatcagacccagcaaactcataatttgattaactttattctcccctgattactttagcggttcatgctgacctatcaacgtgtgaatgctgatcaaataaatctcttacatatttaaatgaagacatttctcttgtgacatttccatttgagccttttgtctattgattggtgattatccagcatacgaaagagaaaataaccttgactaagaatcaacagacataggttctattctggactctgagtgaaaagtattctttaacttttttttttttttttttgagacagggtcttgctccgcacccaggctggagtgcactggtgcgatctcggctcactgcaacctctgcctcctgggttcaaatgattctcctgcctcagcctcccgagtagttgggattacaggcatgcaccaccacacccttctaatttttgtatttttactggagatggggtttcaccatgacagccaggcaggacttgagctcctgacctcaagtgagctgcctgcctcgacctcccaaagtgctgggattacaggcgtgagccactgcgcccagcccatttaacttttatgaactgcaatgcctttaagtatgaagagtaagtataaaaatatgcattttggccaggcgcgatggctcatgcctgtaatcccagcactctgggaggccaagttgagcagatgacttgaggccaagattccgaggccaacctggccaacatggtaaaccccttctctactaaaaatacaaaaaaagtagccagatgtggtggtgcaatcctgtaatcccagctactcaggaggctgaggcaggagaatcgcttgaacctgggaggcggaggttgcagtgagaccggttcgcgccactgagctgcagcctgggggacagagtaagactctgtctcaaaaataaataaataaataaataaataaataaataaataaataaataaatgcattctgcctaccgcatgaataaaatacaaaaaattaagttgactcttaagttctgaacaagtgaggttagtgaggttacaggagaaaaatgaacagcacaaacaacactaatgcattcctactttacctgatggggagatgtgtcgccaagaaatggaaggctctggtttcccagtggccaaacaagtaagagtgacgttggttccttcattgacggtcatatcatttgagatgtcatatatcttaggaggaactgaaatgacaaaatacgcagtgattagaaaaaaatatataaagttttgttgaagtacgtatgattaattccataatatcatgcaagaaaggtatgagggtgaaatgtatatatggcctatgggcctcacctgaaagatggattctctagaacctcaagactttctaggagttttttattagttttttttcccctaatttttggatgttaaatacctcaggataaatggaatatttaataacaaaaatgtttaaacattgattaaatatgtattatgagtaatttgtgttaagtaaactagaatataatcaatctattttatccatggatcctcactgtatgatgttttccttgttgaaatggttaaaaaagaggaaatacagaagaaacttaaaatagcagaatggttattcctacatactgatttaaaagctgggtgagttaggacatgtacatgattgggaggtaagatttcatggtcacaaaggtatttttgactttaattttctatctgccaggtagtagggctagactttctcaaaatttgtgttctaaggaacacaaattctaaggactatgaaaggtggatacaataaagttttcttatcaataatgactggcaaacactggttgaaacagatcacttcaggacttctcatcctttgttatgcccttttgcactgtaaatccataagagtcaagggggatatattgtattgcattttctctgatgtattagactagagaagtttttatcccagaatttaatcacataatacattcgggaaatgttggagagaaaagtctctaaactaacttccaggattaaatttctatattctttgagaaaccaaatgtctcattgaatcctcaaagagcatgggtataaatctctattggctaactgcattatttagagtaagttatttaatttatctcagcctcagtgtctttatctgagagcaggagacaataatagtacatgtcctatctggctgctatggagactaagtaagtcactacatgttaaaggacttagaaaagtgcctgacattagtgttagtcattattattagatgctattaaacacatatatggtgtttgaatttcattttagtagtgctcttttcctatgccttaaaattgttctcagaaattcttcacttttgtagagggtatgactgacctatgccataaataagtttgggttactttataaaatttatactatgttactattacagcacaaatataaataaatagcaattacaccccttggtaatcattagaaaaataagatttttactgaaatctttttaattgttcccttctttgggtttctttatgcaagagacatgttttcacgattacctttaaagctagtaactaaaatctgttgtgacgataaattacccatactttgaattttttttgacaaccaaaactcagcctcaagaaaatcaagaatgatataattacaaatataaagtatttgattatgtgtaactgttgatatgattgaggagaaggctttttcctaagtaatacaccactgtaactgtttccaaatgacatagtttaattggcatttaaaacacattatcatcaaactcttcagtgagcttttctcaggcaaataataaaaattttaaaaccatcccaaacagaggggtcttttcagcttaactaaaacagaacaaaaataaaaacattaaattaccctagaaggaaagtacaaaaaactttgcattacactggtaaataggagagttaataataataaatttacaacattaaactaaaagtatattttagatatttagttgtaggtataggtttaattcaatgaactgtaaagcacatgtggatatatatacatatatatatatagagagagagacagatatacatatatagatggtcactgacttacaatggttcaattataatgtttttactttataatggtgtgaaaataatatccattcagtagaaagcacattttgagtacccatacaacaattatgttttcattttcagtatagtatttgataatctacatgaaatattcgacattttattataaaacaggccttttgtcacattattctgaccaactgtggttaagtgtctgagcacgtttaatgaaggctaggttaagttatgatgttcgatagtttaagtgtattaattgcattttcaatttacaatgggtttatttggatgtaaccttatcataacatgaggagcatctgtattcataaacatacatacagtgcatagcagtgcccactattaaaaaaattatatagtgcttttttcctttatatagaagatagtatatagggctcttagtctcgcctagcgactttacttaattatttaaaatataactgattcaaggttagacagagatatgtatatgaagagaaataatgaaatgccataagaacatgaattccatcctcgaaataccattatttggtcaatactgtctgatcaaaaaatagtttagttggatctttacacatctacatatatttaaagtgctaaacattatgctaaactaatattcagcactagtatttggctatatagagaaacaattaagtcccttagaaataaacttagatttgacatttacctataggagattgtgtagtgtggggagagtggtaaattccaggtgtgacatgtcattctcagtgattgcaattgccttccagggcctcataattcaggacatgctacagggaatacacatctgggaagaggatgttagtaagagaaaatccctctgacaaggctcctctccccagaaatgcatcacttgttggaagcagatgccatgtgtaagagggccagtgaaatccttacatgcacggtggcttgtggagacaaaaacaggtgttgctttgctgaatattcagaactattgcatattcagtttaagccttccaacttttactgactatcatgaagggaataattcttgacccaaaggaaatgcaaaagtttaaaggcatgttacttgccctcaagaaatttaaattaaaagacagaagcggataggtaagtaactaagagagggcaaatattttccacattttcctttcccattttacaggagtaaaacaagttcaataggtaaaacttctgggtttaaatcagtagacattaattttgtgttggtttatttttaagttaattatgtagaatagtttacgcacaaggttattgagtgcagactatttataatagataaaaactttttttttttctttttttgacagagtctctcgctctgtctcccaggctggagtgcaatggctcaatctccgctcactgcaactcctgcctctcgggttgaagtgattctcctgcctcagcctccggagtagctgggattacaggcgcctgccactgcgcccagctaattttcatattttttaatagagatggggttttgccacattggccaggctgctctcgaactcctgacttcaggtgatctacctgcctctgcctcccaaagtgctgggtttacaggagtgagccaccacaccaggccaggaaaactattaataaccttaaggtaggactgcacaaatggtggtatagagaattggtcaactggatggtgataacaattgtcagctctgtcgtcagaataaggtgtggtatagagaagggttttggatggtcccagggcgcatcgtgctaagcacttgcataggaaaaccaaaaaaaaaaaaaaaaaaaaaaaaaaaaaaagaaaaaaaatagaggagagttaaaaataatgtactattctagatgtgtgccccttttctagatcttatttcagactccctcacatccttttctaaatacttaatttatgcaaaaaggagcagatgtatttaatcaattcaacaatttttaagccattaaataactacagattttaagaagtattttaaattgtcatgtactttaagtacttatgacctagggcagagttataaagaaatatattgatgagtgtaaactcatttaatatgctggaaacaattattataatatcctcactatcttcattatatgataccataaaaagacaatgaaaaggcagaagtcctagatttcatactaaatcacagaatatctcctagtgaaactctaattagggatatacaagactttacaactgtgttcataattaattgttgtgtattaccagttagagagatctaagaacactggaagctttctaagcaacagaggttgaaagtagatttaaagattgtgttgggtgaaatgtattttaaaacctccatatccatttaaatgaactactcttggtcccttgcattcataacatgctttccctttaattgttcactggcctaaaattcaactgctacttagtacctggtcttcaacttttatttagttggttccacagtgaggagataatgcgtatttagatgtatctacatatttagattctctaaagataacatatgtctcttgttagtttcactttcaccaaaaaatgtaggcaatttgacttactccacccaccttccctcttctgagcccatctgtgggtgtcttcaggccaggtatgagtcactttcagtaagaaaaatcttagaatgcacatccaaaccagattctaatgaccttcacacaggctaccattttggattattctccactgtttgtacgataatgagcaactgagtttgtgagtgcacggcattattttcttttaatgtgtacatattttctgatgtatagaaataaattatttttgtttgtttaatgagcagtcttcaaagatatagctttaatttctttcaagaattcatcatgctgcctgcaacatgaccattaacagagaagccagcatcacggtgactaatctggatatcacaggagtcatataagcacagggtattttattatattaaaagtttttatctaaaaaaatctgtgcagatgattttagaaagaataaataaaatagcacctgaaccaatattaacttgcatgacctgtgaggtcaggtcacacatgatattaaaaacccttacaggatgcgtctgacagttattttaactgtaaataaaaggcataaactatttggatctggatagttgcactggctcactggaatcaattaaatgccccatcgagctcttaagctgtaagagtccgtgaaagaccacagtgcatacaaatccatttggaggctgtctttaggatgccagggctaaaaggtagatggaatatttatttaatctggctcataaacactcacagattactgaaaaacatcagatcagcatttattgtaaccacaatattctggcacaaaaaccacctgtttcctcggtcaggatataaaatcaaagcagtgttttataggggagtgcaccgaatgccctctcattcattctctgaagttgtagactcattaccaaaaacctttaaaagttgttatatatctatttgaattatgcacacaattatgagatctattctccaaatatgttcactaggacaaataagaagtaaaataaaagtgatgccaactctttgatgtcctctttgacccacctctcccaacggtgacttctcatacctcaaaaatttaccacaaagaagaaacagcgaaatgtacattagtgagtgaattttaaaagatcaaaattcgatcttaaaaaattgtatcactgatgactttgatgatcttaaagcagaataggtttttctgggtctgcactgtggacaatgtttgtgtctctcccaaattcatgagttaaaatcttaacccccgaggtgatactattaggaggtggggccttggaaaggtgattagatcatgaagggattagtgcccttataaaatagaccccacgagctaggccaccccttccaccatgtaaggactcagtgagaaagtgtcatccatgagaaaacaggccctctccagtgcctcgatcttggacttcccagcctccagaagtgtgagaaatacatttctgttgattataagccatctagtttatggcattttttatagcgcctgaatgtactaggacagaatgtgtcttgttgaaataattatttgcacccataactctctgcccctttccactcctatactcatttcttgtgatagttttctttgcaatccataattatcattggtatttatttcttcatttgtttattatctgtatctcttcatagaatctaagtagagacctagggtagggaagttgtgtgctttattcaacagcatattgccagaacctgagagagggcctgacacatacaggttattcaataaatatttcattgttctttcaggtgctaagctaatacttctttgatgtctcagtgaagagatcctataaaattttataccattgcaagaatcacataatataagttctgagaatatggtgaaaatgtaattataatttcaagggtcctgtgtgactttttcatggattctctgagtttagggattaaatattcctctaactcatttagaagcataatattttcttagtcctttgcctactatagcttttgccatgcaaacccagagaaataactggacaataatcatacacatttatttttaacagaatggtctgtcacatcttaggtagtcccatgtgagttggtctcagtatttttttttttttacttttggatctttgcaaatttaaaatcaagagaatttgactctaatagtatgtatgtgcatattatttctactgtttttttcctccaaagacttggagtctgggttagtttggatgaactatatttctgaagcttttccaaactgcttgagtcaacaagctagacgtaactataaatcttgggagaattggcttttttgcactcccatatctggtaatggctggcaatatcaaaagaacatccttcctttcactgggctggcactcctcttttcagtattggcctgcccccaaaaagtgaaagcagatctacgttacataacaaacctcctggaaaaggtgttgttctcaaactgagataagaaattgtttcatgcttttttctctaaattggtttgcttgtgggttcttgatggtttcatggtctgcatctcaccagcaacattattttctccagctgatagactatgactgacttgtcacagtttatggcatttcagagatttctattgcttctcccctaatcccctcactcagagatagtgataacaggaaaaagataccaagcatgagttttaaattcaaacttgccaaattcatgaaatacctacagataaaatatgccagaacaacttaggggtaaagaatccgtataagaaaaacgttatctgtcgaacttcagttcaaactttgaattatgttgcttactttactgttttctctcatttaggatacctatgcacgagtttttctcaatctattctgtccttcgtggggtcacctataaaaatctggcaaaataggcagtgaactgttttaattcatccatccacccgtccatccatccatccatccatccatccatccatccaatagacatttattaagccccatctcagggtgactaatcttaaggagtccatgtctaaagagttagaaagatacaacatttctaatcacaatgcagagtcactaatcctacaaagacttattcccaaggtgtattgggaacacagatttgtaactaactcttccttatggaggcagaattgaggggatgctgatattggacaaggctttttgaaacaggtggaatttgaacagaatttggtggtttaaaacagtagtttcccacacccagctaatcatcagggataaccggatgagtttttcgtgattctgggatgggagaaaggttgatttaggatattctagaccaatagtatgtagtgagttccaaagtctacagattttggaaacactgatttacagaacaccagaaagacctctccttaaaattctctctcctatatttaaaatctgcactctaagtagaaaggcttttttttttttaaagatcctcagaatatttatttgccttcaagggactaatgttaaaatgtaactaaccctacaagaaatgatgacttattaacttgcatccattttcaaactcactgagagcagcatagtgggtgcagtggggcaccatcctggaagtagaaagatgcaataggcaacattttaccatcgtgttcttttcccttgaaaagctcaggattggttctaaatggtagtgatcaagaagagaagaaagtaagactctgagaagaatgaaccctacaggatatggaattatagagaaactaaagtggaaattactttcttctattttctctttctctccatcttctctggactctctaatgcatggattatgcaaaggcataacaatttgccagttagattttcagtagcaaataaaaacatacacttacacatgaaacacacatgaagtaggtttagtatacatgaaaattaaatgtgataaaatgagcttttaaaaggctgctggttttagagagcttaacatttatgtaatgattttaacatttttggttgcaggcaaatttctcgcatgctgtacaaacattttattttgaagacaaaaacacaacatggttacacaagagtttcaatattttggactgtaaagatttttatttttttgatttgttttggcgagaggatcaatagctagcctctgcacatgagtgtttatacaccagaattcaaatcactgctgtacctcaggcttgcttcagtttcacttacttggataattcaaagatataaaacactgcttaaaatcaggaccttaatagcagctacttcctcaggcaacagcagcagcagccagcaggctggagcacacttattgtcgtgctgtatatcacagggaatctacaatgcctgcataattcagtctcttccttagtagaaaatggtcacaaaatagataggaagaacaccgcaattgaaataccttacagcacactaatgtgggtatcctagtgaagtataattcttaaggcaccaactatataacttcaaaaccttcagtgatggtaacattttattaagaattaataatgaggtttttttttttcctggaaacaatttggcagtatattttaagaacttaaaaaaatttctattccattgagccaatgattccccttccaggaatttatattaaggaaagcaagtaccttctttcagtgtagttactattcccataaacctggtggccagctccatttggaaatgtgccaacaaataccctttggaatggcccaagtgaactgttttcttgcctcatccttggcagtgaactattttccctataaaccagaggaaacagcccagctgtgtcaaactagaacccagctgccttctttgcaaacatttcccatagctaaaagcttgctttagggtttttgaaaacatgagagaacccaatgtctacccttggagtcacagagttataatgtaacacctggctcctggttttataaggtaagcctgctcaggttcaatatacatattccttgttaggctcaggtttctcaaaatgtgttttagcagatttttatatctaaaagctgctctggtgttttatgcatttgcagaggagatgtgtcattttagcaccatttgaaaaataacaccttctttgaagtactctggtttctttgttctttgtaaataatatttatttttctaatcatgaagataatatacattcactgaaaagaatgtagacaaatacataaacattaaggaagaaaaaaaagtagcatattaggttgtaatatctaaaactgccctttagttaaaaacaaatggatattggcaatttcatatgattcaatttaatataatgccaccatttaataattattattaatagtttgatatattttatttttgtctttttattcatatgtttatatagatcctagaaatttccatatgatccaataagctcaccagggaattggtgctgaagccttggctggaaataaatagtgtgcccttctcaacactatttatagtgatcccttctcaacactgtgctctagaaagggagtgagaaggtagttggataagtattcaaaataggacactgtggctttctgccttccttacgggaaacatgtctaaaaaaggttacccacagcaagggttagtatttgttgaacatttactgtgagtaatatactgagagactaatgacttatttggagggagtgagtttgggtccatcttagggcaaagttctacatgtccaggccaattcttccttccatccacccatctgcttttgtgatagttggtttgtgtggtggttctatcaacatggccacaaattttttaatactctttccactaaaaataggatctctccccttccccacctcatattaaattggagtaggctcttggctgcttcatacagtagagttgtggaagaaataatgctatttgacttccaaactgggaaaacaaaacaaaacaaaacaaagcaaaaaatatttgtttccggtactgttctctgagaacactcactcttggagttctagcccactgtggtgtcaccacctcggggctaccatgctggagagaacatgtggaggcaccacatgcggtcgccacatggagagactgtgataacagaaagagagagagagaaagcttgggaagcacttcagctcatctaagccctgactgcctaagtcatcccagtgaggcctcaaatatcctatctaaattgcacaaattgcagtcttctgagtaaaacaaataattgtagttgttaaaagcaaccacgtttgggcacagtttttaaaagaataaagaaaatttgagaacttatcttatgtgacttcacaacttaccataaagctactacaaagccagtgtggtgttggtatcaaatagacaatggaacaaagtaaagcctccagaaatagatgataaaacttcccatgatggccaaggccctgattacttatgttgaaaacaaaaatatctaatgttatggataagtaacatatatgagtaatgtgagtcaggacaaagtatacatacatattgtgattgatggggccaggtagagagcacctgtctaaagagagcagctaccactgataatttccatcctaaaaatagaaaagtctaggcttgctagaacttaagactggaaatattaattttttttttgtagcttacaatctcctcaaaatatctgtgaaattagcctggcactaacccaaatgacacctttataggaattagaaaaacatgaagacacttcatcattacatgttggacaattttcttgatataaaagtctacatggtttatgaaagtaaagagtgcctgcagatttgtgtgtgtacaaaatcttcaccatatgctgaaagctcttcatggtctggattcagctagagagccacaatcttgccatctttgcctcacatcttggcaaggccttcagactattttggctttgaaagacacaaggaatccattttcacattacgttgtttgttttcttataaaagttgtacattatcacactaatgtgtggtttctcacctgtcaaaaactaaccatgattagatttacagagtaactgccttagaaaggcctagagtcttgccttagaaaacattctgagaatgggtttcatccagaaacttaatgataaaaccatgattcatgttaatattctgcttccaaaaaataattatcatctatattttttaacgtccatgttaccttatctacttttctcaaagagaacctttatttttttaaaaaaatattacaaacaaaggttatcatgcagctatgtgccaagagatagcagagtcctatggttacatgtgccagttctctctgaaattggattggattaaaagataacttgccatgtgttggctcctagatcattagtcacagtggtctaagtgcattctcttataattcaatatcaaagaaattgcttttgtgacattaactatattatattcaaaagtatataaattattgaaatgctatgcctactgccaagatataagacagttcacatggaaaaaaaaagttgtgttttaaattattcattagaaaaaaatgcagtctcttgacagaaattgttttatactggggctagcttctgggacttatatttaaatataaatcacaaaaactcaaattttcagatattcttaattctctttaacgccttgatttccagcaagaggattaaatattatatattgccttagatctacagttagatacgtactgtattgaatacaagcatgtgtgtgtgtgtgtgtgtgtcttgtaacatcagtatgtgcctttgtttatactgagatatggtaacagtggggaaagtctaattataggaaggctactctcaaaagatctctctcttacagatttatatattattcatttggttagaaaatgtttgtcatttgctatgcactagggactgacataggtgctgttgatttaacatgtaataaaagagttgttttccagtagcttatatattatggaagaaaataaacattaaaatagattaaaaatacaattatatcaagttatatgagaaacatatacataaaatatgtataccttaaggaaaattcacccagctcagataaagatagaaggatggcaaaggcgataccaagatattttttggaatatgttgtagccgtctaaatagacaaatgtgttccaggtcgagttatacacatatggaggctggacaagatgaggaccctatcacagactctgtattcatccctgtggctgtaactgaactacttagctagtcacacctaaaattatttcctttattcactttcaagacataaacaaatgtctctttttgtagatatttctggagaagccagatgaatgcaagaactattttatattgatccctgagtaatttacaagatcataattagtacacagtaagtgctcagaatgtgtttaatgggaatattttagtcagttctaaatgttccttgtttagagatttagtctttaacacattcatttacaaagtcattctccttcatattaattactacattccaaggaacagaaatactttgccacttctcccttttggcttaaaatattaatatattgaaagtgaactagtctcttgggtgttacataaggaacactaacatgctttagcttctctcaagtactaagtgtataaaatattttcatatcccagataaaaaatatcatgtatttttacttttgttttcttgatgctatcagattctgtttttaaaaacttaaaaaatgtggttaagactgaaaagtgtaattccttgggcattcgtgctctggagctacctctccaacctgctgaactttcttgttttgaacactccagtctcgtcacttgataaatccaccaaaaataagccaaaccaaccccttcttctttctgaaaggtggaaaatccaaatatgctacctggtaaaagttagctcttttattctgtatttttgcatacacctaactatcattaaaaccttttattcacggctactactgtagtggaaggatggaaaagtataaactatatctaaatatttggattttaagggttgagaggaataaacatcaaggattagctatgccaaaataacccaatttaccttttgagtaggtcaactacttacgaagaaagaaaattctatgaacatattgagtgtgtatgtagatttcaggagccgtttgacaattgttgacagtttaagcaataaaatagagttgtgtggacaagttgctcacatagcctgacagagacctaactggtcatgccactacaacttgtattggtggtagattcatgtctatatggaagcagaatgtcagcagtgctcaataataatctgtatttggctgttttgttttctgaattttaagcaacttggatgtatctctgggagacacatttaatgataaaactataccggaggtcaggtgttcagtttcagtcgttacaacatgctagtaacacacagatgttattttgccattagacgccagacagaatagtaaagtgcatacatgcagtactacgttaggacactgatgacggaaccaggagtgtttacataaatataaaaaatgcaaggaaggagaagagtatttgcatttgcttgtgaatttgttctcagttgatctagtagaaaaaagtatggtagaattcaggtgattataataaagtatcctaaacaagaagtatcctaacaataaaaaactattttatgagaatacaagctccctgtcatcacatggtttccagagactatggaagaccagtgggattagaaatgggattactacactgagtgaatgcttgagtcaaataatactgttaggatttttcaactgtgcattctttgagtatttgctgcactacatacctttgtatatgaggaagtaaactcaaggaaaatgccattaaagggcctggctattagcaactgaaaaatgagatctgagggaggttaagtgatgaacaaaaatcatttgttgttcgggactggcgataggactggtagacaactggggaagaggaggagaaaaataagaggggaggcaacaaaaatgtagataaaatgaacaagcccattagaggagagaaatggaatttcttcttacatttcacatatagtttttccctttcttacagcatttttaaacaaaactgtataaatagaaagtatgcactgacaaacaatgtcaatatcaggtgcacttgtggaaggtaaatgttggattttcaggaattttgtgagttgaattttaagcatattcattattaaaattaaataatattaaagttaaattatactaaaagcaaaaattttaaaaactcaaaatgtatcactttctcaatattttattacattttactgtcgtgtgttatcttgggttacttacatgtattgaatctatatggtagaaatggtctgctactgcatatctctcctcaactttgtatttagtgatatcaatctgaacgtggccacagtggcagtgtttagagcatggaaattggcaaatgctataaattatggcttttttaaaaaaatatttatcagtagcctgcctaccaacttttacctatatataagatacatttaaagttattcatttcataaatactgtaatatttcataataatagaatatttcatagtgttcccatcagatattgagatcatgaagaggaatcaaaggcatgctcttgcccttaaaaagtctagaatgtagttaagagagaaaatgagaacattagtaactgtaaagtggaacaccctaagagtcataagaaagattcagagaaaaagatcacggtactttaggtgagaaaatgactaactttaattggaagtaggtagaggaagggcaggtggagaggagaatcagaaaagatttgatgagaagaaatttgagcttggctttgaataatggaacaaatttggacttgggaggatgaacagagaattgtgagatcagcatttggaaataaacagttagtaaacatacaggacatatttgccgatcaggcagtttagctttacagctcaacttggtagaaacaagattaaaatgttaggatgagaataaattatagaggactttgagttaaaacattgctaaaataatggacgcaaaaacaaacatgttgtaaatggctagtgtattccttctgagggcctgaagtttcacaggcccaaataagtttttgtttaattcttggaatggaaagaacgtttgattaatatctttgtgggagggaaaaaagagactactgtttgctatttgaaaactccatggctggttgtatgttggtttctccccctatgatatgaatatcctatcaagtgtttctacctaagcaaatttttgtgagtttgcatttatagaagtcacagtgtatgcatccagattgatgtgttagtataaatagatggaaatatgtttctcagttgatgagtaacgtaagagcccttctcatcctgtttcaccaaacagctaaacccacacactttcttccacacttcctctttttttcccacatttatctctgtattgtttttcatttccagagataggatgaccacctgcctttccaacatattgcaaaaacaacagtgactatggttgattttttctagtcagttattttattgaaaaataaaatgtaccaaatggcagcagagtcaccagctgatgagaaggttttttatgtatataacatggtgcttttgatagggagttggcaatactgtgctaggattttaatatcaaactgtttccatcaggctggaagctgtaacactcaaatggtaccttcaggaactaagctgtatgcttgttactataaggtactttttgaaagggggcattaaacaaaatttatagaagaaaaaagaacttttcttttgtagtagagaaatatcttatttctttctaggtgttgcaaggcagctaattgattaccaagttcattttcctcttcttggcagacaactaaattatgattcccagataaagttacttatgcttgagttttaagcaatggaatgtgaggagaagtgatgtgtgctctttccaggattggctcacataaacctcccaggagtgatcctccttgctgtttccttagaaattggaaatcacatattgaagatggcataaatgaaaagtagaatagaactagtctctagagaatatgggctgcctgtaggaacaattgattgggatgttcttttttttttttttttagatggaatcttgctctgtcgcccaggctggagtgcagtggcacgatcttggctcactgaaaccatatatatatatatatttgtatttttagtagagacaggggtttcacgatattggccaggttggtcttgaactcccgaccttgtgatctgcccgcctcggcctcccaaagtgctgggattacaggcatgagccaccacgcccggcctgggatggtctatcagcaacaaataaataacaggcctacacagttttataaaagatatctaccaatatttaaagaactaattttcatgttatatagcctactcaagagaagattcaagatacaaaatttaacaaaaataaaatgaggaaaatattgccaattcatttcatgaaactgacataatgtgacattaaatataggcaatgactgtacaagaaaagcaatttcacttataaacacagaaaatttttaattgcaacattggattcatcaagtgaatccagtaatatatataaaaattttgcctaagcaagtgttcttatgttaggaatgaggaaattatttaacagcttataaatttaatacatcaatacagatttaaggatatgtatatatatataatcatgtcaatagatatagaaaaagcattatataaaaatactataatttataacaaaaagttgcaatctagggatagtttctttcaaaatgtgactaaaaagatacaacaaaattcacaatgctcattatctgtaattgtgaaatgtgaggcatatttcattaaaactgaaacaaggtaaggaagcccagtttttctatttcacattatagtagagttcctaatcagttcaataagatttagaaataagttaaaaggataagtattcaaagcaaaggtgcaaacaagtcattgctaatagataacttgtctttgtagaatattcaagagaagatacatgctattggaattgataagataattcaactggattacagaaaatatgttaactcttccccccttaaatctataaatgtgatacaattacattaaattccattttatttacagaattaaaaaattcatcctatcactcatattgaagagtaaaggaccaagagtagccaagaacaatcctaactaagaaaaataaaagagaataacttatcctttcaaattctcaatgctaattataaaatgccgggaaaaaatacagcctagaataaaactggcacacacaaaactcacagcactcacagaacagacacacacaggttttgaatatgatagcggagtattacaaatcagtgtagaaagattcaatcaatggtgctaggcaattgtctaccctgtggggaaaaaaaaacaatacaaatgaatttggacctcatgccatgtacataaataagttatgcatagattaaaagtccaaatattaaaatcaaaattttaaaatattttaataatatagaattactttatagcattgaagttggaaaaagagtaagatgtaaaacacaagccagatgaaaaagattggtaaatgtgactatcttaaatgtaaacaggtaaactttggtatatgtgagataccataaactgatttaaataaagccacattgcaggaagcattcccagagaatttaaacaaacaaacaaaagattagtattctgaatatataaataatttcaacaagtcaaaatgttaaaaaaggtctactaatagaaaaatggataaagaatatgaatgcacaattttaaaaaggggaaactttaatggccaattatttgaattacttgacaagaagtgcaccttcacttttaggcagaaaaatttaaattaaaatgtcacaacttgaaattcataatattggtgacacttaaaaaattaggtaataccaagttgatgagaaaatgaaaaatcacacactgctgaaaacaatataaatctgcaaataatttgaaaacaaataaaactgaagatacacatatatcactacaatttcatttctaagtatttgaatgccctagaggaaatacttagaaatgaaattgtagagatttgaaagtgtagtcctgaatcacctgggagctttttacaaatacagatactcccagattaactaaataaaaagctgcaacttaacaagatctgtagataatttatatctacattaaagtttgagaagcattgccctggactaaaacagtggttctcaatattgaatgcacattaggaccatctgagatgttctcaaaatatatcaattcatgggccccactcctgaaaaacttgaattgccatctatactcaagaaattcccaaatgatccatttcattgtttatccatggaatctctgtactagagaaaatctcatatatgcacaaggaaatacatgaaagattatacagtttccaaaagcaaaaatctgaacaaatcccaattgaccgtgtgtttataaaatgttacgttgtataatataatcttcaactgcagacaaaatgagttaactgggtccctgtgtatcaatatgaactattctgaaaaacaaaatgctgagtgcaaaaagccagttgggaaagaattgtgcagtatgaaattatgataccatttatgaaaatatatgtcaattctgtaaattattatttagaaactaaaagtccaatcctttaggaagggagcagtgttttgtttaaaatatactgtgaaatacagagcttctacaatttagaccaggctgaactttggggatcatttcaaaggcctcatttggtcccagagaagtggtgcatttctgggtgtacatgtaggtcacagattagtcaaccttatggtcattaaaatctagcttttgcagcaatgctgatgctaatgttgctctcctaactggatattaacatagttctatattctaatttttaacattcagttgacctgaattctcatccaatctcctgacctctctaccaccacacatattcatacaattttccttccaagcatacagaagccctctgtgtgtactttccactcccatctcaggaggcactacagagcctgggtcatgtttcagcctgtgcaaaatgagtcctatttacatacctgggctggaagagtaccaggtgtgtttgagaaaaagatactctgttaatgtgcagcactatcatcaactaggttttgtgtgtgtgtaattttggaggtagtgatagacaaagtcatttctctctttagaaaaaataatcgagaaacaggttttgattttgtgcattttcatcaaattcaaataatctagaaaaatggagtgagatcaaaagctacaagaaaggctcaagcgagctggatgcggcatagcctgtggtgaccaaggttttttgttttgttttgttttgttttgtcacagtgaagaatgacatacaattaagtgaaataatttttcaaagtgaattctgcagcaaaaactcctttttaattttatccatcagaaagtttgcaaatgcctatcatctacaggtattatgctcccttaaggcaggagtcatacttctttacaatctctttagagagccaggggtatagatgtacaaaaagacatcacaaaagaagtaagtaaattgcttagtaccaaataaggggacacaaattcacttccggaggagttgagagaaggaagttggcctggagtgctcagaaagactttttaaaagttgtaggttttatataggggcctgataaagattactaggggcttaacggtagggactatgggttggtcatttttacagcacatatttacataattgaaactcattaaatatttgcagatggtgagagacaggatttgtatcattaaagaggagaaggacttcagacaagctagtattgcttgcagaaagacagacgggaatgccaaaggagagcaggaaatatttctcgaatacttaatatgtgtgaaacactgtgctacatactttatatccattacctcatttagtaatgtgcctcgcagtaccacacagtcatgctatgaattaggaattattaacctaattctaagagaagaaaaatctgagaccaaactgatcataagcggcaagactgggtctcaacccaatactgtttttcactaaaccttgtatttagtatattaaacatgctgcttgctcacaaggatctaagctattgagtcatggtaagaagattcaaaatgaaaatatccaatatgaaatctaaggccacagaatttgcagttaggctgccttgaaactctggtgcttactatttgtttaacattgaacaagtgacttaaattttatgatcctctatttccttctgtaaaatttggataattagagaaaatacatcaaagtgatttagaggaaaatgtataagataataaatgtacagaaatagaacactacctgacataaattatgtatttgataaatgtaggctttatagaactaacattaaatgctgttggattgaagagcttaagcagtctttcctgttttctttttttaagtttcagaatggctctgaataatgtatacattatacattaatttatttagttgtctttgtttccttctaaataacattctctgagcactgactcttcttccatggttaggtagactgcaccattaacttagtcataaattttctatttgtgcagatcatttttatcgaatatctttagaaaaaacagagtttatattgtttaacctgcatcactatagtatctagttgcagaaagtactcaactataaaatctgtatgtttttgtcataggtatcattccttgccattgaaaacatttatgattctttaacattggccaacagatggcagatattaaaggacacaaagagccaaatattcttacccttccagactggatactctctcctcatacaagataaacagagcacagccaggtgagagaacgtgctgtagagaagccagccccctgaagctatgactggcttttcaagagtatcactgatccagaccatttagagagtaatatcagactcggtggagcagagagtccctacatttagcctaaagacaaacagcaactgaaaaaaatacagaaaaagtcttcaggagaaagttcacggtgaatatcctcttaactgagaaataaaagatacagaggttaaacataaaaaaatgactaaagagtaagcaaagaaagtatataaaaaagaaagatgacaaagctaagacattaggtgacaataaaaattacaattgcatgtaataaaagaacaggataaataataactagcattaattatatcttcactgtgcaccaagaactattctaactatttatgcatattaaagaattacatcttcacaatatttatgtgaaacattttcactcctattttgctgatggggcgactaaggctaattcattaacttgctcagatcacttaattgttaactaggagatctaggattcaaactgagctgatctgagtctgaaacctaatattttttttcctccaaggctatgcaggcagaaaacaaaaacagtagagctttataagacaaatcttggattgaagagaaacatatttcgtggagaaaccttagctcctcacagagctgagtaagagtgttgataccttatcccaataatccctttaatcccctattttgtgagtgcacctatgaatgcattcaaagactggggtgtaaacagtttatataagtagccgaaggtactatattaagacagttatcactctgcattattaaaattatatcctcacttatctgcctttttagactgtgagccttgagccttttgagggtaggggaaaagatcttgtattgaatggtgtttttttttttttattatactaagttctgggatacatgtgcagaacatgcaggtttattacataggtatacatgtgccatggtggtttgctgcacccatcaacccgtcatctacattaggtagttctactaatgctatccctcccctagcactccaccccctgacaggccccagtgtgtgatattcacctccctgtgtccatgtattctcattgttcaactcccacttatgagggagaccacacggtgtttggttttctgttcctgtattagtctgctgagaatgatggtttccagcttcatccatgttcctgcaaaggacatgaactcattcttttttatggctaaatagtatttcatggtgtatacgtgccacattttctttatccagtctaacattgttgggcatttgggttggttccaagtctttgctagtgtgaacagtgttacagtaaacataggtgagcatgtgtctttttggtggaatgatttataatcctttgggtatatacccagtaatgggattgctggatcaaatggtatttctggttctagatccttgagaaattgccacactgccttccacaatggctgaaataacttacactcccaccaacagtataaaagtgttcttatttctccacatcctctccagcatctgttgtctcctgacttttttttttttgagatggagtctggctctgtcacccaggctggagtgcagaggcacgatcttggctcactgcaacctccacgtcctgggttcaagcaattctcttgcctcagcctcctgagtagctgggactacaggagcatgccaccatgcctggctaattttttgtatttttagtagagacggggtttcaccgtattagccagaatggtctcgatctcctgtcctcgtgatctgcctaccttggcttcccaaagtgctgggattacatgtgtgagccactgcacccggctgtttcctgactttttaatgatcgccattgtaattggcatgagatggtaccccattgtggttttgatttgcatttctctaacgaccagtgatgatgagcttttttcatatgtttgttggctgcataaatgtcttcttttgagaagtgtctgttcatatcctttgcccactttttgatgggattgtttgtttttttcttgtaaatttgtttaagttctctgcagattctggatattagccctttgtcagatggatagattgcaaaatttttctcccattctttaggttgtctgttcactctcatgatagtttcttttgctgtacagaagctctttagtttaattagctcccatttgtcaattttggcttttgttgccactgctattggtgtttcgatcatgaagtctttgcccatgcctatgtcctgaatggtattgcctaggttttcctctagggtttgtatggttttagttcttaagtttattatttgcaaaattcctgacatactgtaggtgctcaaaaatcctagtttgtccctctccctatcccttttccttatccctgtaacatactgttcatgtcctcatattccactttcaatcaaaattatttgctttctttccacatggtagcctctgtgtgcttatgctttgccttctttgttaagagaggactgtgttcccatccagcctcatccctccacttgagcactaagtccattcactttaactactcgagggcttcatttcactaatcctcccattctctcccacatcatccagtgttttaccttaattagatcattcccatagcatgtgttatagttcttcaatctttaagaaaaaataaacagaaacagaaaaacaacaaaaaacctcttgagcaatcttttctgtttactgcctcattttacaataaaatgcctcaaaatagtgtttgtagtcatcatataattttctcttgatttctttctaattacactttcaccactactacttccctgcaactaccttctttcctaccaccctacaacgatgcacattacttaacccagtgacaggttctcagctctcatcttacttagtatattactcaacgtttagaataattgatcactttgttccccttgaaacattttctctgcttttctggacatcacactctcctggttttctactaacctttactggcctctctttgccagtcagctctgatggttttttcctcctatctcactagtctcctgatgttagagcatctcaagcatagattgttggacctccttttatctacattactgctttagtgagtccatcacattttatggtttgaaataccaactaaaaagtcaagaactcttccctgaattgtagacacagatctccctcatttctttcccttgggttcaagattagatgtacaattctctgttcagtatcttcacatggttgtctagtacatatctcaacatgtctaatgaaaactcttgttatttccactcaaactatctatcatgccagcctttcttatctcagttaatcataactagtttttccaatttgctcaaaccaaaatccttgaaatcacccttggtttccctcttattctcacactccacatatattatcagaaaatctatttgcctctaactttagagcctcctaacttcatctgctattgtccatgtcccaggcaatcagttctcaacacagaagtcatagtaattctaataaaatcaatcagattgcattgcatttcgcccaaacactccaatagtttcttatctgttatgtactgcattctgttgttagcagaaataaggacattaaaggtgatactgatgagggttctgaaagaaaagaggaagacagtagtgcaagctattattgttttagagaacatatatatcgttaccataatgttagtagaaatatgaacactaaaggtgctctggtagggtctcagctgaaaatgaggaacatgttatcagagactgaaagaaaaactgttcatgctatgaagtggcaaatacttggctgaattgtgttctagtgatctgtggaaggtagagcttaaaaataataaacttagatatttagctgaaaagatttctaagctaagtgttgaaggtgcagcttgggttttccttactgcttaagataaaatgagaaaggagagaaataaagagaagaagaaattattaacagaaaaaaaccagaacttaaagatttagagaattatcagtttatacatactgcaaaaaaatgagaaagtatgttctggaagggacaacaaagatatggctgaacaagtactccataaagagattgcccatggatttaatcagctatgtctccagtggccagcacaggaaaatagagctattcatatgtgatcatgctttatcctacaaaaaaagaaagtatgaccttgaaggtaattcagacatcatcagagctcccacttgcaccataggcccagagcatgcatgcccaggaaggcagattatttacttctcagagagggtggggccacctcctagatttcagtagccaaactgccccttaaagagtcatgggggcaggataatgcttaaggctatggaagggatgctgctgccttattgggcctggagagcagagcatctggccaaagaggagtattcttaagccttaagatctaataaaatgccttgataggttttagaatggcttgggactcatcatgtctttcttctttctgatttctctctcttggaatgggaatgtttatcttatttctaatccactgttgtaattttaacacacataacaagtcttgtttcacaggttcatagctggcaaggaactttgcctcaggaagaggcatacctcttgactcacctatattctatttagatgatatttagatgagactttggacttgaaatttatgccaaaatgggttaagacttttggtgctcttagcatgtggtgaatgtattgtaagtgaggacatgaatttggggaaatggggcagaggtgagaattttataggccaaattgtgttcccccaaatttatatgttgaaatcctaacctccaatgtcagtttaagggtttgtagacagggcctttaaggaggtaactaacgttaaatgaggtcatcttggttggcccctaatctaatatgactgatgtccttatagtaagaggcagagacatcagagctgtctttctttctgcatacacaccaaaaaatggccatgtgaggacacaaccagaatgtggctatatatgagtcaggaagaaagataccaccagaaaccatccctaatagcatcttgatcatgaagtcctataaaaataactatctttagttaagtcactcagtctttggtattctgttatggtagctcaagcagaataatataccatcacactcagagccaggggtatagtctgtccaatggctaacagtgaccttcctctctacatcctgttgcttttccaatataatctattactatttttctaccagctccattggttccttgctctctgacatttccgtggctcaggggctataacttgtggtttcatttatctggactctcccttcagatatatgcatagctttttccttgtacttcttttaattatttgtccaaatataaccttgtcaaaaattatttccttgaacattctgtttacaaattttacctttctaccttccttgataaaaaaaagtcttcatagaacataccaccttctgacgtattacataaattacttatatgttttgtttcttgtcccttcttactaaaaccaaagttccttgaatagaaatttttgttgatcttggtcattgttcacttcagtgcctagaatagattctgtcagataataaatgtttaataagcatttgttaaattaatggaaatgtatttatattttcttctctgctagtcaaagaataatgaccttcatatttgtacttctaaggcctatatggtaaatataaaatatttaatactttcattaaatatttttattaaatatgaatagaataataacaaaataataaatcaaggttgataacagggagaggaatcaggagtctagtatacaaccctaccatttcatttctgatatttatataaagttggtattctatgtaatatttggagatgattgctaggaatatgacagttatcttaggctgtgtttgttttttcatgttttataaagttgataataaacagcaataacaggtcctgttgccaagcttcccaactaatgtgaatgttgcaaggtgaattaattagtaagaacagatgtcatgcatgcagtgcagttctaagggatctgctggccatggtccagtagctggcctcatagcacagtgtaagtacagactgcatacgtagacaccagccagtttaggttcacatgtggaatcacagtgttgtgggaagtcagggaccccgaatggaggaactggctgaagccatggcagaagaacataaattgtgaagatttcatggacatttattagttccccaaattaatacttttataatttcttatgcctatctttactgcaatctctgaacataaattgtgaagatttcatggacacttatcacttccccagtcaatacccttgtgatttcctatgcctgtctttactttaatctcttaatcccatcatctttgtaaactgaggaggatgtatgttgcctcaggaccctgtgatgattgcattaactgcacaaattgtttgtagagcatgtgtgtttgaacaatatgaaatctgggcaccttgaaaaaagaacaggataacagcaatgataagggaacaagagagataaccttaaactctgactgccagtgagccaggtggaacacagccatatttctcttctttcaaaagcaaatgggagaaatatcgctgaattctttttctcagcaaggaacatccctgagaaggagaatgcatccctgagggtaggcctctaaaatggctgctttgggggtggctgtcttttacagtcgcagctgtagggatgaaataagctccagtctcccttagcgctcccaggcttattaggatgaggaaattcccgcataataaattttggtcagaccagttgtctgctctcaaaccctgtctgctgataagatgttattaatgacaatgcgtgcccaaaacttcattagcaattttaatttcgccccatcctgtggtcctgtgatcttgccctgcctccatttaccttgtgatatcttattaccttgtgaagcatgtgatctctgtgacctacatcctatttgtacactccctccccttttgaaatcactaataaaaacttgctggttttacggctcagggggcatcacggaacctgccgacatgtgatgtctcccccggacacccagttttaaaatttctctcttttgtactctttccctttatttctcagaccagccgacacttagggaaaatagataagaacctacgtgaaacatcggggctgaatttcgcccgatatcacagagatgtctttgcactgtttttgaatatcactttcaaggatagtaacacaccaacataattttagagataattggaatgttgtatttagctagatatttcattgcaagctcattacagtttgcaaacaatatttacaatttctcttatttcttttgttaaatgcttaactacttgcctgctgtaatgtaaaatagcaaagaattgaaatgcatgtgcacctggtttatttgaatagcaaatttttattcatgttctcagtaataggcagaagaaaagcaaacagaaattaagtggttaatgaaaaaataatgactatggcaaatttgcttttgcaaactgcttaagttctcattatccaaataaaaatgattgaaaataatctcaatatgaagtaaggatttcaatctattaactttcttaaaattcagtgtgtgcaaaacatctgccacaaatttaccaagaaatttccattattatttctaaaattaagtaatatctaactcaagaatctgaatattgcagtgggcaataaatacaaaaatacaaaatattatgaaaaaccatgtcacaataaacaaaacctttgctttttccattggacaggttagttccctgaccaatacctttttaatcaactgttgatttggtctggccaagaagatatattaaagttatattaaattttttaagaaaatatactataaaatattaaaaattctagctcctgaagttaagcaccatgtgaatttttacaatcatcttaaagttctgtctttcatactgtagttggaatccctatgatttagggcttaaaatggttaaagtgtaaagccctatgataacaaagatttttaatactgtagtataaaaagtatcaaatgagtgtgtaggtctataaaaagtaagaaataatttcaactcaaaatccttttgaaaattcctcctacccactattgtaaaaaaaaaaatctagcatgtatttttctttctttacctacaggttcctgatgtcagtgccataaactggttcaggaaattgttataatataggcaaaacttcatactaatgaagaaattattattttcccaaaactgtggtaagctatttgtatacattattccatcaaatactcacaatggccctataaggcaataatcttattctaataaaaatttaaaaagtgggtagttaatctccccaagtgttgaaaccagtacgtgtcagataaggcctcagacttatctgaaatgaaattgtcttttggaactaataagttttaatccccatcctacatcctagcataccacacaaacttaagtactgcgcaaacatgtcgatctgtttttttttgttttttttttttgagatggagtctcactctcttgcccaggctggagtgcagtggcgtgatctccgcttaccgcaagctccaccttccgggttcacaccattctcctgcctcagcctcccaagtagctgggactacaggcgcctgccacaatgcccggctaattttttttttgtatttttagtagagacagggtttcaccgtgttagccaggatggtctcaatctcctgacctcatgatctgccagccttggcctcccaaagtgctgggattacaggtgtgagccaccgcacctggccatgtcgatctatttttaaaataaatactgtatgggacattgtaagagtaattagaaagcatttcatattgtttctgtgcaataaagcactgaaatatggctaaaaagacttacaacttaaaatgcaaacttcaaacatttatggacagagaaattaaacattttatgtaatagataaaagagaagtcaatcaaataaagaacaataaaaaataacaataaaacaccctgtgaaaagactgatcaaaagtgtatacagatagaagttgcaatggccaaaaacagaaatagtagacagtgatactacattccaaatctaatgatttaatgaattcctcttgaagaggaattgaggttaatggaaattgttcatgcttaatttagctgcatacaatgctctgattttttattttatttggatttagcctcactttatgctttttctgcatttacaaagtctaaggtaacaaaccatttcaaattttttaaaaatcaacatttcaacctaaaatttggaggggacaaatccagtaagcagtttcttacgaaagtttattcttacttcctacctgagtaacttgcacactacaaaagctcatctgcaactgagagggaaacagtgagtatcatcaccaaaaaagctctgagatttctaagcacattcttttttatttacttctgttttcataaatataaaaatgcataaaaaggagatttgtcatatattataatttgttccactctccaagaaaatatctactatctaattcttatacatatacacatattgtatcctttaaaagaattttaaaatatcatttatttatgtcaaacaataaataactgaaatgagaggaaaataagaaaagttattgttccataatgtataaaatggcacatgatatcatacaactttttgcaagaaaaagcaaaacatgccagtaagatcaccaccaccaaacaccaaaaagttgcaactcttaagagggaaaatcactctgaaatcactttaaaaatgaggaactgaatccaatcaaaagaaataaatgtttcatgatttttcaaactttatgaatttcactatcactttaaattcttcagtatctactaaggattttttacattctgtttgaaataactcaaaatagtccctcgccctcctataggtatagatggtggagatgaaaacaaatatatttgagtgctaaatgtgatttaaatatattatttatttctcacagttattatgccaggtaaatattttccctattttacagatgaagtaagcctgagaagagaggttagggagcctgtcagtcacacagctggttcaggcctacaagtatattccacacatgcagctcaaaagagcctttattatactttttactgtaactgcatgattttagaataaacaaaagaatgtacttcacctgctctgcaatccaaggtaatactagttctgaaagcagtaacatgaaaatgaataggatttgttgcataatatcttcccccaactccttgttacatattcttatttcagaaaaaaaaagaacaatagaaaatgagacattttttttcacagtggtagacacccaaaaaggaatatgtgattttcctcctcttagagtaaactatctaaagcttctaaatcaatgcataccaacatagctcaaagcaaacataaatgacactaacaacacctctctatctgtaacttgttttctatatatgccaattcatcactggctagtaaaacctaataggagtgtgtgtatgtggttttatttttccatttacatgattagatccttagttgcattgtgattgagaagcatccttttaaagagctttacctattgcttattaaacatacatatctccatgtgtgaaaagcagcacgggggggcactgataagtgatggatacacaggaaagaaaaatggctatccctccattcattgtttccaatttattcgtgttgcaaaagagtgtgtgcccttgtggaaagtggtgcttccctgagttttttattaacctgcatcatcacactcctcccatcatcattacacaaggcagttaagtaaacagatataataggccttggtctcatctttagaaatttacttccgtggaaattcagctagctatgtcatttatcttgcttttcaaagagtgatttaagtgccacccacatggtgaagcaacagtaagctaagttgccataatcatttattcacaaattatttcttgtgtgtcatctatttcttaggctttgtattaggtattggggtaataaaagtaaaccaagtatgcccttcaagtttttgcaaagtaatgagtacaaatgatcaaaaaggactaattgaacaaccacaatctaaaaatccttcactttttcaaaggtatccatagcaataatgaataaaagtaaacaattaaataaataagaatgtctctactaactattctctgacttcatagtattattatatatgacatataacttcctgacaaaatgaagctaacatgtccaatgtgtgtgtgtgtatgtgtgtgtatgtgtgcgcgcacatacacgtagtaattcacatgctcaacattctaaagtgactccagtgtcacttggttacaagtacataaatttaatacatgatttctgaaagtcttaccaacctgtgatcctaacagacaaattgctttaagcaagtcaaggaaaaaacgtaaaagttttgcatgaagggaaactaaaaccatctcagacaaatggtaattgtctcttaaaagattttcaaaagatttttattatcagtgaactgcaatggttgatccagatgaagttggttatgaaccataagctgctcatgtttgaggaaataatatattatcatttattcaagctagcaatcttcggtgcacaatctgcactctggattaactagcaatgacagacagcagagcagctttggggtaaggcagaggttaagctacccttaacctatgctttggttaagctttcctttgtgttctaggacctaatggctgttttcctattcatttcaaattattaaaaaagtgtctaattatacagtaatgacatttttgaaatcatggtttttcttttacacagagaatggaattgacagtatggtgtgcctcccttccaggatctgcagtattcatttgagccactaaccttatagtaaatcttgtaattttccagtcagataatctaattataaccatgaatagaactgaaagagtattaatactgtaataccatatcaaatatacaatatggaaacacattaaaagctttttaatgagtttactgaaagagcaatattgtttaagatttgtcaaatttattgatatggtttggattcctatctccgctcaaacctcatgtcgaattataatccccagtgttggaggagaagcttggtggaaggtgactggatcatgagggtggatttcccccttgctgttctcatgatactcagtgagtactcaggagatctggttgtttaaaagtgtgtagctcctctcccttctctctcttcctcctgctccagccatggaaaatgtgcctgcttcctctttgccttccaccatgatggtaagtttcctgaggcctccccagccatgcttcctgtacagcctgtggaactgtgagccaattaaacctcttttctttataaattacccagtttcaagcatttctttatagcagcgcaagaatggactaatggatctgttaattcttgtttattaaggtatatatttctcaaatttgcttttccataaaacaggtattcttgaaaatttgtcttgacattctggtggtttttaacaatagacataatgccaaaagattctgctgtaggctctgtgaaacatcttcattagaactttaggtgttttaactgaaggagtctgcacaaaaggtggattatatttacctcctaaatccttcggggaactgtaaccatctccatgacgaaatattaaaagcaaatcctattttaatgatttcttactatttcctgggtattgtgccacatattatttatttttatagcaactcttgagggaatattatcataatttattaataaaggaattcaggcacagaaaattcaagttccttatctgagataaaagagctatctgtttgcccctctgactggaattcttcatttgtataggtggttcttccttattcagatccaatgtcacctcctttcctaaccaccttattacatagtagctgtacacccttggcccaagtcagtggctatctcataactcctttcattttcttcatagtacttataatttgaaattacactatttaatttatttacttacttatatttaatttacttataatttacttataagtaagtaattatattacttacttataattatatgtactctttctctcttctctagacatgtaaagcaactagaatataagcctgttttagagaagaagttttcaatttgtttattatttcttctcagccttttgaaaagtgtctggtagatagtagttgctaacttaatgtttactgaataaagaaataaattaatgaaagaaaataatagagccaggattcaaacccaggtcttttgactcaatatccaaagttctatttatttattttattttattttattttattttattttattttattttattttattttcttataggatacaggtgcatggcatgcaggtttagtatataggtaaacatgtgccatggtggtttgctgcacctatcaacccataacctaggtattaagccccacatgcattagctatttatactgatgctcttcctcctgctatcccccaacaggccacagtgtgtgttgttcccctccctgtgtccatgtgttctcattgttcagctcccatttataactgagaacatgcagtgtttggttttctgtttttgtgttagtttgctgacggcaatggcttccagttccatccatgcccctgcaaaggacattaattcattcctttttatggctgtacagtattccatggtatatatgtaccacattttctttatccagtctatcatcaatgggcatttgggttgattccatgcctttgctattatgaatagtgctgcaatgagcataaatgtgcatgtatctttataatagaataatttatattcttcttggtatgtacccagtaatgggattgctgggtcaaatggtatttctggttctaggtctttgagaaattgccacactgtcttccacaatagttgaactaatttacactcccaccaacagtgtaaaagcattcctatttctccacagccttgccaatagctgttgtttcttgactttttaataatcaccattctgactggtgtgagatggtatcttactgcagttttgttttgcatttttctaatgatctgtgatgttgcacttcttttcaatgtttgtgggctgcatcaatgtcttattttgagaagtgtctattcaagtcctttgctcactttttaatggagttgtgtttttattgtgtttttttcttgtaaatttgtttaaagtccttgtagatcccagatattagatcttattcagatgaagagattgcaaaaattttctcccattctgtagactgtctgttcactctgatgatagtttcttttgttgggctctttagtttaattagatcccacttgctgagctctttagtgtaattatatccaatgcgtcaatttttgcttttgtcgcaattgcttttgatgttttcataatgaaattttctccatgcctatgtcccgaattgtattgcctagatttacttctaggatttttacaaatttggattttatatttaagtctttaatccatcttgagtcaatttttttataagttgtatggaaggagtccagtttcaattttctgtatatggctagccagttttcccagcaccacttattaaatagagaatcctttccccattgcttgtttttgtcaggtttgttgaagatcagatggtcgtagatgtgcagtcttctttctgagtactctattctgttccattggtctatgtgtctgtttttgtgccagtaccacgctgttttggttgctgtagccttataggataatttgaagtcaaatagcatgatgcctccagcttttttctttttgtttacggttgtcttccctatatgggctcttttttggtcccataagaattttaaagtagcttttttctaattctgtgaagaatgtcaatggtagtttaatggaaatagcattgaatctataaattcttttggaaactatggccattttcatgatattgattcttcctatccatgagaatggaatgttcttccatttgtttgtgtcctctctgatttctttgagaagtagtttgtagttctccttgcagaggtccttcacttctcttattagctgtattgctaggtatttcattctctttgcagcaattgtgaatgggagttcattcaagatctgactttctgcttgtctattattggtgtatagggatgcttgtgatttttgcacattaattttgtatcctgaaatttgctgaatttgcttatcagcttaagaagcttctgggctgagattatggggtttttagatgtagcataatgtcatctgcaaacagagaccatttgacttcctcccttcctatttgaatacattttatttctttctcttgcctgattgcccttgccagaacttccaatactatgtggtggagtggtgagagatgacatccttgtcttgtgccagttttcaaggggaatgcttccagcttttgcccattcagtatgatattggctgtggatttgtcataaatggctcttaatattttgaggaatgttccatcaatacctagattattgagagtttttaacttgaagggatgttgaattttatcaaagatctttcctgaatctgttgagataatcatgcggtttttgtctttagttctctttattgatttgtgtgtgttgaaacagccttgtgtcctggggatgaagccgactttatcacggtgaatacgctttttgatgtgctgctggattcagtttgcaagtattttattgaggatttttgcatcaatgttcatcagggatatttgtctgaagttttcttttttgtgtgtgtctctgtcaggttttggtatcaggatgatgctggcctcataaagtgagttagagagaagtccctccttttcaattttttggaatagtttcagaaaaaatggtaccagctcctctttgtaactctggtagaattcagctgtaaatctctctggtcctgggctttttatggttggcaggctatttattactgtctgaatttcagaacttattattggtctattcagggattcaatttctttctggttcagccttgggagggtgtatgtatccagcaatttatccatttcttctagattttctagtttatttgcacagaagtgttcatagtattatctgatgtttgtttgcatttctgtggggtccgtggtgatatcccctgtatcactttttattgtgtctatttgattattctcttttttcttctttattagtctagctagaagtctattttattaattttttcaaaaaactagctcctggcttcattgatttttgaaagatttttgtgtcactttctccttcagttccactctgatcttggttacttcttgtcttctgctagctttgaagtttgtttgctcttggttccctagttattttagttgtaacatcagggtgtcagtttgagatctttctagctttttgatgtgggcagttagttttattaatttccctcttaacactgctttagctgtataccagatattccagtatgttgtctctttgctctcattggtttcaaagaacttattgatttctgccttaatttcattatttacccaggagtcattcaggagaaggttgttccatttccatgtatttgtgtggttttgagtaagtttcttaatcctgagttctaatttgattgtgctgtggtctgagaaactgttagttgtgatttcagttcttttgcatttgctgaggagtgttttacttccacttatgtgattgattttagagtaagtgccatgtgttgataagaagaacgtatattctgttgtttttgggtggagagttctgtagatctgtatcaggtccacttgatccagggctgaggtcaagtcctaaatatccttgttaattttctgtctcaattatctgtttaatattggcaatagtgtgttaaagtctcccactattgttgtgtgggaacctaagtctctttttaggtctctaaaaacttgttttatgaacctgggtgctgctgtattgagtgcatatatatttaggttacttagttcttcttgttgagttgatctctttaccattatgtattacccttcccaaagttctttttactatataacattgactgccaatattctaagtcctaagattctaattagtaggtatctcccttcctttcaggtacagaggaaacaattctttagccaaatgtgctattggtaaaatccatcacgaacatcctcttcctcgactttttttacttataattttccctatccatttaagtgagccagtgatcactgataaactggatcatggttgaagtgataaaaggtttaacatattactctttcatagaactttgctacttttccactatcagtaaataaccaccccttatgtccttaacttgctttttacacaaattgaatttcaaggtgcatcaataaaatcaattcctttcaaacaccctaagttttttatcccaaatatcccttgtcttacttatttaggaaatgcagaagatgcagtaaaatttaagtatttgcttatgtacttgctgtttggtctgaattcaaattcatgaccagaaaactcaaagagaactcaatatgtgaaatcctaatttgctttattattatgttggcttttgtatgcttaacaattacatgtcttcttttccctcaaactttctgtatgattcccctccttttacaccaccacacatgcacttttaccatcttagcagaaaaccttttgtattagtccattttcatactgctatgaagaaataactgagactgagtaatttattttaaaaaggggcttaatggactcacagtgccacatggctagggaggcctcacaatcatggcagaaggtgaaggaggagcaaaggcatgtcttaggtggcagtaagcaagcgagcttgtgcaggggaactgccctttataaaaccatcagatctcatgaaacttatttactatcatgagaacagcatgataaatacacacccccaagattcaattacctccctctgggtccctcccaggataggtggggattatgggagctacaattcaagatgagatttgggtgacaacacagctaaaccatatcactttgtttcatacagtcaagtaggaaattgctcctgttcccattccccaatctaccaattaatctgcatctgtgcccacactctctgccttcctgaatattaccacgaataaaatattcctggttctatcaaagggcagcccttcaaactgtgcttgtattacatcccttatggcctctcaaaaactttccccctaatattatctacttttaatcaatactgtcacttcctttttttctctatctatctcttactagaaaaaaaaaaatgacaaaaactatcctgactccagtccctcttcacctagctcccattcctttatttgcctccacagcaagccaacttgccaagtttttaatagtttgcattctctcctcagcccactccaatcaggtttccgtctctaacattctggcacggtttctgcatctgaagtttaccaatggcttctgtgtagacatggagatgtgctgtgcctactctttttaaagaaaagacttgctcatgcagcttccaggggatgtggtgagcagactgcctccagctatcagcttctccaagtttgttctcagccacctggctcaaacagcccacattcaatggttaagcaagatggtagtacaaagtgcctgccagttcgctgacatgggctaattctggtggccattttagcccaagtacttccccaccaggttggaaaagcttagttagacgttcatcacaacttaacatttttctcttatcagtcttatttccttcttgcctcctttcataggcgctattccctaataaacatcttacatgcaaacccagcatctgcttccagaaaatccaatctggacagtcaataccaggactagatcgaggaagcaggctggaagatggcgtttagtttttggagctagattatttcccacctgcaggcaatgatgactgatcactagtaaggaggaacacagactgcacctggcaaaaagtggcatccaaaggaaattttcacctgtggaaacctggtagagtgtgaggatgtagtgatagaaacagcagatgttgctgctgttattgaaatgtatgaaaaataatacataaaactttatcaggattgggtggctatggctaagcactgctggtgttctacagtcatgttgccaagtacagtggccactagcatgcattgctattgtgtttttgaaatgcagctagtttaacctatatgtattggggccaacaggcatatgaaaaaatactcaacatcgctaatcattacagaaatgcaaatcaaaaccacagtgagataccatctcacaccagtcagaatagctattattaaaaagtcaaaacattaacagatgccagcaaggctgtaaaaagaggggaacacttatacactggtgattggggtgtaaattagttcagcaattgtgaaaaacggtgtagcgattcctcaaagaacttagaattaccattcgacccagcaatctcattattaggtatatacccacaggaatataaatcattctaccataaagacgtatacatgagtatgttcaccacagaactattcacaattgcaaagacaaggaatcaacctgaatgttcatcaacagtagactggatcaacaaaatgtggtgcatatacaccatggaatactatgcagccattaaaaaaagaatgagctcatgtctttgcaacagcaacaaggaggccattatctaactaagcaaactaatgcaggaacagaaaaccaaataccacatgttctcacttataaatgggagctaaatgataagaacacatagacagaaagaggggaacaacagacattagcacctacttgaggatggaggttgggaggagggagatgatctgaaaaactacctctaggtaccatgcttattacttgggtgacaaaataatctgtacaccaaacttctgtgaagtgcattttacctatataatgaaactgcacatatgactctgaatctaaaataaaacaaaagctaaaaaataataaataataaatacataaaaataaactatgtataaaatccaaggaggtaaatttttttaacaataaaagctccagcagagtgacagccaaggaatcctgacccacagatggttatggagatattaataaaacacgacatccataggagcaaaacaaaaaatgttttgttttgctttacattttaacatgttactactagaagtatttgaaagtacctatgtggctcacattatatttctattgtacaatagagcattatagaacaaagcatttagattaggtataggcaattgaaagctagatgtagaagccagtgggccttttatattttatacaaagaagtcagcatctgttctagtgaggggctaaagaaagctgaggcacaattctgaaactaggatgactcctagaaacacagaaaaagtgatgttggtgccagtaacagcttattatcttctcatggtgatagaattctgcccagcaacaagccccaccatatgcatagaactagtcagcttttctattcttggaaaagacctagtaattagatgatgggaaaagagatgtccgacaacaaagactatcatcagtggcattgaaaaatgaatccagttatgcatcagctatgattgcatagaaagaaaagtagtaacataaaaataaatgccactatagaccaaatagaacagtaatcctctatttaatatccttagagaggttcgagaagggtttgtatctgtaaaataagaagagtatattatgaaaaaggaatgatcatagaataagaaagagctcttggaaattaagcaagtatttactaaaactaaaaattgaaaggaagaattgaaagataaagttgaggacattttctataacatgaaaataaagaacaaagagatagaaaagaaaagagaatcatcttgggaagtataatgctttactaattccataaaatgctccagaaatagatgctatcatatgcatatcttattctagaaataaatcaatgcaaatctatgtcaaaggggggataaaaaagaaaaggtgaagttgaaatgctagaattgccctggtaggctctggaggaaagggataacagggtcaggaaaatgctagaatgaatattcaatgtacagttgaaagaccctgtagatgagtatgctccacacggaagccagaagacaccaaggccattatgtatgtgctaaaacaatgacacggcatcagtaaaaattccctgatagctctctgggcaagaaccagaagggggacaggctgttacagattgtgtcccactgatgtcagtgtggataataagatttcaaaatattaggaacaaaggggcaatgcgtcattgtcagaatctaatggggttgtacttttattttttggtaatgaaagctatatcagagtgataaacaagaaattctgacccacagatggttatggagatgttaataaaagacgacaccagtgggggcaaaataaacagactgccaacatgagtactactcagattttagcagcaaaagaactcaaagttagatgaccagaagattgagggcagtcacagcaataaaaattcatgatccctttcccagtttccagacctgagccagttttcagacaaagaacccattcagtgaagatgtggcactgactaggagtaaggactccacaattatatggtaagtgtacatgataatgattcctccagtccttccctacagggattatggccatttgattggggaaattaaatatctagataatttgatggctgttggacacaagatttaagttgaagttgatatccagagcccatcatcatggtctccttgttagagtagggcatataggggacatatgacacatgattaaattaagttgcggttagggtccatcttatagagtatctactaatggtcatctctcttgtcctcaaatgtacaatcaagaatgacacttgggagttggatctttggtcactggggtcagagctatcacacagcatgaggccaagtgaatgtccctgaacctgctccttccatccttcaacaaagatagcgaatcaaaatcactatttaatcctgggagtgggagatggagtcagaaattagtgccacccttatagatttcacgaatgtagaggtatttgttctcataacattattatttaatttactagtctgaaccctggaaaaacaagatggattctgaaagataactacaagcttaacccagaaatagtccctttttgcatctgtcatgccagatgtagtatattgctagagcagattaatatggcctaaggaacttggtataaagccattattctggaaaatgtattattttctatctcagtcagaaaagacaatcagaaacagttcacatttacatggattgaacaacaatattaatttatagttttgcctcagggctatgttaactcttctgccctctgctataatatagtctaaagagatctgcaccatctggataacccacagtacttcccattaatccattacatcaatgatattatattgatcatgccagatgagcaagaggtagctaacattctgaaggccttggaagaacacatgcattccagaggatgtgaaatagaacctgtgaagcttaaagggtcaggctgtccaaaactatttgaagagtcctaagtgaagaataaatactgcattttgtacctcctaacacaaagaagggaatacaatgtcctagcgggtatttgcattctaaaaggtaatctattcatttaatacttagaaatgtactagttgacacacacaaaaaaagttgaacaaaatttgagtgaaaccagagtagaaagggctctgaagaggttcaggctaaggtgcaacagccccaccacttggaccacgtaatttggtgaagcctgcagtgttggagctatcagtgatgggaaaaaataccatatgatatctgtggcaagtcctagtgaaaaaatcacaacacaggcctctacggacctgtagacatcatgacatttgtagcaaaactgtatgccctttgaaaaatatgtcctggtagagacagagcacctgaccatgcagctccaaacgatgattatcagaaattacacaagaaagagatacatttgagatgaagcatgagtgggacaggcagacataagcaagcaacatgagcagataattcagaaccccatggcagcactattgcaccagcaactcctcccacaaccaggtcacataggaggtcaggtatgaccaactaataaagggggaagtgattttaatttggtttccagaagggtttttttttgtatgtgagtgtgagccaaaaatggacagcagctacactatagacttatactgtatgcttgaaagacagtagtgagggaaaattatttcagtgagtgagggctttaggcagtgcaactggtcttctacttcatgtggaaagagaagtggcacagaaagtagccaagaggtggcctatgcaaatggcctggaagcaaaaggctagactgtcacagacaaggatgaatgaggtagaaacacatcgatggacctataggattgcacaaaatgagaagatctacgtattatatgttgatatctactatagaacacctgcaatgaaagaggcatttaacaaccaagtggacaaaatgatctagccagctactgccagctagccgctatcattgatttcatgagtgctggaacaatcagcacataaacaaagtgtctatgatgtcaaatatgaatactacacatgggtccaacggcatcagctcccacttgtcaaggctgatctagctcctgttgctgctcagtgtccaactgcccccaacaagctaatcctgagccctcattatggcatcattgcttgaggagactggacacatgagggcaggttgactgcattgtttcccttgcattctggaaaggtcagtggtttattctcactggaatagattcattccatatagagctttgtgtttcctgccatttgggcctgccttggccagttccactattaaaggctcacagcgtgtttgggccactagcatggaatcccattcacaagggctcctcttttacagccaaagaggtacatgaatggacttatgactacaggacccactagttgtattgcacactaaatccagactgctgaccatataatgtattagaaccgcctgctgaaagcatagctgaaatgccagattgcaggcaatagtctgagaggagagagtgccatcctccaaaatctagaacatgcattcaatcaaagacctttatatggtgctgcgtccctgttaggaagaatacaaaggtctaggaatcaaggggtggcattcctaatgtacctctatgtaaacatggaagctgcccttgatctctacaatgcatacttcggaatcaggctcaaatatcccaatgtatagagtaatggagatgcttcctccagagtcccaatttctgcatcattttttttttttttttgcccagaattaaacatttcttcacaggattatgaatagtgagacatccattcccttctggagaaaaccaaatctccactcaataaggtgtgatctaaatatgatcccaaattatttcaaagttgactttgcttcattccaccatatccatgataaccttgttatatcctttctctcattttgggtagaagaaactgtgatagggaattgaagttgagaggtaaataaacttttaatgtttagagaatatttgcttttctgtgtaaaaaagaaaacacgctttgcatttccaggtgatccttgctgccaaaactgataaaaattgacttggcaattttgataaattttatcctctattctcagcacacttttttcttacttcatagcatctcagacctgagcctgtaatctaaggacaggttacctaaatttcaagaaacttacagcttcacaccagagtttccagtccatgttttgtttctttttccatatttccagaatttttatatccttaagaaaagcctgtacagataaagtgttgagaaaacagtagcaatgatagcagatttaccacctgcccatttactgcctgcagatttacggccaacgccgcctattttgccatctgggtcaaagtcatattttcagtggaaatatgttggtaagttattgctggcattttttacatgcaggtggtgatcacacaggttttatggcactttcataactgtgcgtctgactgaagtgcacagaagctgatcttttgtgagtgtctacagaagcaattcaatgaaatgaaatgcagtctattcattacatttaccagtgtgggaggaactccttaaacataaaatataatcctgagaaaggtgccaagtcatctatcctgtttgtttccagaggatacattgtggtacacagaaaaaaaaattggctactcttgcacagtgaggctagtgataccaagagagtttcagagttgatggtagatatttgttcagaatagggcaaaacctagttaattttgatgcattagccactgcaattttctcaaacactttttttattgaaaatatgggcagttcatttgtttcttttgctaaatatataaatacattgtgaaggagagataagatcataaaaaaaaaaactggagagtgaaaaaggcatgggactcaaaatcagaagacctggattcttaagaaaattctataatgtgagagccatataatcttacccattatattgagcctcacttttctcttttgcaaatggagaaaggaggtgacaacagaaagtacatactttttaacatctaagtataatttacatgcaccaatccagccttaagtgttcaaagcaatgaattttgacaactgtaaactattgtgtaatcatcatccaaaacaagttatagaatatttccattcactccagtgcccctttctagtcagtctctgttcctctccacacatagaagaagcaagaacttctgatttctgttaccataaatagtttgggctattttgtacttcatacaaatggaatcatctaacttcttttgcccaccagaatgtctgtaagatttgtccacactgcatgtgtcgttgatttattcttagttattactgattatataatagtccaatacctgaataatcaacaatttacccatctattctcttatttatggatatttgagttgtttttagtttttgattttgtgaattagactgcttttgttattcatgtacaagtttttgtggatatgttttcatttatcttgggtaaatatctaggtgtggaatttctaggtcataacacagctgttttcaactttataagaaactaccaaactattctccaaaaggatggcaccattttaaatactcaccagtagctctaattgttccatatctctgtcaacacttggtattatcagtctttttgattttagtcattctgggggatgtaaaatagtatttcattgtggtttcaatttgcattttctagatggctaatgaggtagagcttcttttcatatgtaaatcacaaagaaattagatgtggtttaaatctccttcagaaaacagtctgagttctattctcctctgtttttaataggcattttacaactcatctgtgtagtttttaaaatctctgcatgctttggtcccacttctacacattttcattcagaagatttagcataagcctctttaaaatatgattctgattcacaaaggaaccactggattatgctccaggtatctgacaggttttcaatactactagtatgtttattatagcataaaagggcaatataaaaataattaagaacatcaactttataataaacaagactagatattgaatccttgtctgcacttcctctctatggaattttgtgcaaggtgtggaatctctctaaatctcagcttcttaatctataaattgagaggaattacaatacttacagatttatgaaaaggatcacatgtgattatgcatgtaaaatggttaccattcttcctaactcataataaacactcaatgtatattagaaagaagaaaatatgtatgtagatagatagatagaattatatagtaaagaactagctaaacaagttagaacgtctaattttagtattgtgacatgtatcccttttactactattatttagcctatcattcacttcagattgtctcccaaaacacctttcttacatcgttttacctgtctctcacatatagaattttcattgtcccaggtattggcattctcagctttcatacgccacaaagaagatgcatgatagaagatacgcctctatcggctgtttgatttaccagtgccaggtctcctggatgctctctggtttcctcccacagttccctctttccatctgatgttctcatctaaaattgtttggattttagtttctggattctcagttttcttttccgttccctgtatacattgaatgaacatatgcaatcaagtgtgttctctgtcactctgctctgtctttccctatttttcaactatgaatctatatatctctactccagtagcaactttcatgatgatagagttttgattatcacaataaagtttacttttcttaccacaataaccatgattctacctgctaatcattcctttcactaaatcttctctctctcttttaatgaaaatatatgtcactcaagactcattctggctttgcattttgtttgttttgttttacaatcagctgctgcttcccacttaagtgggtcttttttcctttacctgaacaatttgcaaataacatgatgcacactttctgaaaagagatataagtagatttccatttccttaatattatatgcgagcctatggaagtaaggaagaaagattcttcccctttttttctgtgtaaagaagtgtgtttgcactgacttggtttgaacctcacaacaaagtttttgttattcatttgtactaaaatacacattccaagaaaaaaattgtttttgaattgttaaattttcacttactgacaagggcagggatagctagttacctacataattacatttctaaaatgttaaaatgaaatgactccttttatggaatacattttaatgcatttgtaagaccaggggataatgacaaaggtaaaaagaacattcattaaactaactggggagtggtaagcaaatagcattttattaatgatgagcgtcaacatttctctagtgaagaaaggtgaaaacaactagtgttaaataatagggcctttagcaagcgattgcttttaagcttatacttttgctaagagcagttgccactattggcttttctcctttcacagtggtttcccaaaacatgagacttgtgatgaaatccagtttggtatggcttcccagtaaatagccaatgactttgcagaaaaaaaaggagcttttttttctattctattgtgttctgttttatgaaaaaaaaagagggagcagagagaaaaataaaaagtctttcctttaaaaaaatataaagctttttactaccaagagatagaaacaatctcatttaccattgatgggtaaaatttgatagattgctgataattctcaaaagaatgactagctttccatttgccaagtaaattaaagggtctacgactcttaccaacaagaatcttgtcacacaactctattcaatcaatgaaaaagctgactctcggtagataatcactctttaatctctaatgccatagatttttccttacagtttgtgactcactgttttcatggaaaatacaaaaaaagagaagaataggaccagtatttgctgaatccctttcctcagtgtctcatgttttttattattgttctcaactgagaaaatacagaaattacaaacaaacaaaacaataacaaaattgctttctaaaacatttgtttccaaaattaactagataaagacaagaatgggcaacacagaatttttgcttttttgttttttctaaaattatgctccctccttggatcagaatttttatgtaactataccgcgagagagacaggtatgaaaaaacagcatgatatcttcaaggtttttttctttatcccaattgacccagataaaaaatacaaatcctatgtcaatgataaagatgtaaaaaagagaaggaaaaaaagaaaatggaaccaaatgaaacgtcaggtgaacagttaagtaaatacgtatttcatttcttatagattctgaaagaattcaataatttctttaaaacacatctaaaatctcagaatcaactgaagagcagcatttgcttttaaagccagagggatatttaaattacagaattatcccatataatactgtgaaataactgctatagtagagataggaactgaatattttggggtaatgggaattgaataaataattagttgctcttgctctgtattgtaattctttacctctcttattctgcaatgaagctgtggatttcagagaaggaatgtttttctttatgtccaaagtgtttagttcagttctctgctcaatgttagtattcaataaatgtttgaaaattgtttttatccctgaattagttctactcttcatcctttcatatggaaagcaggggtaggaataggaaaaattaaggaaaaggatataataaagagaaaatagcacatgtattttaggttcctgggagcaagtcagaaacacaccctgttgttgctatataggtttttgaccttttgtttttctcccatgacaaaatataggttctctttcctttcttatttttcctttgtctcgctctctttttctttctttcatgttcagtatacaatccacacagctcctcacaatttcactgtcttttcactcttctaatgagtatgtgggtcatgtctgtgggatacaagtccacattgttttgtctttcccagtaacctatgcctattgccatcagagaccaaattcttgagtttctaactttctagcaaggtacacctgctgtcctgcactccacaggagctgctgtttgttctgattctgtgtcattatttactgcctgcagtgtgagctctgctccttcaaggaaaaaaaggtttggcttatgttttcctcccaatcaatgcacaatgaacactactgacggctgagccatgagacaaggctgagggcagagagtcaagggcctgtgtatgtatttcagggcaggttcatttcccagggaaaaaagaggaaaacactatcacgtttggaaattgtgtaacatccatatagtttaaccctccttttcattctcacagtctattgctactatctaaagtctgaatccaaattaagttggcagggaaccttcaatatactttgtgattttttaatagttcctgagtttgcaggatataggagtttttctggagttggctattatatgaaatcaaactgaaattaattagtattaaatcctcaacgttttttgttgtatcatattttcctttgagttttttttcctatgaaaaaattaaactgaaatcttcatttcttttgagatttaacagatattggttccagcatatctctggcatcaccaaccagtaagtaaaattatgttccattcccagcaatactccaaatctcaatgcaataagctcctatcaaactgatgaggcagacaaccagtctttttcagagataccacactccaattatttccaacagggggttctgatatataatcagagctgctgcctacagctctgcaatacctcaggcctagactctaaggtcccgaacacccgtttggtttcttgaccgctgtagtccagcccataatttagtgctcacttctaccaaaatcgaaacgatcaaagctttcctctctctttagtcagctaggaaaaacaaaaaacaaaacaaaacaaaacaaaacccaaaaaacaaaaaaacgtaaacaaaacgaaacagaaacaaaatataatacaacaacacaatcaaaaaacgctgttccctttaacaagctctttcagagattttcacagcatactcttatggtccacagtgaaatgtgtagttccatcctaaatattgcagcacaatccttctcaaggtggtttggccagggaactgttaggcacagccttttattacttaaaataactacctcccccaaggtgtttgcatgtatagtctgcctacctttaacagatttctttactcactgggaattttttttcagtaacctcattaatcctttcctctggtctaatcttctttagggacactagcccatgacaaaagatttacacaaatcggaccccaattgtgggctaaattcaaattttcttccacaggactctggggcccctatagatcaagaaataggacttttcatctttatcagggtctccaaacatttcaaaacctcaaaagatctctggggcagggatggtaaagtgttactgcagtgttacttttatatctgactcatttatttattatttcattcattcatatagcagacatttcctgaatatctacttggtgttcagcattgctctggactaagttgaaaaagtgttttctataaaaggggctaatagtaaatattttcagctttgtgaaccataatatctgtcacaactattcaattctgctattgttacaaaaaaaccagtcataggcaatatgtaaattaatgggagtggctgtgttgaataaaattttaattaaaaaaaaataggccgtgcgtcagacttggcctacaaatggtaccttgttgattgcattcttgacactagtgataaaccaacaacaacaaaaagaaacaaaactccctgctgtattgtaacttacataccagatatgtaagtaaagcagttagttcaatgttagtaagagtcaaagaaaaaaacagagccagaaaggaggatagggaataaacaggtaggtctgaaaatacccatttcattaggatactactcgactttgttccacattgaaatttccctctctcagccactttgtaaactttgtaaagtttagattttagttgttataattcaatcattcgttcagtagatattcacttagtattcattacatgccataaatattagtatttatcacacgcaatacataacaccatgtgttatggggagacacaattatataagccaaatttcctgcttttaagatcacaccatagttgtgggaaaaaaaaaatgtgtaccatttggagataggaattcttggaatatgttaaactgttagattagaaaacgtttctaaagaccagctcccacatttcttaatgtagccttcaacatgagtccattgcatgaactaatgaaaatagaaactatagtagccttctttgactggatgggtctatgaataaagatgtaaacagaaaaacagtatgctgtcttttaggacagtgtcttttaggacagccagttgttgctgggacagacactggaaatttcatgttcattcaaatcaccaagtactcaatatcactgtgtttggcactatcaaaggatcaaggtgggaatacaatgtggtttctgcccctagggagtttttagagagaaaaaaattgcaaataaaggtgttagattgtttgagtggataaaagctaccctagtttggggtcattcatgttactcattatattcctcatctttacatacacaatgtattgttaaacttctattctggtttagagttaagcattttaaaaagggaaaaatttatacctgacatgttttcatggagaacctactgtgagtcaaatacttctgggcacatggggttataagatcgggcatgaaaaattgttttctgtcatcagagggctcattattgtgtgtgagacacaatcctgtaagcagacaattacagcacaatgcaatagttgctgtgacatactattagtggatgctacaaaaacacaaaggatgtgaatattggctagaggacagtgggaggatcgaactcatgttggtccctggggatgtaggaggatttctatagagaggaaagaccaaggatattttgggctgagacaaaaagaaaaaaaaaaaacgcaatgaggcaagaatgagcatactgcttttaagtgtggtgtctatggagcactgtgggctgagtgggagccctggtttgaaggaagtagggagtactgactagaatgcatttttttaatatggtaagaggaaacaactctgggttttgaacggggagtaacagaatgaaagtaggactttaggaacactggactgatgtaagtacgcaagatggattagagatggtagagactcgagtgagaaaaatcaactgagcacccctgcgataatcataagcctagattagtgagagagtaatgggaaaggagagaagggcagaagctgaaagacagttcaaaggaggaaatgacaggactcaatgacagactgaatactaggtttgaatgagagggaagaataaaagatagcctggaagaatagtgataccggtgacagaatcaacatagcactatgaactgacaaccagacgatcaaagtgagacaccacttgtgccatatgtctgaaagctcttcatcagagatacaaagctgaaaggaaggttgtctctagatttttcttgctcaggagtatatgggtaaatgatgaactcttacaaaaagaagccctctaaggcactagctgatgtgacctcatgtgtcaaaccaaattaaaggcccatagagtgagggtcagctctgatgtctgtacaatttagaacagcaaatagacatcaggttctccttgtgaagtctcatccaggtcacctataaaccataacaaaacatcaaataacaatagttggtaggtcctcagtaaagatttgttgaattggtctgaggataggggaattaacaagaagtcagtgaagagctggtctacctctttaacattggacagagtggagaaataacaactttaacaaatcacaaagtcaaggcccaattaggcaaaatagaatggcctcttctgaaactcaggtgtaaagtgcattgccatgattacataaggaatcatggagaatttcaaacagggaagcctgttttatacagaatttgtttctctactgaaatggttagctttgactgtgtagtgttgactacaaattacatgttaagaacagatagtattattaaacatctagctatctatatatttgggaactcaaaatggaaagaatcagttatctgtgatgtcctgaagtagcactgatacatagaaagaaaaacatcatgaaaaatagatccataaatctaaagttgtgatacagagagaatacatttttatgacttcattcaaccaataaggaaaaattacgttttcttcaatataggctacttttttttgagatcatcataaaataaaattgctactttttgttatgtatttacttacaataatagaaatataagtcaaatgcattatgaacatcattttttaagtgagaaaggtactttttgcacctggcagtaacaagatgttaggactttgctttgcaatagtaaaatagaaaaggattttgtaaaattctgagttagacactattgtttcctaaagggaaataccactaactactatcagtggtctcttctcaggagttagaaaggaaaaattatatactgtgaaagaagagaaaatttatttctccatggttggtcaagactagaattctctacagagagaatctttctggggggaaaaaagtatttttatgagctggaagcaatggagaaggaagcagagaagcaaacaaaacaaatgacaaatgcattttgagttggtggttctagcaggctggtacttagtgtgattccctattctgtctccagcaatacaaaagctgggtcagtctttcagcacttgactcgggcttctgactgcactagacctgatgttgcaaaccagctgcaccaaatttatattgtgttttctatagagtgagctgaagcaatttggttccaagtgccattcttcatgtgcttaattattttgacattattttcagaactttatgttcatttccctttagaaccagcgcactctcactgcagcataagcatagcatttaaactaggtttccaattagtctgcatctttatgaataacttgtcttgctctgcctaaattattcagcttagagttgtttctgaaatcatggattatttttaaattaattgcataatagtgccaagcacagggcctagcatatggcagacaattaataaatgtttgttgaacaaataaatgagtttcacttcagtcttggattttggcctaccttttcacaatgttaaccaaataaactgcattgtattggatgtgaagccacctacattgatactggtatttgattcataaaacttgctttgattcatggtttaaggatttgaattgggagtaagaagaaattggtatctagctattcacttactggtatgatggttatttttacctgtcaagttcactgggccatggggtccccaaattaaatattatcctggatgtgtcttggaaagatgtttccagatgagaatagcatttagatcaatgaactgagtaaaataaattgacctccccagtgtgggtgggcaccatccaatccatggaggacctgaagagatataaaggtggaggaaggaggaattcaccacccacccccaccccctgccaaccatttttttttcctccctcaatggttgagctgggacatttaatctcatttactcctgccctcagactgggttttataccattggctccactggatattatactttcagaatcagagtgacttatacaactggctttcctgggcccccactttcagaaaacacattgtggaaattctcagcctccataattgtgtgggccaattcctactgattgtgcttctcaagagaatcgtgaccaatacagctaacaattgtttatgttgttcccttctgaacaggaaaagacctggacttaaagttatacaacttgggagtaaatattggcttctagccttgctatgttacaataacagagttttgttatttttgaaatggtaataatgcctgccaaacaccgtcgttttaagattttaggagatcacacacacacacacacacacagcagttatctgttgctgtatatgaaaacacccaacatgtagtgacttactcacttttgctcacaagtttatggaacagctgggcagttctgccaatctggaccaggctggactgattacagctaggcttttttccatggtctttgcctggttgttggctcactcacatgactgacagttggctggctgccagctacaatgatggggttaatagggttatgtgtttctatctgtttttctacttatctcatagtatggcagatttcaagacagagaaaaataaatgtccccagttctcttcaaaacaaaactctgaactggcatcatgttttttctgccacgttctattggtgaaagcaagtcacaagggcagccaagatttgcagaatgggcaaacagactctatctcttatctggaagaactacaaagtcacattgcaaagttttgaggacaaagggagcattagaaaaattgtactcatttttgcaatctaccataatataaaaaattgttaggatatgcataagggcaataaatcagattttttgttattactgtcctgcaacctctctacttccttattatactttttctttcactctcaccttcattttttgtttgcaatttcatggttctaacaaaagaggatgcttagtattgattaacaaaatgactctagttatttcctgtcagtcccccaacctatgtatatcaagaagtaatcacaagggattgcttttgcaaatttcttgaatcttgcagtttctgaatctttcagttccctattgcaaccaaggaaggtatagtagcatcatggttaaagaaacagtctctagactattttgtttttgaattatgactctatcaatttggaactatgtgactttgtgctaggaggtttatcactttggtacctcagttttcttgtctgtgaaatggagttagtgagatactaaaaagattaaatgagattgtacactatatatatgtatatatgcctagtctatagtatgtgtgtgtgtgcacatatgtgtcttttatatttaagtaattaatttgtttcagtgagacataaaatcataggaattctggcctccctggtgattagcagataacaaggcaaagctattgcagggtggctgatcaggctccctcattatctcatactgcctctaccccctaatctctgactatgtactgcatgttattgactttggagttaaacccaaatagacaaaatccaggcatgttaaatctacactttattttaaagaaaatgttaggcacatgagaggcatttgggaggctgaggagggtggatcacctgaggtcaggaatttaagaccagcctggccaatatggtgaaatctggtctctactgaaaatacaaaaattagctgggagtggtcccgggtgcctgtagacagaattgctgcttgaacctgtgaagcagaggttgaagtaagccgagatcgcatcattgcactccagcctgggcgagagagcaaggctctggctcaaaaaaaaaacaaaaaaacaaaaaaaacaaaaaacaacaaaatatatatgtgtatatatatatatatatatgaagtcggtactcttactcttagcacaggtacagcttggggaaacaatgaaacctgctggaacattatttcttcctgtgtatatcaagacaacctaagaaagaattgggactccggcgatttcagttttaaaacagaaagaaaagataattcctataaaaaaaactcactctaaacaaaattacacttatatttttgccagcattttatgtatgcagtactccttgctattgttaaataaagaacaataaacaaaacctaaccatgattccttaactgccatatatttttacccgctactacacttctgagaaaaagcatatggcgaagtcagacctcatgactaaatacccttcagaggcacataactacatttaaagacatttctaagaaaggaaggaaggaagagaaggaggaagcaagagaggaaggacaggagggagggaggaagaaaacaaaaaatcaggaacagaagttgtacctcaatgtattcagcaaaatttgaattctgccagactcttccttgtattattagtatgtgaaacaactaactgatctaatgctgtttaccgtcaagtcacctcttcctctcactttgcatctctgacaaatactagcctattcacaagtaactccatgattagcaattccaagacagccctgtgaccctgttttcagattgcttttgaagagtagctgataaaaatagtagaaattatgactatcatttccaaaaggacttctctatatgcctgacactattctaggcatgttacttatatcatcctcgttcctaacaactctctgacaaagtagatattattcctactttgcatataggagaggttcaagttggcagctgttaagaggaggatctaggattcaaatatagatccctctcattccagaccttgtgcttttagtgtgaaaataacttgaacactgacatggtatttctctttagactttttttgttgccgttaaaatacattttgttgatgttaaatacattcattttttgtcttatccagagcattcagtcacgtttgttgccctcttgttaactctctccacattctctgcatcactcttttaataactggaccctgattgaacatagcactctatctaccctataataagtaaagagtagataatcttatgttttcaacatgaaatgttcttttaatattcctccatttacaatagcaatcccacctcccaaaccgccattagcacaaccttaattaacatctatttaaagcagtaaagcaaggtccatgaaatagatattgagctattgttaatcactcacaattgggtactcacctaattagaacaaatactaaaatatataatctagttcccttatttctttcctggaaaaatcaatgaaaagtacattttaaaagtaagataaatttgtattcttcctgatgttctaactatattaatgccagatctaagactattaattaagactgacaaaatgtatttttctaaaagttttataatccctgataacatcccatttgttcacattgtttgaggtacattgaaaaaaataagatcttattatcccagtttctagggtctattgttttattttcatgcaaacatagtacataattaaataatgtattttgcctaaaagttatttagaaaatcgttagtatacgcttttgagaaaaatttcacttttcaagaaaataaaattggataatacaaataacccagaggttagacgccaaaggcaaactggcactgctctgccacatggctcaaatgcagcataaaatatgttttaaatataaccatgtaagaaagcacatccttatataatttgggagctatatatactcttttgggaattaattatcaaattataaatgatctctttctacagaaagatgcatttaaacatctattttaaaaatgattagggaaaatcactactcgtgccaagcaaagaactcctagctttgactaaggtaaaagtcattgatacattaaggtgttgataatgccattagaaagttcttaggttttaataggttgcatttagtttactgatcagctaagtaggaaatataaaggcatattgcaagtctttggcagtgagtgtgaagtgctttgtttcattcagagtagtcttgaactctactctgttaaacatcttcataaatgatatgcagttggttgttaataacattatttaaattctcagatgagagagtatatcaagcaataagacatcacataatagtacaaaaagcctagaataaatggcctgaaattaatcaaatgagatttaatctggaactgcaaaggccagtatttgattaaaaaacagatccaataaaagttgaagtaaaattaaaaatcagtttcaataaagagatattttgaatagttaatataaagttgatttgatattctgtaatggagtttgagaaaatgtaagctgtttttaaaacaggaatgaacttgaagttcttatagtaatcatcacctagaaaatttgagtgccagctgaccacattgggaaagttgaaatgctgtgtgcatatctgtgcctcagcaaaacttctatgatcatcagacactcatccaatagaaagaacaaggggtcccatgaagaatccttgaagataattgagaaaaaaaaaaaaagtacagctggctgaaaagagaccagactttttttttttttttttttttttaagacagagtctcactctgtcagccaggatggagtacagtggcatgatctcagctcactgcaacctcctcctcctgggttcaagtaattctcctgcctcagcctcccgagtagctgggattacaggggtgagccaccacatccagctaattgttgtattttttttttttagtagagatggggtttcgccatattggccaggctggtcttgaactccggacctcaggcgatccacccacctcagagtcacaaagtgttgggattacaggcgtgagtcaccactcctggccgagaccagacttaggattaatttcaacacatccttcaaaggcaccagggctttctaaagaaataatacaaattaaaattattgaaaataaaatcaagagagcaaaaagtagtggcttagatagaggaatataattttgattgtgatacaacaggctgcttcttcatttgcagagttgggcatattatttgcaaatattccagaggattttattttaaccaggacatttaaactactcttcataaagcaatctccacccttatttctgaaaagattttactatgtttttggagaaaatctattcacttcaaagtgcttcttttgcagtagtcttagagctttcacattgtcattctttgaaggacatgctgaaactcgagttacataattacagctttacaaaataagtcctctattttgagattcttagtggcgatttcttcttactagtattagaataatggaaacataacatagctgcaggtgacgatgtaaaatagataccaaacaataatgtaataaggcttttccatttttatcaaatgtgattatatgcattatctccagagcggatttctctttttctgtcaatataattcctggaagtgcttgctttacaggactatagaagtgggatcagtttgagtttccctatcatacctgatttaagtgaatcagtaaacattgtacatcaaaaacatctgtaggattatgaacagtgagcaaaatatagttcaacagctgcaaatatgcttagaattgtgctgccataaacactctaaagtgttcagaattaccacatcattagagatatgttaaaagtaagtatttgtatgtgttccaaagttatcttttatttcatctctagaattgaaaaaaaaagatatatctaataagtagatacacccagttattgtggttccttcaagggtctgtgtcctttgcctacatcattaataagtttctgtggtatatcagatgtggaaacaaaagctttattctctttctccattgttatactactgataaatggttttatattcttagcttaatttttattttaaaaatgtagacttcactctactatataaaagttatgatactcagagtaatcaaaacctaaaaagttccagtggataaatgaacatctgggaaacttggaatgctataaatagttttgtgccacaacaaaacctgtgtcatgattaattttatgagtcaggttgactggaccgtggtacccaaatatttggtcaaacattattccagttgtttctgtgagaatgttttgaaatgaaattaacatttaattggaaatattttaaataaagtagattgccttttataatataggcgggccccatccaatcagctgaaggccagaatagaacaaaagattaacctctccatgcaagagagaactcatggcgagcagcctttggtctttaactacaacactgttctttcctgagtctccagcctagcaggctaccttgaagattttggacttgccaacctccacaatcacatgaaccaatttcttaaggtatatctctttctctctctctatatatatacacatcctattagttctattcctctggagaaccttgactaataaaacctgcaggaccatcaggcagtcacccaatagaaggatcaagagatcacatgaagaatcctatgagaagaggataatataaaacatgaatgtcttctcaatttctgcataataacataattttcaaatataaatttacatataaatctattttattttcagatgacgttaggtctcctaggcatgggaaaatatagttacttgctataattccagtattcaataaacagctttttaaagtgtataaccaaaaattaaattcgatttactagttcattgcacatcatgttgtcaaaccccaaatttgaaagaccgatgcatagaagcatttatcctgtgtatagcaacaattatctagtcgcaattgtctaatcgcatcctgccttttcagttatgtttgtacatatttgtcccccactggggacaaatacactgtcatgtcagtataatgtggtggttatgagtacccattctgcagccacactggtggaaagattaggtagcctctcaaaccttccagttcctcatcttcagaataaaaagaaaaatctctacttcacagcatcattataaggataatgtatgcaatgttcttaacacagcatatcgtagaaatacaattcttgcttttagtctctttaaaaggcaaggatagtgtcctaaaagaaaagaatacattttcttcccatagattacctggtttagtgctttttatattgtcaactagttggtaactattgacagtagttcccaattattgtgtgttgatgatatgctagattgaatttttaaaactgtctcaaaattccttcaacgtaagtatcttcatttttggatgaggaagctgaggctctgatcacacactgctacttagcagtagaggcagcatttaattcagttctaaataaaaactgtgctcattttgccttgcaactcattgtcattgcctattagatgattggtaatagacatttgttagctcagaagtcacatgggaagttcccattgatcatgatattctgtccttttatttccttttcatgctgcttgacgatctggctttgtcacactttgggagctagaagcctggctattctggcttgttagacagtggaatagagtgaaagggaaggttatgaaagtgtcttccctggtgattcttttgaaggggaaatccactacctatccattgagcttaatttttagattcatcatgcttagacaagatacaaactcatcatggacagcatctatctttcaatgtctgtttccaggaagctggagatacattttgtttgttctgaagattctttaagctccttaagtctaggatcttaacgaaataaggagctattaagaaatttctctaaatctttaaaatatttttcattatagttagtaaataaacagtatagatggagaaatgtcttcatctatactgttaaacatgtcttccaatttttcatagaacactttcttgcatgcattttagttacagcattgttgcagattttgtgtgaaaggaaatcttgaaaacattattctagttctaaatattaattccagtgggcagtgatttcctctattatcaaacacctttcaaattcgaggaagtaaaacatttgatttctaagatgtgcctaacaatgttatcattaaattaacatcattatcgtatatcttaacttagcaagctctgttatggagtctataaacatcttttgcaaccaaagaatctgtttttctccaatacagaatgttgtcaccaagttaaaagtgaaaggaccctattatcattggggagatagaggattataacactttcccatattcagggtaatagcactattttttaaaaaacttaacttctttgggcaatatttctgcctttttgattttgtgaaattattttacatttttaagggaaagtaatcatggcattgcctcaagtgtcacatcaggtacatccaaatggcaaatgaatgtcgttatagtgcccattagggaactcactttgattaaagaggacatccatgcccaaggacagcggctgtcattagtctccaggctgcagcaacatcctatttgtggcaggggatggagaaaggcttgtcctattgcacagaaacaggggctctctagatctttggagataaatagacttagctatggaaacagaacattaaattgaaaggcaagccaataaaaacaaagcaacttgaagtatatctgggtcaatttaaaataagtccatttcccattaggcaataagagaacagaagtcgaggctattgactcctgtgcactgaaatggtatcaaaccaggtgatttttcccagttacgtgctgactgagacaagtccactaagcaaggggttgtcaaaggccaggtctgtatcctctatctgttcctagtgttagaagggctttatctcagaacaaaatagattctgaaacttaagttacattctgttatcacaggagacagttgataacaattggggtagtaaaacattcgtaatagttttaaagatgaaatgagaagaaaatagtctcatcagtgagatccaaaatgaactccaaagcaaggacttatgaaaataaattctagcttagcatttaaaaaatctgaaattgacctatttttatacctcattgtttttctaattaaaaaggcatgagattcattatctattatgaatagaatcgctccattaattcaatattctagtgaaatcttaacatgtctaattggcaggaaatgtaaagttcaaaatttgtggacatgacagcatgctagggatatgaaatatctctctccctacatttgtttcagtttctccagaaaaccaggctagccttcttttaattgaactggagagggaggtaaagagaggatgtcagaccaatcccaatgataagtgtcacatccaattgccacccttaccagagggaataaaattaggttaaggggacaggttctgtatttttaaaaattacctgccatgtatttttccccaaatgtcaggtagcagcctctattagaggtataccattaatcaaactaatgagaactatggatgtaaccatcccttaacaaagacataatgcctcaatggggaaaagagcagaatgcaagaattttatgaagtgggccttcctttgtaaacacttgtgtttgaatcacaccatagtgtccaaatcagggcctcctgatcctgacaacagtgtttaatgttccctaacagagagggtcataatactgaatcaaaatcagttttacttatggttttaatggaaaaaataacatttgatttgccacagtaaggcatttcaaagccattcttaatgacctaaatcttactggtgatccttcaggttttgaagaagctgctgaaaagagaggaagtatttgtaggaaactacaatcctgccaacagtgttcacatggaagctgtccttgacccgtttgcacgtattgaaaccactctgagttctcctgctttattgttcaatctagactagcaggaatggcataaaatcaggatactacgcctcaggcttgataagaaattagtttctcaccagccttttcaaacagctcagggtgacttcagtagaagagagaagcaaagagtttggagattaaaggaatgagagaagtcagatcactaacacatggtgactggccttggcccaaccccaggacagagattgtcttgtcttcctagacatcctggtggacatccttgaacagacaggcctgcccagggggactatccaggatatagtcaagaaagtgccttctataggagttcagatttgcagacagaaattatttcaggttttgaacatatatattaaaatgttttcttagtatgagttaatctgaggtcaaggcaaatagaggtttaatgttaggaataatagacaatggttctttttcaaaccaatcagaaattgttcttaataaataatgacttacatcattttaattgcacagtatgcagtcacaaggaaacatttcctgtgttaatttctacatagcgctcagagagtgtagcttaatttttgtttttatttttgataaataactatagaattttatatatctacacagaatatatttcataaataagtgcataaatatgaaagcataaatagtaaccaatttgtgcataaataagaaggcataaatcataatcaatttaataagtaattaaagttattattatatttaaaaatcagatcttgagatgggtaggagatggtaagaaaaaagaaacaaagtcccacataatggactccatgaagacttttgttctcaggggaaatcaggctgccccaatttcttcaccaagtatcaccaaaattaagtaatactaatgaaactaagtacttagaaataatatttattgagcactgactatcatgtcctattctaaacacttaacattcagccaattttcaccacaaccctacaaagaggtactcttcttatctccacttttaaacaaatgagaaaactgaggtagaaagagagtaagttgatccaattcacacagcaaaaaggacaatagagccagatctatctatctatctatctacctacctacctacctacctacatatctatctatttatttagagatgggctcttgctgtgtcactcatgctgaagtgcaatggcacgatcacagctcactgcagcctcaaactcctgggctcacgggatcctcccacctcagtctttcatgtagctaggactacaagggcatgccacggcacctggctttttttttttttttttttttaagagatgagggtctcactatgttgtccatgctggtctcaaactcctaggcttaagctattctcccaccacaggcttccaaagccctaggattacaggcatgggccaccacccccagccaagagccagatttaaatcatgtggtctgaccccagggcctctgttattctctctcctgccaacctggaagccagaaaggttgttattctcttccttactctagggctgtcctctgaagttgagctgaatggaaagcaagtttcccccccaacctaataaaaattctgctcatagagaagtgtttaaatctgattccttttctaataccaagtacctaggagtccgattagccacatctatctaactcaacaagaggtcttaactacttgtatgatttatctcctttgttcttcagcactacaaatacccacccacccacccacacacacacacacacacaaacacacacacaaacacacacacatgcaggttatggaagtaaaaagattgctgacacattttctaggaattgtttcctgggggaaaaaatgtgaataaatagtaaagctgactctctcatcctctggtttcacttcatcccatacccttgaagaacccagaaattccacacatattactttctagctgttctctcttttctttaccaccctatatattgtcttagtccattcaggctgctgtaacaaaaagccttagaatgggtaacttagaaatatatcacaattctggagactgagaaatgcaagatcaaagtggcagcaggctctgtgcccggtgagggcctgttccttataggcagtgccttcttgctgcatcctcacagtgcggaagaggcaaacaagcttccttgtgcctctttgataaatgcactaatctaaaccatgagggctctaccctcatgacctaatcacctcctaaaagacccatctcttgatactgttacatttggtattaggtttcaactcatgaatttgctagggacacaaattttcagaccatagcacatatttaaacatttaagcattgcaatgttttcttctcccacagtacttactctccaaaatgaattcttctctttcttttcacattactactctgtataccactccaatcaaatccccccatctcacagtatagaccatttgactcaagttggctttggatatcaagtcagaagcactgaggtcaagaatattttattacactggggaataaggcctcatttcatcccctctgctgtgttgagatgaactgttcagactgtttattgatatttacttaatgataaatagaaattgcatatatttactgtgtacaacataatgttttgaaatgcaggcacacctcattttattatcttcctttcattgcactttacagataatgcatttgttacaaactgaaggtttgtggcaacactgtgtccagcgagtctatcagcaccattttttcaacagcatgagctcatttcatgtctctgtgtcccattttggtagttctcataatgttttaagcattttcataattattatacgtgttttagtgatttgtgatcagtgatctttgatgttactcttgtaattgttttaattgttttggggcaccaaaagcagtgcccatgtaagatggcaagcttaatcaataaatgttctatatgttctgactgcttcactgactgaccattccccagtctctctccttctccttaggctttcctattccttcagagacaaaaatattgaaattaggccacttaataccctacaatgacctctaagtattaaagtaaaaggaagagtcacatgctttaatcagaaactagattgattaaatcagattaaatcactttaaatcagaaactagaaatgattgaggttagcgaggaagacatgtggaaagccaagataggctgaaacctaggcctcttgcaccaaagaattaatcaagctgtaaatgccaaggaaacattcttgaagaaaattaaaagtgctactgaaatgaatacacaaatgataagaaagcaaaacagccttattgctgatatggagaaattttagtggtctggatagatcgaatagccacaacagtcccttaagccaaagcctaatccacagaaaggccctaaccctcattaactctatgaatgctgagaaaggtgaggaagctacagagaaaaaagttggaagctaatagaggttggttcatgaggttcaaggaaagaagctgtttccataacataaaattgcaaggtgcagcagcaagtgctaatgtagaagctgcagcaaattatccacatgaactaaataacatcgttgatggagatggctacaccaaacaaccgatattaaatgtagatgaaacagccttatattggaagatgtcatctaggatattcatagctagagaggtcaaaacctggcttccgtgcttcaaaggagaagctgactctcttgtcaggggctaatgcagctggtgactttatgttaaagccaatgctcatttaccattctgaaaatccaagggcccttaagaattatgctaaatctataccacctgtgctccataaaggaaacaacaaagcctggatgacagcacatctgtttacagtatggtttactaaatatttaagcccactgttgaggcctactgttcagaaataaaattattttaaaaatatcactgctttttaacaatgtacctggtcacctaagtgctttgatggacatacacaaggagattaatgttgctttcaggcccactaacgaaacatcctttttgtagcccatggatcaaggtgtaagttcaactttcaagacttactatttaagaaatatatttcatggccaggtgcagtggctcacgcctgtaatcccagcactttgggaggccgaggcgggtggatcacgtggttagttaggagtttgagaccagcctgaccaacatggtgaacccccatctctaataaaaatacaaaaattagccgggtgtgggggcgcacgcctataatcccagctacgcaggcggctgaggcaggagaattgcttgaatccagaggtggaggtttcagtgagccgagattgtgccacggcactccagtgtgggtgacagagcaagactctgtctcaaaaaaaaaaaaagaaaagaaatacatttcataatgctatagctgccacagacagtgattcctctgatggatctgggtaaagtaaattgaataccttctggaaaatattcaccattttagatgtcattaagggcattcatgattcatgaaagaaggtcaaaacatcaacattaaccagagtttggaagaagttgattccacccctcaaggatgactttgaggagttcaagacttcagtggagaaagtaactgcagatgtggtgcaaattgtaaaagtactggaattcgaagtggagcctgagatgtgattgaattgctgtaatctcatgataaacttgaaagatgagtttactgttacggatgaataaagaaaatgatttcttgagatggaatctactcctggcgtagatcttgtgaacacgaaatcacagtaaataatttagagtactacataaatttatttgctaaaatggtaccagaatttgggattaactctaattctaaaacaatttatattggcaaaatgctatcaaatagcattgaatactatagagaaatatgttgtgaaaggaggaagggtcaatctatgtggcaaacttgcttgttttattttaagaaattgccacagtcaccccaaccttcagcaaccaccccccatcaacatggaggcaagatcctccaccagcaaaaaggttacaacctgatgaaggctcggatgattcttagcatttttagcaatatagtattttttaattaaggtgtgtacatttttttagatacaatggtactacacacttatactctacaatatagtgtaaatataacttttatatgcactgggaaacccataaaaatgtgaaaatgtgccaccaatttattgcaatatttactttattacagtggtctggaaacaaactggcaatgtctcccaaatatgcctgtatgtatactttatggaatgtctaaacaaactaattgacatatccattacttacataccattgtgtgtgtgtgtgtgtgttaagaacatttataatctactgtctttttttgtttgtttgtttgtttgtttgtttgtttgttttgagatgagtttttgctctgtcatccagactggagtgcagtggtttgagtttgactcactgcaacctccaccttttgggctcaagcaatcctcccatctcagcctcctgagtagctgggactgtaggcatgagccatcatgcccggcaaatatttatatttttgttagagatggtgttttgctatgtttcctaagctggtcttgagttcctgggctcaagcaatcctccctcctcagcctcccaaagtgcttggattacagcacgagccaccacgcccagccaaatctattgtcttgtcaagaatatgtcttaattgtaggtcaaaataaactcctacacggcccttttggaacattttatgctttacaaattaaaatttctgctaagtaaatgagtatgtatcagtgattgtatgttattcattcatctcatttattttgggcagaatgatgagaaattatttctacatacttttgctttttattttgtaatgcttttgtttttcttgttaacttgggaaagagagcagttaagtggaaaagatttggcattgcctcattcagatgctccaatatttaagcaataatgtatctagggaatacaatattatttattattttaaggtaccattatctataaagactctaacactggtttttggaaatttcctcactaaaacatacttaaaaagaagcccaatcctgaagcactcaaggctgagacttttttgtgtgctaggaatatagtttacagtaacttctgattcaggatttagaaaagggtagtctcatggaccatgtgccagactacctgtatttatcaaaatcatccacctctgatagtttcaagatgagcgtgtgtttcctgtgggcctttgaaagtgctgagttgggctctttgagtagagaaggatttttcctaacagatagctttggctatctacatgacagcaaaggaacattttggcaggaaaccacacaacgcagcagaataccctggtttgaacaaaatgtttttatgcaatgtgttaccaggggaattggttttcatgttgatattaccgcccacacaaatgatccctggtttatttcctaaccagatgatttttttcttcctaatattttacaaatacatcctaggtatgttttctaaataatttactgaacagttttgatgccttatactgaaccaagagttttgagcactgccagcaagaggtgtgctaaaaatgcaaattttcttttaaaactcatttaatttttaaaattatttttactacagttatgcatagcacaatcgttgtattaggaaataacactttttaattcatgtatttctaatttcattcaacacaattttataagctccaactatgcacagggatctgcacaatcagcaacacactgatcttgtttagtaaaagagatttttaatgcaaggttagacaagaaaaatatgggtaaaataccacggtagctgattggaggaagagattacttctcatgaagaggggcaagagaatcattacagaaactgtagcatttgagtgggattttaaagtaaattctatttacttctttgtttgctcattaaaaaaaattatgtagtatagtaaacagttttattaagatagcagactctatatttaaaccgtggatttatactctaagtttactaattaattaacagtttttgagtttagacaactcatgtaattcacttcccttacttgtaaaatgaaggtaaaaatagttccttttacacaaggttcttgggaagatgtatatcctatttacatgtgtattcaggaaatagcatagcaaagtataaagggcacagactttggaaccagaaaatactgtatttgaattataaagctatcctttaccatgtagctactgacaaacatttaaactgtttcatcttttaagtgattcttacttccatacatcgttgcaaggagtaaatactaggtatagtcccttaaagaacaggcagaaagtcaatgctacataataagagattgcactggagacagacaatgggactacatgtcacaggacctcaaaatccaggcaacataaagtggtctaactctatagaccagagttgacaagccggcagcttgcttttcatattctgtcagaactgtgtgagaacagcagatacaaatattttgtttggccacacagtgtcttaaaagttagaaaatttagtatattttttcatcaaacattaaaaaacccatatttcaatatgaaaaatatgaaaacaatcagctatacctaagtgccttctaaatcttatctggagcctacgcatgccacaatctctagcactcctgattgtcttattctattcactttacttattttattaccgacctggcctttttaggaacttgagtgtgcaacatttccagacaatagaccacaactgttttgttttgttttgttttaacagagaacggtttgcacagatattttcaggagtattacacctttgtaatttgcagatttcaattagaaaaagacaagactggaggcaagtgaacacaaggtttttagtaatacagatgagaggtaagtaggtttgaagttaatgcagaaatggccaggaaaaaaaaaaaaagctgatgtgaatgttattccaaaggaataatcagaaggaatttgctaactgactggaaaaaatggacaaagaggaaaaaaaagagaaagaatggtaaaactaaagaatggaaaacgcttgtaatagaaataggacaaaccaaaatatgtctagagatcacagagatttcaatgtgtggtataacgaatttggacatttaaagttaaagaaatttctaatagtcatgaatcatggggaaaatccatgttgaccctcagaaatatttgcaggctctaatcagtgacaataaactgtgaattttcagggaaaggattggaatattatattcttatatctatttgtgtaatttcagagcttggtaaagagtatgccctcagtgtttattgaattaaattacacggaatatgcataatttttatcaatcttgagaatgttggtatatttttacagatgctactcataatttgctacaattaaaaggtaataatttgccattttcaaatatacagcataataaattttcagatacaactgtgttcttgttattccacgtaaagagatgacatataggatttaatgtgacattgcttaataattatgcgatttataagctatgtttagaagtccattaaaatatatatgttagtgttgatatttttacaaagacaattgtgtccagtataattgagcagaattcttccaaaccgtgcctttgtcttgaaaaatgccatgagctatgtagcacactagggatttgcttcattcagagtagttaaaaaaaaggcagaaattagatactctcactagagaaaattgaggctgactgaatgtatattgattctttttaattcatccttctgtgcctatgaatttacaggctttctgtccacaatagacagatccagaaagggtcaagagacagtagaagaaagcagccataaagtttttgttatcataaagtttctgacatttatttacaaaattttcaaaagttgtgctgttatttggacaggattacatttataaagcggttctcactttggttattagcattgctagacgtctgttttaatatgaatgtgtttagttcagagcaaaatggatcaattatgaaatgtgcaaaacaaattattaggcttgagttgaaactggtcgttttaaaccctcagcacaaagagcagaataatttccaggtgaaatgttgttgattctgtattcttgtttgttgaggatttgatttttattaagcatgttgcattaaaaaagttaatttaatgtcatgtatatttacttttacacattttgttcattttgctttgccctataccttgtcaaccaggcaaacctatgttctcttcgaaactttccttaaatcctcttccatcaaaatatttttggtaccttttacatacttctatttctacatttagaacactgactgcaaattgctccccctgtgagctctcaaattacttcccctaactatgtgctcttatacttcgggcccaaattatattaatttctatatattctcagaatatagtacagtgcctaaaatatagtaggtcctcaataaataaattttaagcaaattagtgagtaaatgaaaatacatttttgtaccccacatctaatacagcacctgatatttagaagatattttttaaaaaaacagattgaactcaatactgtaaatcaattggtcagtcaaaaggtgatgataattataatcgtattagtccactctgatgctgctatgaagaaatattcgtgactgggtaagttataaataaaagaggttgaattgacccacagttccacactgctggtggtgggggcgacctcaggaaagttacaatcatggaggaaggcaaaggagaagaaggcaccttcttcacaaggcagtaggacagagagagaatcggcgctgagcaaaggggggaaagtcccttataaaaccattagatcttgtgagaactcactcactatcacgagaaaagcatgggggtaaccgtccccatgattcaattaccttccaccaggtccgtcccaggacacatggggattatgggaactagaattcaagatgagatttgggtgaggacacagccaaaccatatcaataatcttaggtatcaaaacaatgtccatccacaccaagactcaagcaattgtggggcattctgtaacagcacaaggtcaactatataagtctctgagttcacctttctgttgacctgtgagttttgatgcttgaatttaagatcctctacacttcttatccttaaatactccccaaacagtatcacgtttaggcatgtagaagttctataaatcactttcattgcccaaagtccttctagaaaaatctaactctgttgtatatttccccataagcagtctgtcaggtcgaactgcaacccgttttattttctttcaataaactcaaatccctgacctgccaagtggttttccctgatgaactatgaggaaacttcattttttttcaccagtgagattatttggaagacccttaataattttttttcttacaaaatggaataaatgaatctgaagtctcctctcatcctaggagaaaagcagttgatttatgaagcagaaataggcaactcaactctggaggaggctgccatagccatttaacttctagaagaaaaataggaagtcctttataggacatgtatattggcatttggaagatgttgaaaaattaattgaaaaagaggtttcataccgagacctggaaagtattgagaacaataagcctattattttgattatgcttaattatccttacggtacagtaaccatagctttgaattatgcattcttaacagtcttaaaattaataatgttctgttgaattttcattacacttttcttttaaggtgctcaaagcattttagagaatattaatgtcatcatgaaaaaaaatcattgttttaatagatgctttgggtggcaataaggtaaaattatttctattaggaaaggttgaatttagaaaaaatatattctgagcaccttatgttggagtatgttagaaatttcagacttaaatatataattatggaccgtgattctagtaagcatacatataattgcattctaatctacagccataccacacaactcctctgcctgccctcaaaaatgccttcttacagttatgtgtctcagcatgctttatttgctatgtaggcaacacttcttaatcccattcccatgagcccttctgactgagattaagaatggggcaggaaaaaatgtagatatttattaagggtctatgttcaaaatatggaggccaaaataatgagtgaaaaatagtgtccattttcaaggagtagatggtctagtgataagacagtcatctatccaagtaagtgccctaccagtcgatagatacataaggaaatataagtttataaggagccatctgtacagaattgataaattatgagaagcagcctccgtttgaggaggtgccataaaggaaatcttcatgaaagagtgagttatcctatgagtaagcacatgatggcagatgaagtgttataccattcacttatttatccattaatttcacccattttatttatttattcattcatttaacaaacatgtgttctctattgtgtgtcagatacagtgactagaaagatataattccttctttaaaggaatcacagtctaatatacctcacaatatggaaacagagaggattttcacctaacagctcttggcataggtaggagaatgttttgaacaggaagtgaagcaatagtgagataaacagaattccagcattattacaaatatcatctgtctacccatccatttattcttttgtccatgttaacatttattgtctgtcattatgctaattgttgcataaaaatactctacaaaaccccaagttcgagctcaaatttcagctgctctatgaaacattcaggatctaaaggaaacccttcatgccatatgaattattttcttttttaacagtgtcaacctcactaggatctgctggcatatggttcacattatcatgagttaagtcaagatatatatgttttcatgtatcgtatttatgttataatagaagaagcaaaggactttggtgttcaaagagatggatttccattctcattcctgtatttgcaggccctttcagcttgggcaggtgtcccagacttagtttccttgtatgtaaaatgaaaagagcaaatgatatcgcactgagatgacttgcaaacaggaaatcatagtgaaaatgacagtggttagtgattctttccattcaacttctgagagactgtaaaagtctaatattgcatttgaatacaatatagacttcattgctgtaaaagagaacatgagttttgggaagagtcctatgttagaactcaaaagaactaccctgtaatcttggttccaaaactgtttgttgtaattttcctgagccaccattttctcatctgaaaaatctgaccacaaacaggccaggcactgtggctcatgcctgtattcctagcactttgggaagccaagggaggtagagtgcttgagctcaggagtttgagaccaacctgagcaatatagtcaaatcctatctctacaaaaaatacaaaaaaaaaaaaaaaaaaaaattagctgggcttggtggcacacacctatagtcccagctacttgaggatctgaagtgggaagatcatttgagcccaggaagtcaggttgcagtgagccaagatcacgccactgcactccagcctaggtgacaaagtgagatcctgtctcaaaaaaaaaaaaaaaaaaaaaaaaaaaaaattgaaccacaatcttccttggattcgtaagagaatgtatgtgaaaatgcttcatcagtaataaagctctacagaaatatatggtgcttttattatcttttgactgtgatatattaattctatttagcttggcttcaacaaaatatacattttctttttgtctcaaatattgtataaattctatacaaccctacaatttctagagaatctaactgatgggatttgtttttgaaagacttgctatagaaagcctttcttctttcctttttgcaaagctaaagaatcttgcatgatttcctttccctggggatattctccagggcattcaatttggcaggcttcacttttcttttcaactctctaacaccaagtgttgcaatttggctttcactttcttctaccctaatttccattttcctaaacatattttccctggtgttctattgaagcggttatcatcactggtcactctctgcagcaacacaaacacatttttgactagttcatcctttgggtctatagcctagagagctactattgagacatccttctcctacacttatccaaagctcacagtgaaatatgctgttctcatttttgttcttctttttaaacattcctttctaaaactcagatctgtatcatttagaatgcagtttgcagctattcctgcaggtaagttttaaaagccactatggtttttgcattagattaaacagactgcctacagagcaatgcatttgtgtagccgtctctgaactcatcaagaaaaacctgaacttcatgggttttaatgggaaataattattacagtggaaccttgctaattcatgatagtgatggagagtcctatattaaattgccaaatttctcagtgataattgaagaaaagtaaagagaatctaaaggaacttagctgatattttccccgtttttcagactgcctacttgttctcaatgggacatcaaatgcaggctccttatggaaaacaaatgaacaaacaaaaacacatttaaatcttaattactaaatacctaatggctctcccagcagatggttattggggaaaagttatgtaacacaaatatactttcatgaaaatacaaaataatattttactgcatttcaaaatatcatttaattgccctaaactgaatacaagcagtatttagttgaatatcagccctatattattatttttgtggttttttaaaaccaaaaattgtacctaaatatagcattccccaccaatgctgctcctattttccaagtccccattatctcatgcctggttccctgtaactcttactagaaggtcgttcctccctgattttggctttgttccccattggtgtgttatcaaatcagcagtggaagaaaatcctgttaaatcatatgtcctatgtcacttggtgttcaccctccaatggctccccaattcacttagaatacaaatcaaaaacttctgatggcctgcaaggccctgtatgacttcttgataccttttgcccccattctttgacctcctacttctctctttcttcctcactctgctccaggacattggtctctctgctgtttccagaacattctgagcatgctcctgtctcagagcctgggaacttcctcttctgttggtctagtatgttctttccttaaacgctgcatggcttgctctctcaccacctctgtgctttacacaaaagttactttttgaatcaattgtcctctgaccattctctctaaaacacatcctattcctcttccacttcctggatttacttttattcatactaatttctagcatctaacccagaagtctgcagactttttctggacagacacacactgtagagttttggttgcaactgcctctgggttttgtagcactaaagcagccatagacaataaataggtaaatgaaagaacatgactgcgttccgataaaaatgtgtttacaaaagcaagcagtagggtagattcggcctgcagattgaatttgctgcccctagatccaacatagtatgcattttacttattttacctcctgtcagcttcttgccacatttggggatgtcagctccgctatcacaagggttttagttcactgttttatcaccactgtctataaccatacctggaacacagatgacactcaacaaaattgtatttaattgttcagtaaaagctttttattcatccatctaaatatcaaagtaactgttcctgaatgaggacattagcattagagaacctctcattgcacctcagagagagtgagaacttctcttggagaacaacccaaggaccatctgccatactcacaatgattaataaaagaagaagagctgccaacagtctatttccagacccctactgctctgcaaatttttgcaatatgactgagcattccattccaaattctgcgaatccaggtgatacgtgaccctgttatccttacaaatgcaccaagaagctcatagctttatggtatatgtgttcttgtgtgactggtagagggcagtcaaaattctcatcatttaaaaaaaaaaaaacaactattcacaaagggggagtttgtaagagacaatatacgcttgcttgcttgttttatagcatttctgagaacataactttgcaagtaccttacaaggtaggagagatcatttcacagcagagccatactttttattactatctctttacagtgtgtttttcagcaatctattcacaatctttgcccagtaaatcttgtgaatcagttgatattgtccaaatacagtgggaggtcatttttagaccactttatgttttgggaaattataattcaaaattattgtgtgtttcattagagtgactctgcaactccaaagtctaataaaattatgtttgaaaaatcattatattagaagtcagattatcacaaaatacaatgatagatagtaagacttaccttaaatttactgtgcaaaaaaaaagtgagcttagtttgctggggctgataaatactaaaagcaaaacaacatgaagcttaaatcacattcttaaggaattacagaaggataagttttagagttaaaaagtctttggagatttaaattacatctcctctcttatgtacagatgaaaaaataaatccttacccagaaaggataagcaatttcccaagtcataaagcatttctgtggttgggaatagtgaacatatgagcatgaaaaaattggagtttatttttatagaatagcacatctacataatcaagttaaaatagtataattgggtatccaatgtaaccaacagtgagaagaggccattgagatgacaattactagtttgctaacgattaaaagctaagaagttactctcttttaactactgcttattttcatctcaccatagggaaaaagttattacctgtaaatgacagaatattttattggatctgtatattgagaatagtgtttcagatcacagtctctggagctagcagcctggatttgcatcacatctaataactgtatgatcttgggcaagttccttcatctctttgtgactcatataaaatgactcatataaaatgatgacacctacctcctggagttgtcatgagaattaaatgtaaaacacttagaagagtgactggcatacaggaaacaccatacactattattacaatctaagagaggtggactgcacatctctttggaagagttcagggtacttctgtactttttccctaggggtagttttggtcccttccatgggcaaggctaggagatattgaaatgcctatatgcactgcaaacaactaagactagaatcagattcctagacccaaaatgcagttgtcttcagacttatttctttctcatgcagcttcttcaacaccaaagaatgcatgagaaataaatctgcatgcatctccagccttgggttcattagcacaattcagtaagtaatgagaaaggaataacttgtgctaagaaagatggctaacctttataaataaactgattattcgcaagcataaaatgaaattaattttggattattacaggggagacatgagtaaactacagttattaggagcataatgcagtcacattaattcaagttagtgagtaattatcactgtttccatttttctttttaaccatttaagaggtcttactcaacacagtagaacagaatgaaacagatttcactgtaagaaaagaaaaaccatgtatttagatgaggtggcccctgccaggagacatttaaaaaaaatcacaccatctcttcaaggacattatatactttttgcacacacaggagtgaaaatctgaagaaatgatttcattatgtgtgacagaagacacaatatttcttaatgtgttagagaatttgtttacattttctgtgtatttttcctaaattatatgtaatccatattgtttttcttttcttccaatgtgaatagtaatcatctttctgaatgcttattatagggagatcttcctatcattaaaaacaaactctttaatcttcacaacatgctggcaagtttattagaagacgaaatttgaacaaaaagaaattaaggacataactaaaaagggtcaaaaaagggaagtgaacctaggttttctgaccccatagctgacactcctaacactttttcttacaaagctgttctcaagttatcatcccattgccatttctaataatgtcatcactcgcccattttcaaaaacatcataagataactacctcactcactccctgtttccctagacatctcttacccaaatctgttctggactattagatattacaaaaacatcacaattgcttcctgaggtaaatcttggcattgcctataagttcctttgctctgcatttgtattaaggagttggtggctttcctctccattctgtgtattgtctcttactctagattttattgcatcaaaattaatttactgatatatttctctggctctaaaggaggagtatatattttctagtgcaatgctgggtacatcatatgccatcaaaaatacatttgagggctaatatccagagtttacaagggacttaaacaaatttataacaaaaaaacaaacaacaccattaaaaagtgggcaaaggcatgaacagacgattctcaaaagaagacattcatgcagccaacacacatatgaaaagaaggtcaacgtcactgatcattagaaaaatgcatatcaaaaccacaatgagatactatctcacaccagtcagaatgctgattattaaaaagtcaagaaacaacaaatgctggcaaggttgcaaagaaaaaggaatgcttttacactgttggtgggaatgtaaattaattcaaccattgtagaagagagtatggtgattcctcaaggacctaggagcagaaataccattcattccagccatctcatgactgcatatatacccaaaggaatatgaaccattctgttataaagacacatgcatgcatatgttcattgcagcattattcacaacagcaaagacatggaatcactccaaatgcccatcaatgatagactggataaagaaaatttggtacatatacaccatggaatactatgcagccacgtaaaggaacaagatcatgtcctctgcagggacatggatggagctggaagccattattatcagcaaactaatgcaggaacagaagaagaaacactacaggtcctcatataagtgggagatgactgatgagaacacatggacatagaaaggggaacaacacacactgggacctattgggggagttgtgggaaggaagaacatcaggaagaatagctaatgggtgctgggcttaatacctaggtgatgggttgatctgtgccccaaaccaccatggcacatgtttacctatgtaacaaaactgcatatcctgaacacgtaccctggaactttaaataaaagatgaagaaaaagaaatatgtgaatacacaagtaattagaagcattaatactggacttacttctctttgtttcgattacagttcctacacacagttattaagtttcaaaagcagatggctcctcctcatttgggaatagacagtactagtgttcctgagcgccttagggaatataattttgagtggtctggcaaccacccaacgtgttgattatacataatgaacaagaggactgtcccttattaatagaatattaaaatatcatttcttaacattcactaggtgttaattagtttatacatgttatcttattgaatctttccacaacattttaagttggtattttttcatgctttatagatttaaaaaaactgaaactcaccaaagtaagcaaattgcccaaagtcacacatcagaattcatatactatgtcacatctctgtgactagaaaatttgtttaggtggcagtaaattatattttctcccttagagatgatgggaagtactcattggtgaattccccacatggttgtcagggggccgtcttagggagaggtcgcctgggtccacaggtttcatggtaccacctcttggtatcactcatgctaagtgatctgcagttgttaagactgtacagcttattccactgtggagcacacaggcatgcagttcttggtcactgatgaaccctgtaaggaaggtttgtcctgctccctgcttaatctcaacagacaatgtcccatgatatgaatggtctagcagtggctagagtttaaacttaataatagcatgtgtaatttactggcttcactgcaatctgattacacctaaaaattagaaggtcatcagagaaaaacaagaaaataaatttctctgtaaaagaattgtgactaaagtaatttttcctgatacattgataaatgttgtatagtaggtgaaaaggtggcagatggcattttttatatccttaatttattgacattaagggccctgcagccttcaaagcaccttcatctgacagaaattaaacaaaattccaaagaaaagggcaacacaagacaggagctatttccagggccaaaatagaacaggaaccacaacaataaatagaaaaatccttccaataagcacacggtaaataaaacatcaaaaacacaaacagaagaactcaattaaagcagaaaagttctcagtattcccctgaaggacataaatattattattcattatttatacaatgctgtagatgcacatggctttatacagcaagttgaatatcatatgagaaacaaaaaactgtcctttcaggtttctgatttaggcacacatgaagaagaaagggaatgtataggctattttgaaagaagagaggtacacactaagaacagttcattgaggcagtttttagagaggacagtttctaacaagtttttcaatgaaaagaagttcaaggtgagatcacatgctgaataaaatacagaaatcagtagtaaggataaaatgattagaacttcccagtggcctcctgattgccatcttatttatttagctataaagtagatcatatctgaaatattttcttagccatacctgaaggtcttcagtagagcttttctaacaattgtgtaagcatctaattccctgtataaaaatctatttggttaggcacatgcacacgtatgtatattgcagcactgttcacaacagtaaagacttggaaccaaccaaaatgcccatcaatgatagacttgataaagaaaatgcggcacttatacaccatggaatactacgcagtcataaaaaaggatgagttcatgtcctttgcagggacatggatgaggctggaaatcatcattctcagcaaactaatgcaggaacagaaaaccaaacaccgcctgttctcactcataagtgggagctgaacaatgtgggagctgaacaataagaacacatggacacagggaggggaacatcacacactggggcctgtcagggtgtggaggactaggggagggatagcattaggagaaatacttaatgtagatgaagggttgatgggtacagcaaactaccatggaacatgtatacctatctaacaaacctgcacgttctgcacatgtatcccagaacttaagtatattaaaaaagagtagaatgccattgcattctatgaatatcatattaatattttacatatgcttttcttgtttccaatttgtgtctcacacatagcaataaagaactatccttgctaataaaaaaatctatttgtatttaaaatatcttgagtgggttctgtttcctgtattaaacaaagacatatacatcttagacatgtcttatgaataacattattatagtccattgttcttctgtgttgattatgttattttcaaactgccaacatttaaagtatactataattttcccaattctggtttgaaatacctttcctttcaactatataaacaaacacaaaaaaagcctgtaacaaaagacacctttccctttacttaaaggaaataataatgaggaaagaaaaaaggcaagtaaaatgtccatagaactctttcttgggttacaaaaaaactacttgaataatttaaaaatctctaattgaataattacaactaagaaacacaagaagaacagtaaaatatctcctaagtagaccattagcaatttagcaaaagaaattctggtttcagaggaagtattggaattgtttttgacataatgttccataacatatcatattaatccattataatgtcagtaagaataggctaatcaaataataatgaagaccagacactttcccaaccatttaattctttcagcatttcaatattcaaaaaatgataaaaggcaatagctattttgaataatgtaaactgtactttaaataatgacgtaaatatctgaccttacaaagtttttcacattttaattaaaatgactgtgatattaaattgtttcagcaaaaatttttcccaatattttgatcctttaaatatgccactgtgtagtaattccatcaacattactggtagttatagattctgagaggacagggtaacttttatgtttagcttgtagttggttttatggtcagtaaataatatttataagggaaaacctagcatatcttaacagctgttgtatgttttataaataaacgtggtaagaagtgatagtataatgtgacgctctctgaatgcagtgtcagaagataagaaaggttctacatcaaaagctatgaatttattaagttacctaacctctccaaactgcagtttttatctctgaaaagtgggaatgtccctacttcctttttgttattgtgattaaatgcaacagtgtagaagaaagtcatttgtgaggcataaagattatcatataagtacgaatattattgtgcctttgaaagggaaaatactgaaaagaaagatacattatcctggccgggtactgtggctcacgcctgtaatcccggcactttgggaggctgaggtgggcggatcacttgaggtcaggagtttgagacttgaggtcaggagtttgaaaccagcctggtcaacatggtgaaactctatctctactaaaaatacaaaaaatagccaggtgtggtggcccgtgcctataatcccagctactcaggaggctaaggcaggagaattgcttgaacccaggaggtggaggttgcagtgagtcgacattatgccactgaaccgccaccctgggcgaaagagtgagactccgtcgagggaggggacgaggggattcaaatctactggaatggatagcattaatcaaaattgtttcattattatgctgtgtagcaaataatggaggaattggggttgtttacattacagaaataaatactaaaaagatatttaacagttgtcttacaatatttaaaaatttggtcaaattgattaaggggtaagcttctcttttggtgtttgagagactgatatgtcaactaagactgttatgattagaattgccgtactatgaaatagactcctgaccaaaatcatatacaaaattttaaaatttgaccaatatcagaaatgtaaaaaatccaaaatattgtatcatgtttattattaattaactggctcaaccacctctacaatatttattttctatgaagtaactaggtattctttgcctcttaacatgatagttacttcataatgtcattttctatagaaagaatataaagattatgttcccttttctcttagcaacactgttcaaatttaattttattattgttagttttggaaatatattacagcacaccaattcatcattgattttgtccagaaactattttaggattattatcaattttggaaaaagctgtattaattttctatcagatatgacctgtttgatatcaagtctttgctctttgaattgaggacaccattaaacactttttggtcaatgtcttccttttagtggcacatacacgttttatataatctttgtcaatgtcagtataccatgtctaatcagcaagaaatataaatctctccagcgtgttttttaaatctgctactcctcattacttagcacaatattcctggaaaatattctcatggcaataactgaaagtaactacaatacatggaaacaaatgaattacatttaaaaatcccactaaatctcaatcaaatgaattcccaaatcaatttccttttaagtggccattccaatgtcttctaacacaagggaaatcatagaaagaaatagccatcttaaacaaatgagttaacataccttaccttaaattaaatagatagatgatagaagatagatagatagatagatagatagatagacagaatacatacatacatacatacatacatacatacatacatacatacatggatttatattatataaatactttgctaaagtcacttccaggaacttgcaagctgttcatacaaaaaagggcccctgaagtttaactttaattacttcatggaaaatgcactttctgttaccaactatctttctaggtgttttctaatatcttaatcatatcaaactgcttctagtgtattgaaagctatatcctatttctgaaacacacttctactccttcctctcacttatgtctgcactttatattccttctttcctctctcactgacctaatactctcttcctctctcactgacctaatactctctctccccttcccacttcccaccttctccctctcaccactttcccctcaaatacgccttacccccaatatgtatgtacatactggaaaacaggcccttcatcaggctctttcctcttcaaccttcatgatttacaatgacctcaatttctcctaggaatacatcatcaattccaaatcctagttaggaacacctcctgagtgatctcaaacatgctctgtgtttcctacactacaccaaaaactataatttgttcatctgcatcttttacctgtttattttctgtgaaggcagaatcctttcatgacttattcatagattaatatttaataccaactacctggattaaatctgttgttaggtaaatatttgctaaatggatgaatagattagaggaaggaattctagatgaaattaagtaaatgagttatttaagtcaactaatacaagtcctcaaaactttgattatatagagagctaaactgataaatatagacaaatatagtgagcctataaattaaagctatactatgatgaaaaaataaatgaataattgtgaaatagccaaaaatactaaaatacagctataaggttaaaaataaatctgaataaaaaatgtaggagggaaaagtgattaccttaccaaaattctggaaaacagacagatagtccataagggaaatgcaattagtctcacatttatttaatgtgatggatactgattgctagataaggttaacagtgctacacaaggcttgttattttgaggtaatagcatattatggaaaaagtagctaaacagagtagaagttggaaattttcccaaacaatatttgtatagataaatattaaaacatagtaacaatcatatggagtatatattcaagtcaaaagaaaataattgctctaaagaataattattattttgacttcttatttttcactttcacttaatacggaaaatactaacatttttatgatgatctgtgatatttaacagtggtcttaatatatagtaatgagttgcttaaacatgtttggatagcttttctttctttcttttttttttttttttgacagagtctccctctgtcacccaggctggagtgcagtggcatgactttggctcactgcaacctccacctcccgggttcatgtgattttccagcctcagcctcccaagtagctgggattacaggcgcgggccaccacagctggctaatttttgtatttttagtagagacggggtttcgccgtgttggccaggctggtcttgaactcctgacctcaggtgatctgcccacctcggtctcccaaagtgctaggattacaggcgtgagccaccatgcccagcctggatagcttttatgaagtgtttataaattgagtatcctgcaagtattaggacagtcaaaccaaatcacttgctttaaacattttcagatattagaatgtagtattgacaaagacctgctacaaaaagctatagtttttgaaatatctattattttttatctaaggaattaaaataattaacgcataattacgttagggtatgcaatttatagttatagaaatgatcagtgggctcttcctggatattgatgaagtaacagatagtagtttgaaaaaatgaccattgctcaaagaaaaacatcttaaaaattagaaattggtggatgacattaaaaaactggcctgtattaaatttatactttacttgcactacaattacagcttgcaggtggggagtgcagttaagtatagctgactcatattcctaattccagaatttggtattgtaatatattaaagattaagtaatacttttattattcattctgttacactgtgtgaaattatgttggcctagggctaggttgaaaaatcacagacctatgaatgtgaccattatctggctctgtaagtgtctttttattcattcaaatctgtgtgctcaaatttgagttcatatcacactcatgagatgttgttttcatgaatgtgctaacctgaaggggtgaatgttcaaaacactgcagagccaacatacacccaaaatgcaataaactgcaagattttgtatgtgccttgccttagcagagttttgaaaattcaccctgaaggctagaatactttctttgtaagaatctcagctttcatacgaatacctggggataagagaactgtgagaagcaagcctaatggaagttaaattctattgcaggattacattaagaaggggagccgagcagaagttcttctctgtctttgagattgttctccatcgtgtgttaagaatatcaaactccctatttatcatcaacgtttcagtgacttgggagtgcagaatatatcttgtaaagaaacacttatgtaggcttactaatgcaggtgacatattaggctgagatgtaaaaagacatagctctaggggtgatctcagaagcaagtgacctagtcattttggaaagtctcatctctgaaattccaatagttcttcagattcaaaatcgatagaatagcatttctagtagactttttgtgtggactacaatgtttcaggataatattgtcttgtcaggtcacctcttatcacaccattttaaatatcatgagaaaagtaaacaaaagagtcatttcgagccactttttcatgcggcatcccagttgtggtggtcacttaatgttcattgcaagctcaaaatgtatattaagcagccctgtcagttgcatacatcctatacaccttgtacatttgttgttactcattaaacagcatgctttatcttggcatatcaatacatgacaagttaagctgatctgcactagacaaattgattctgaaacaggtattgaaagtttaaatcaaattgttttcaccttctttactgtcaacaagatagtttttattgaggcacagatatattgtttttttatttgtttcagaagaaacttaactctctgtactatctacctagggtccttttttctatcagagctcattcatgaattgcagcttccagtaacttgaacacaaacaatcaatttctatttgagattaactgaaatatcaatttatcctttctaagaagaattatgggaagtattattcacagagctcctcttaatattgtttgcatagaatcaaatactttcagcagaccaaccttggacttttaggctgtgcaatctataaaatttagtactctggccagctaaataatacaatggaataaaaataaatgatgacaacataggagatgtcataaaattggtgaacaactatagtccattcaattgcttaaaagtttctaaattaaccttatgataatattatgattaaatactgtctaaaacttgctttgaagaggtgttacatgcaggaagacaatgatgtttccctctaagtacacctaagtggtagactatgattttctgaggtggttttgacacattttgctgaactaacttccagtctttagttttaggttttctaagacatggttctatagactattctaggaattaaaggagtagtattgtgttgtagacgttaactctgttcaccgcgtatttctgtgacaagccagttacaaggggccctggaggtattatgggcaaggaagtgttgtgaacagaagtgatgtgtgccactccctgtttaggtggagagcttctaaagtgctctcccttttccctccagcaaagcataatgtggcttctctgtcagcctgcatctctcagtgaccatcatgagcaaagcgcctctattcaccacgttggacatgcaacatgagcaagaaataaaacttggttatttgaagtcacagaaaattaacagtgtcttaagaccaccatatagtttagcacattttgacagataaaggttggattcatttcaaattccaataatatgctgctggccatactgctgagaagagcagtttgtgtgaaacccaaaagaagtaggcaacaatttattgaagttaagattttgatggtacagtagccaacattactgaaaacactctttcttgtttgttgccatgtggacattgttgttctctctctttttacttcatttcttgtttatttttcctactgaaaatggcataggaagttagcggaacccacactacccttagacttaaccgatgtttcacactcaaaaacaaaatgacctatattttatgactcagacatactatttcttgctctaccactcaattcctaaactggaaaacggtagaaattgggaggtatgttgaaattgaatccctaaagatgtagcaaaaaaaaaaaaaaaaaaaaagacaaatagagtattttgaggtttttgtttgattctaatagaaaagttcatttatctacatgaataacatttatatttgcaaagtaatttgagttttgggtttggaaaacatatgtaaatatataaatacatatattaaatatataaagtccatgaaagaacattatctctaaggcttgttttgcagtgtgaagtagctaaaatattggttaacaaaacaaaatgtttaaaaggagaaattttattgtggcatgggatagtgaaaatgttttggaataaaaatattaggttaagttcctgacctgcaactggctcgttatatgaccctggaccagttaatgtatataaagtattctttcctctctttaaaagataggaaaatgacatcttccctaattcatagcattattatacaaaattaaaataatgcacataaaaacattgtgcactctaaataatctatgtgcaaatatgctagaatattcacactttattgttgttagtaactttttctagttttcctctcgatttactcacatctctccttctttccaaataaatggaaaaacgttagtagactatgatgggtaatgccaccagtgagtcaagctgtagtgggtgttactgtaatagttcacattcatcattgctatagttgaaaatgagcatttggatgtggttgaatagttcacatcaaaacaaaatctcatctgtatgacagaaactctgttgtgttgggctttgaacataatccaagatactcaagacagtagcaaaattaggcatttggaaaaatcagagtaagaaaggcatttttcatgcttatttgcttcaaaggatgctctgattttgttaattgcctgaaagagtgcttcgatttgctattttctacaaacagtattctaatctagtttatcctctgagttgcagctgtgttcaagtatcctaataggtttggtgcatgctgaactattcttctgcaattaattcacttggttcttcatgtgaaatgatttacacctatttagaattaaattggaagccattccactcttgcttatgaagttattaagacagcttttagatgacattaatttgcacttagtaccttttatctaaggatctcaaagcactctatgaaagtgcattatcattaatgaagaaaaatagaagaatcgaacactgtatttaggagtaatttgcaaggtaggacataaaataaaaatgcattcttatttttagttgtaaaatagtaatggtacatattatcttcagactcaacaacacaacttcttattttctctccctgtctagcaaggtttgtgggtctctatcttcttcaactgcaaacttccacagccattcattctcatacctacaaagcaacatcacctgggttttctactttatggtgtatcttcttctctattattaatgcctgctttttaaatatcccagccttacattattattagcctgctctgaaaagcagttaggatgtgaatttgctttcactgaagtgggttgaagccaggcctgattcttagatgtgtttagcatccttagatgttcaagtatcttcaaataaaagatagtttacactaagacttgattttcacttagtatcatgatatcacaagtcaatgttctgtggatattgattgctgaggaaacttttcggtttccacagcaagtttttctttttctttttcttttctttttgagacagggtcttgctctatcacccaggctggaatgcagtaacataatcatgattcattgcagcttcaaacatcccaggctcaatcaatcctcctccctcagcctcctgagtagctgggacgatagatgttcaccactacacctggctaatatttttaaattttttctagagatgggattttgccatgttgcccaggctggtctcaaaatcctaggctcaagcaatcagcccatctcagcctttcaaagtgctggggttacaagtttcagccactgtgcctggccaagtttttcgtttctataaaagtatacttatattacatcacaaatgcaaatataaataaaatgatacacctttaaaaatgccaatcttgtacatacaattttatgagtttcaagaaaaataaatcctgggcccaatttgtccattttctctctgaagtgtttatttgctttaattgtgctggaaagtaggtctctgattaatacaaatgtcttaaactaaaacttataacttgggtacagaatgatcctacttctctctgtaaaagcagatatctggtcattctgagtctttggaatttagccgattcatgttgtcagtagcagtggcatttgataatcagggcagttgaagccttgcctttaacagggatgctgaaactgttaaaaaagtcttcatgtgaattagaaaaggtgcagctcagtgatagaaattacagtttgatgtgcagatacgggctagatttaagatgttaccttactctttcagccaggcatccctgtgcagcaaacaacctgaacaatggaatgtttcagtcctggttttagatcctagagactgaaaacatctgtatttcagaggtcctgcttaactacttgaaacactaagcctcaagattttaataaagaatgtactcaaatatccaagctaactaggatccttctctggaaaatgactcttcgcttgagtattgtctctttgtctgtttctattcaaagtcagaaggaaaaaatggaaaggctcgatgaagatagaccattatatacaatcttcatggggttgttcttaaacctgagctgtttcccatcaaataaacctaaagttatacttccaaacgttatttttcttatttagtcttaatctctcctccactcagcttctgtactctgcttctccactgaaattggtactatctatggttgtcaattttttaagctaatgaagacgaggagctcggacttcctttgggagggcagtcttaaattttttaacatattaactctaaaaaacacatagttcttgtatatattatagaatatttttcttcggaaaagtccagtatagttctataatgtgctaattccatgattctaagctaacaatataagaaacataggcaatttgggaggcccaggaaggtggatcacttgtgctcaggagttcaagacaagcctaggcaacatggcaaaacactgtctccactacaaatatatacaaaaattatctggtcatggttgcacgctctggtagtcccagctaatctaggggctcagtcaggaggatcacttaggttgaggttgcagtaagccatgatgaagccaccacactctagcctgggcgatagagtgagaccctgtctgaaaaagaaaggaagaaagaagagagagagagaggagacagagagagaggagaaggaaggaaggaaggatgggagggaggcaaggaaggaaggaaggaaagaaggaaggaaggaaggaaggaaagaaggaaggaaataaattagtccactattaagtgttaacagtattaagtgaattctttcagttggagaggaaaactcatagattggaattgcctgagcatatatgtagcatgtcagggagtggaagaaactgaagttttttatattatgatcccatattagggcatttggaatcataatatgttcactgatggataaacattgcttctaaactaaactctaaattaggaaggatgagtgatcgaatgagataaatcagacctctgttttagaattcccatgctacctgaattttggagactgggtcagaattagaagatacttagagaaagtattacctataggatgatgtttgcagtagttaaaaaaaaaatagcagtaatagtgtggatggaaataaaatgtaaaacttgagcaacaaagactgtacagattaggaggtaaaatgtgagggttgcgagtgggagcaaaggatcaaagagcattcaaagcaaaggtaggtagcacgacaaaaacaaaacaaaacaaaaaaaaaacaaaaaaagggtctgagagtaaggcaggcagctccatctggagaaaaatctaccagggaaccagaactagtcatgtatggccttagaagaaggagtagctataataatctatagggactattagtagttggctagagttgccataacaaagttgcatgtactgggtgacttaaacaacagaaatttatttttttcatagttctgaagggtggaagtctgagatcaaggcgtgggcaggtttggtttcttctgagggctccctccttggcttgtagatagccaccttcttcctctgtcttcacatattcttccctctgtgtttgtgtctgacctgatttcctcctctaataagaacaccagtcttactggactatgacccactctcatgatctaaccgtaattatctttttaaagatggtgtctcgaaaatacagttacatcctgaggtactgaaggttaggactttaacgtatgaatttttgggggacaaaaatatactgccattgataaaaaatagaatagacaaagagtaaaattagctgtggttttaattgtattatttatacattttataataaatacacattattttataagatgaaaacaataaaaaattgctttcagttcattttctactgcagctgtccatatctcaaaaatgtgaacattttgttgagctaccccagttctaaggtctgaatgcttagtccttgatggaggtgatcttgtaaattttatattataatttaaggattacagtaaaatataccatggcctgtcatggcctgaacttcatttagacttcatttagtgatatcaggataatgatttattgtctttggtcttcctaactaaagttagaaatgacttcaaaatcatcctctcctggtaataatttcaaacattggaaaatgccgactcttactattttatatttgtatggtgagtggagggaaaatctttgagtaatctgaaatcaataaataatatcaaatcaaatctggccaatttcagtgctcaatatattccttaacctttttttgcaagttttattacaacatacctgtataaatttgcttctctcatgtaattttttagaaaagattatccatctctgaattaagtgctttcattatctttcccagcagtgattcttacactttggcattaattagaatcacctgaagggcctgttaaaacagaatgctgggccccacccatagagtgtcttatttatagtctggtgtggactccaatatttttgcattgttaacaagttctcaggaatgttgttattgctggttcagcgacactgaaaacttctgctctgcaataatgtttgtaacaacaaaatcaaattatttcattttactttgaaaaactatttttcatcataaaaatatatagttttaattaaatgtatttgtcaccattatgaaaaataataaatagctggaaatcattctgatatgcatggtatctcagaagacatgaaatagttgcagttaccatgaccaaaaaccaaatcaaggagctaacaactctacaaagtcaacaagtatttaaaatatttgttatgcacctatgtgtcatcttggtcttagccatactagtgtggggacaataaaaagaaacatagagctatataatatctatcggtaaatttctttaataagtgatatatctgggttgatgaaataaataactgttcccagattgcagtgtatgagatgtagatcacaaagctgaaagcttaaaaatagcaacaaggaccagcctgaccaacatagagaaaccccgtctctactaaaaatataaaattagccaggggtggtggtgcatgcctgtaatctcagctactcagaaggctgaggcaggagaatcacttgaacccgggaggcagaggttgtggtgagctgagatcgcgccattgcactccagcctgggaaacaagagtgaaactctgtctcgaaaaaaaaaaaaaatagcaacaaggataatgcatgaaaaccctatctatttgccatcaaaaaaaattatacaaatgtgtaaaggatcatgcatagggagagatatttctttttgtttgtgccttagaattgaggctaaggaccaaattgaggataaaagatgctactccccacccctattcatcaatataagaagaaaactaaaaggaaatggattagtggcctgcagataatttgttatttaaaacaagataatactttttaaaaactaaggttgccttcaagaaaacaatacatgccagcatagtggctcaagcccagttacttttagggaggcaaatcaaccacatatttttggaaatgtggactttgctgttgaccctactactgataatttaggtggaaagcagattaaatatgtgatgataattacacaatgaactcccttgatcaagagtttgttaagacctctaaacatgcaaaaaagttctagttcacccatacattacagataatttttttctctatgaaaaacaacataactttcttgctcttcactaaagcatttcacaaaaatcttagaaatgccaggtttttaacatggcattcacaacatttcttaggactgaataatttttttcctctatgttcagatggaacactaaatgatacttagtttttttgaaattcaagatctatttacaaagtgtaaaaggactaagacccttctgatggcccaatttagaaacattaaaccagctaatgtaaacctcagtatgaagaagttatttccaactcttacttcagaaattgaagctttcatatgagttctatagtaagacatatcttttcatagcagtccaatatgttaaccttagtatttcttgtcatgaaatatttttaaactaccaagatagctaataatctaaaatcgatttcctttccagtaatattttcagaagtatgttaactttaaactttcagatttcataatggagagatatttaaggccttatatttcaaaatgccccaggcatcatggtggaaagttttgaggataggtttttcacaataaaaaataacaattttattgcagagaggcctataatttaaatattttatttatatccttcctatatattagatttattactcatatttcaaagaagcatggtggcatcataaagtacaattttactatactcttaggattaaaagaatatttttatacagtaaaaagtatatttcgagagacaaaattttgatgcccccaattacttaaccaaataattcctctaagaatatatgaaagccagtgttagcaggaacaaagattctttgtggatttttaatttgttgctctctgttcaaatttaagacacctttggttctggatgaattttctttttggaaacatttattttttttaactcctttgaaatgaactccaaacacttcaacatagatagaaaaccttgcagtttcaatgaagcttttcaaagtactcttttaccatctggcaaaatacgaatttgcagcttcctaccaagataacctactgccttcaattctgactgtatgcatatttctctttctacccataaatgccactcctcaaaaaagagtaagagctttcgaccaaagctctatgcttatagctatgagcatttttttagagctcacatttactagccacaatatggaatatacaggggataggaggttaatatttaatcatgaatattgattaatatttagactcgatttctgacgtgaaatttggctttttgaagtttcacgagaatgataggcaacatattcaataaatgtaataataatggcaaatactcaaaatggcaaaagatgggtggtgtatatgcttttatataaaagcaatttattttattgactcatcttaccttggtatctccctcccactttttacctacacaggattctcaagaaagttgtgttcagtcaaaatccttcctacagtacagtatgtttcgagcttaaaggaaactcttctagaaattacacagatcataggaccctaaatatataaatgttttatgactgacttttttctgagacagtaagtgtctgatgcagaaagaaaacagaagaaaaaggagaatgataattagaagaggatactctctgcttcgtagcaaattcagcttttaataagaacaatattgataggtttttccttatgtaccagtaacatcaccaaaccttttgacacttgtgtgcgagctccctaaagagtctgaaatctcagtttaaaataaattgtaattgttcattgtttggcaaggttcaactcaattaggcttttgcacagatttctacatctacattttcctaacttatctgttattgtgcctattttaaaatacagagtatttaagccaaaatttatatgtaaaccattttaaataaagattctgcaaggtacatttgctcaatttgttttcatttgattattgactgttaaatttgaagaaaaaagtcttaactatgaaaatgtacataggaaagaagattgctgtaaatgtttcctgaatatgagtatcacatgactttcccctattgtaatcatgtggcagaccacaagtgagtttccaactgaattattttaggcataatatattctttctgaatgtctttcctctttaaccaactgctttttgcttgtggttttaagggtatgcacttaatcttgctatttcagctacatctgtgtactgtaaaaagcagccagttcttagaatggttgataaactggttgacctctgtaatctacattttagagaaatacatttcagctgcagatgtttccaaaggtagaaaatctgtgaagaaaattaatctgtaactgacagatgttttcatattaatacagtttgggaatattctcttccaaacatgttgccttcctgtgaaattcaagagtgctgttatctcacatttctaggctcctgaatcctatagcatggcaccaaaatggactgtcatctaaataaacagacgcgaaacttgctttgtagttagaaggtgcaatttaaatttgttgacttttacatttgctccattccatttaattcagttagttgtataactgctgataaaattttcctcagtcctgcggaaggcccagtgagttacttatatcaaaactcaaagtcagtataaacgttggcagaagatttcatcctgtttgggcattttatagcatcttagggagttatctttcccctaagggctttattattaatgggaactgcccacgtggtttgagggaagaatggacttcctcaattagaagacctttcaagagagttaacagaaaatttattttttcatttaaggaagagaatgtttcccataagaacactgaatctttcatggctgactgtcttgcaaacacaatgtgtaaaatttttagttccttaaaaattaaacagacactgtgaaatttaataaggcttaaaagggacctatctttagtatccctgttttctcaccacccagtactcgtgataacagattatcagcactacctactaaaaaatcttcatcgtcttcagaaaaaaaaaaaaaaaagcatgttgaggtcttcccaaggatttaatttcagtagttctcagtctatatgtggaggagtttacacagatacttttcctaccatttactggctatgtgattatgagtaatttcctttgccttctgaagctctgctatttcatttgagagtcatgttacctactttgaaggttgtacagatgggagaaaatatatgtaaaatacctggcatggggtaggtatttaaaatgatcctttgcaaccatttgtttattgccacaatatttacttttacttaactcaattcaatatatgtaaatttacaaagtataatttccactttattgctgtttggccataaagtataaatcttttggggcctcagtttcttctaacaaagcattgcttcaacgattgtaaattatacacattagcttgctcatcaataccactattataagatttattcattataaaatatatttcctctattacattccattcagaccataaaactgccaccttaattctataatgttatacattatatacaataataaaatgacttcaataatttcctctagattgaaatacctgatttactatataatcattatatacatcaaacttccaccgttgtttgatatgctatcatgttggctaattttagaagctttgttaaataaatagaaaaataaaagccctgatttttttgctcaacaagaagttatgttacagataaataattgaacacaaaaattcgaccatttgagaagagatagagtctaatatagtgataattacagattattacactaaaatatactttttcatgagaaattaaaggagctattttctttttttattattatactttaagttctagggtacatgtgcacaacgtgcaggtttgttacatatgtatacatgcgccgtgttggtgtgctgcacccattaactcatcatttacattaggtatttctcctaaggctatccctcccccctccccccaccccacgacaggccctggtgtgtgatgttccccatcctgtatccaagtgttctcattgttcaattcccacccatgagtgagaacatgtggtgtttggttttctgtctaaaggagctattttcttaaagttaatattgactcagcttgaaaaccattcaaaacaccaattgtcattgttgttagaaacgaaaatatttaaacaagacaaaatttctgatatgaataaatggaagagttaactacagccttattaacattttttttttactttcctagatattatgactcttttgtatccttaaccataacaccatcctacctttatgcttttctcagatcaatgaaatcaaattggtcattttctccagggtgccctttaaagtctactgaaagcagttcagctcattccctccttactccatctctttcctaacactgtgtttaattggttattgtttcctccacttgggttgtaagcagttaattgtgtttgttttttttcctttatttcaagagtgatattttgcctcacttcttgggtgggatatgaacattgttcaaggcacttccattgttctgcaagccatatatcattcattgtgactagaccatacccccatccatacacacagactcatccacagtctaaattcattccttaattatcactgtacatgtagatcattcaaatattagttcatttgattggtttacaaagcttctcaactgctaattttattatttgatagaccaacaaaagcaaatgcacaaattattaaaattacagaatttgaaaattgaagggatgtcttaaaattcatctaacttaaactcaaatatcatatgcacctttattcccagtaagaaacaaatttctcattaaacatctgtggtataccaaaacctgtatttggcatgcgggaaattgagaactagatgacacacttgccactttcatgaatcaagtacatgaagaaaagttacactaaaaaaggtagtttaatgattcttcagaatgagacaaaaaaacctatcaacaggcaattgcatcaaataaatcaaagcagttgcctgctagttgctttaaattcacatggacaaaggctgtacttgtttttgatcttatttcttcttgtaaacacctttctctatatattttttctaggtgtatgaaataatctgaaataatttctgagggttccacttttacaagctaaaatcagtgccaggtgctttcttaatcttgttcataaacctcagaatggctttgaatccttctgctttgaccaaaatggacttaaactatagaagtgttgagtttttcttagcacagatattggtaactttagtctgacatctccccacctgggtgattctaaggatgtcacagaataataagcacagtaaacaattagcatcatccaacaaacagccctcaaatggtctgtggcatctgtttgtccctagcttgaaagctaataagagccaggactctccaaggtaccttccttttcagcttcaaatttaattacactttctgcatttcaaaccattgaggtacttatggctagagagaacactcacattattttatagtagaacaaattaagaaaccctgcataagtgggcagaatgccagcttgcaattctccagaagtcttgactcacacagcagtgtttcttgcaggacatctacttgtttagttttttgtttgtttgtttgtttgttttttagagtttttattataaggaaaattcgcacgttagctgttttttaaacttctgtagtaaaacataaaattagcaatgcaactgtaagtaagaggatctgggtgaattaaaaaacacgaagtgtatacataaaagctgaaaggaggcaatataataaccttggaaaatggttgacaagtcattgattaatcacattgaacaaaatatttaatatgcacagaaacattagagaatagagaagtactcaatattttagagaataaattttccttgattatacacatcagcattattatgatttatccaaatatttggtaaagtattataactttctctttagacagttatctgttctaggtttacctggatatttttcataacaaaacaaatggcgtattaataatcagtatggaaatttatgaaatgtgttttcccaaaaatatctttatactataaattgagtaatatatagaaatgcttttaataagcaggcagaaggtttggtttaaaagtgttatacttaggtaattaaatcttgcaatgaagtttctatatcaaaagacgacagctttttcacttatgcacttctgggaaaagactatcaaccattaatagtccttatgacaaggctgaacgctaatatttgcaagctttcaaaggagttgctaattatacacaaaggaacaaaaggtgttgaaaactataacaaaagggcttagattagtccagtgaagtttcctgaattcaaaacttgctaaacatgttctcccctgagaattatgattattagttgttccctaataaaaatggtaaatgaaaatattagtgtttgctatagaaagactaatttaagaatagtaaaacctaaagtttctattgcattcttcttccatagttttaacctaggtattccatgagaatggtaatagcatattaccctttgtgacttcagattatatattaaatgaccagtgtgttcttagtttatgggggaaaaaaaaaaaaacaaaggaaggaagggagagatggaaggaggaattgagggtgaggcagataaattagactttagtttttaatatctaaccaggtgaattatttattcggggcagaacagtcacccctactttttaccatcagtctgcttctgaaacagtaatataggtggtatgaggcacactgcacctcttatgtcactcaccttttccccaagttgccttaaacggagatatatatctttagtaaagataaataagatataaaactagttgagaactgttcattaccttttttacgtgtattccatttactggttttctgcaatagggaagagagggatgctaacatggaggagaagagcacaggaaaggagccattgtgtctactacacttaccacttagttactttgtattgactagtgctaagaacaagattccatttggggtgcaaaatataattgacccttgagcaatgtgggagttagcactgaacactgcactgttgaaaattcatttataacttctgactcccccaaaacttaactattaatagcctactgctgactagaagccttgccagtaaaaagcagttgatttaaatgtattttgtatgttataggtattatacactgtattcttacaataaagtaagctagaaaaaataaaattttattaagaaaattataagtaagggaaaatgtatttactcttcattaagtggaagtggatcatcataaaaatcttcatccttgtcatcttgacgttgagtaggctgaggaggaggaggaaggggaggggttggtcttgctgtcttagcggtggcacaggtggaagaaaatccaagtataagtggatccatgcagttcaaatttatgttgttcaagggtcaactgtattgacatatttatctaaaagcttaacaacttttcaaaatgtgaatatttttattttctttcttactctctgtcccagtcatgaagtcagggacaaatatctagtctcattccttgtactaggattttttaaccttaattttcattttttaatttattttttctttaataaatagtaattgtacatattcatgggatacagagtgatgttgcaatacgtataatgtgcagtgatcagattagagtaattagcatatccatcatctcaaacattcatcatttccttttgttgggagtgttcaatatcctccttccagctttttaaaactatatattattgttaactgaagccactttacagtagtataggacactggaacttattctattttgttgttgtttttactgcaatgtttctcacccccaatttttgctccatactttctctttgttattaaaggataagcaatatatattctcctgaaagatcaggtggaaacaaccttttccatttggaattcctacaggctaatctcccctacccccacctggagtcctgcttgcatgtcttttattcctacaatcctgctgcaatgggtagtaccaaagaaagccagtggagctcaaacttttgaaaggacacacacacacacacacacacacacacacacacacacacacacctctagaataaaaagctcatgtctgaatggcttgtgtctgaacggctccataatttattcttcaacttgccactctcccatagtagaggttagatgactctattttattttttttcttctaacctatctctgaatagaaaaagaaactgatttagaatggagaagtcgggggaggagccaagatggctgaataggaacagctccagtctacagctcccagcgtgagcgacgcagaagacgggtgatttctgcatttccatctgaggtaccgggttcatctcactagggagtgccagacagtgggcgcaggccagtgtgtgcgcccaccgtgcgcgagcctaagcagggcgaggcattgcctcacctgggaagcgcaaggggtcagggagttccctttccgagtcaaagaaaggggtgacggacgcacctggaaaatcgggtcactcccacccgaatattgcgattttcagaccggcttaaaaaacggcgcaccacgagactatatcccacacctggctgagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaggaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagattctcctcgagaagagcaactccaagacacataattgtcagattcaccaaagttgaaatgaaggaaaaaatattaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatccagactaggaagaaactgcatcaactaacgagcaaaatcaccagctaacatcataatgacaggatcaaattcacacataacaatattaactttaaatataaatggactaaattctgcaattaaaagacacagactagcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacacaccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaacctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcattaaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccagatcatgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgcgaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattggtagatatacctaatgctagatgacacgttagtgggtgcagcgcaccagcatggcacatgtatacatatgtaactaacctgcacaatgtgcacatgtaccctaaaacttaaagtataataataataataaaaaaagaaaaaaaaaaaaagaatggagaagtcaagaacacaagactttttggtatgtgcttgaatactacaattcatttcaaaagaaaacatctgtagtagttcaagaatcaggggaaccacattgaaacaggaataggggctctttgaagcactcttctaaagtgagtagcaattcataatgacaatatttccatttattcagcagttactaggcaaaaagcactataacaaacactttacatggataatatcacttcctcttaaaacaacactgagatacatgtgttattttccccatttgacagataaggaaaataagaccaaagaagttaagtaactattaaaatactgtttgacaaatccaatcaagactccaggctaccaattaccaaagttagctaacttatcaaatacaggtttaacttgctaacttgttaacttcataacacgctaacttgtcaatccttctttaacaaaacttgaagtctctcaataagttttatttttaaaaaaagtgagagagagctgggcacgtggtggctcatgcctgtagtttaagccacttgggaggctgaggcaggaggattgcttgagcccaggagtttgaggatatagtgtgctataatcatgcctgtgaatagccactgcacttcagcctgggcaacacagtgagactccatctccaaatttttttttttttaaaaggaaggaaaagaaagaatccatactatgaaataatctatacacaatttactaacatttatagaaaatatctataagcagtctgtaggcatacccatcgcatgattctattgttaactaccatgtgtcctcaataggacattttggaagccttggataggagtgactagggtaataggtacctttaagttttaatttaggagctattttattatctacttatgtgcctctattgttccaagtttttgtcatttttgtcattatcattatcatctaaccttagtgagtgcttactatttcctaggtacagagcttttcaaatattatctcatttcattctcataaccatccgtttaagtaggttgtttttcatttttattgagatattatacaaacaccacaaaatttaccattttgtgtgcacaattcaaaagtttttagcaaatccagttttgtaagcatcatattttcatcactcccaaaagaaatgccattcccattagtacctactcctcattcatcccttcctcttgcccctggttaccactaatttcttttctatctttatagattatcttattgtagacatctcatataaatggaataataacatttgtggtcttggtgcctggcttctttcacttagtgttataatttcaagattcagctatattgtaacatatcagtacattatttttgcttgtggccaaataatagtccattctatggctctatcacatttgtttaaccctttatcaactgatgaacacttggattgttttcactttctggctgtcatcagtaacgctgctaagagcattcatatacaactttttgtgtgaacatatattttcaattttactggatgtatacctagaagtgaaactgctgaattatatagtaactgtgtgtttttgagaatttggccacattttctttcacaagagctacactattttatatatcaaggtaccagtttctccgcctttttgctaacacctcttattattcaacacttattattatagctatcttagtgtatgttaagtggcatctcattgtggtttcaacttttaagtctcgatgataacgtttaacttttttttttttttttttttttgagacagtctgactctgtggcccaggctgaagtgcagtggcacaatctcggctcactgcaacctcctcctcccgagctcaagttattctcctgcctcagcctctggaatagctgggattacaggtgcatgccaccatgcctggctaatttttgtgtttttagtagagatggggtttcaccatgttggccaagctggtcttgaactcctggcttcaagtgatccacccgcctgggcctcccaaatgtgtttaacatatttttatgtgatgcttgactatttatatagtttatttggggaatttctattcaaattatttgaccactttctaattgagttattcatcattttattgttgagctgtaagatttctttgtattttttagatactagtgccttatctaagatattaatacaaatattttctcccattctgcgtgttatttcactttcttaagtggatcctttgaaatacagttgtattaaattttggttaagtttaatttatctattttttctttgatgcttgtgcttttgttgtcaaatctaaaaaaccattgcctaagctaaggtcctgaagacatactcctatgttttcttgtaacagttttagagttgtagctcgtaccttcagatttttgatcattttgagttaatatttttgtatatggcatgatgtaggggtctgattttaatttatttttccatttggaaatccagtggttcccagcaacatttgttgaaaaggctatctttcccccattgaaagtcttgccactcttgtcaaaaatcaattgaccataaatatgagggtctgtttctggattttccatttaaattattatgtctgttttataaatgaaaaaatgaagcttggagaggccaagtaactggctaaagatgacaatgtaataagctgggattcaaagttggttaccccatctgctgtattcttaagcactgtgctctgatgccatgttacaagtataatctgcactgatacagactgcactgattccttttttaatctcacagttaataaagtagttgctgagtattcttctctgttcacgcttaaagtatatagacatatatatgttatagaatatatatatatatactataactcgaagtattattgtctctgttttccatttcaaaacatgtctatttgacagaacatcagattctctccatttcccgacatgaatatcttgtaaagactaagctcattataacacaaatgtcagataaaccaggacaagaagcaatgttctacattggatttagaatctaaggatagttctccgattcctgctgtgtagctagttagttacctatcccttgaaaagcccctcaacttctgtgttgtcacttcttccctgcaaaaggagaagtgtgaaatactagtctgatatatctaaagtcacttctatatttataaccctagtttgagaggtcttcctcagggcttgtgacaaatgaaattgtaagtttgtatttcatatttatacaaaagaaagagaaaaacgtagtagacccacaattttaaagagattaactcatactttaaaatatagaatgaatttactgcctagtgtgaaaatttgctaatggtataaaaatcaagatgattccacaataaaggcataaaaagtacataacaatttaagggttttttttgtttgtgtgtttgtgttgtttgtttttatccaaagtttggtcaacacttatggtacaagatctctaaaaattttgaggagtgcttatctagaagcgcaggcataactgaacatttatccaataattttaatcaatactgaattttaaagacttagacatgagattttcataaattcagaagaaaattatttccaacttagaaattttaagcttatagttttggttcctttagaaagccaacagacaattttactttacggatagtattttctgaaggaacaaatttttaagttctccagtatcacagttactattgtgctgtggctaataatgaaagaatactcattatctaggaattactgcgagtctgtaaacagtttatctttcttctgaaattggctaaaagtattcaatgacattactgaagtcagtctggtaggtatttaaaatttccgtcattgaggaagctaatacattctttctcagaaagggaaagctgtctttttatttttttcttattaatacatttttatcatccatatctaagaaacgctcatcccataaaatgcttacagacattaaaaactgctttgctggccgggcgcggtggttcacgcctgtaatcccagcactttgggaggctgaggcgggcagatcacgaggtcaggagatcgagactatcctggctaacacattgaaaccccgtctctactaaaaataagaaaaattagccgggcgtagtggcggatgcctgtagtcccagctactcaggaggctgaggcaggagaatggcgtgaacccgggagccagagcttgcagtgagccgagatcgtgccactgcactccagcctgggcgacagagcgagactccgtctcaaaaaacaaagaaacaaaagaaacaaataaacaaaaaaactgctttgtttttttttcatttaatgtttaaatacacgtttggacgttcaaaacatatcttgcaataattgtgtttaaataaatgtttggacgttcaaaacctatcttgcaataattgagatccatttaaaagaaaacagagcaagtatatgtatacatatattttacatatatataaaagaaaaaagagcaaatatatataatatattgcaaatatatatattgcaaatatatatatattgcaaatatatatatattgcaaatatatatttgcaaatatatataatatattgcaaatatatatatatagcatatatatatatatagcatatatatatatatatatatatatatatatatatggcaactaatgtgtgtgtgtgcgtgtgtgtgtgtgtgtatgcctaggacttccatggaaaagattctgggaacagcaaaattcttttaaggaagaatccacttttgcaacttctttcagaaaagtgagaaattcaacctttgtcccctccactgatgcctgctaaaatgctgaatgtatttttcattggtttctgagctccctacacagatatataagaatccagaacgcagatcttagatttagaagctgagaaagaagtgggtttatggttagagtggcactaaactctgaatttcagggtatggaggaagggtatggaggatgatccaaaagacagtgagtaggaagatgcagatgggaaggcagataggaaggcactagaccagattaagaaggttgggggaaaaagttagggatttgaaccagacagattttctgagctggggtattatcacaatggaaaggaagaatcactgaggaagaaactgttaaaagcacaaatacactaagaaattcaaatccttgaaatggttaaaaagttacacagtagcatttcagttttccagtatctgcgtataaccccatttactgaaattaaaccctatatttattattctaattaaatatgaaatcatttaatttgtacaaacattttttattacatttgcaatttctttaatcaaaagtcttcttatttatagttgggaatgactctgtttttatcagaaaccattttatttcttctcatggcaggcttatttaatatattccatatttgcctttagtctcatccagatctcatcaaacatgaaccattgttttcttcaccaagtgtccaaagggtcagtatcaatggtcaagggtccactctaaatgccctggccctgcagccacccttaagaacttttgttaacatttccactggagtatttgggaatattcgccaagagttacaaagaaaacatggctagtgaagagaaacatttgaagtatatacaatcaataaaactctcatccaaagcacagctgcttaagtagtttccatttctctacctccagccaaaaaatacagtataccactgagtgggaaaccttgcttaaggaaggtcctatgtagtttatttggtctgttttatggggatttcctcacatgataaatgcgaggagattaagaactcttgtaagggatgctatagtggagttaggccaattcaaccatagtaaagtgtaataacttatgaactacaggtttaaaagtataataaccaatgcttttccctattagtctctgtttagtatttgcacaatccattctttatcctagtcatgcaaataagcatattacttaatgttattatgaattaaaattatttattgcattcactttattatattgaattgcccaattatttttgaggcaattttaacaatgtaaaaatccctaagcatatttatttagttttttgaaaaaagaaatagttcattttcatttaataatattcaaatcatcttaattgccttcaatgatacatgtaatgttttgaatcttaataattagagttatttaacttgcagggtaaccaactatgtactggaaaatgagggcaaggctccaattaacgtaggaaaataatgtttgcatgttttaataacttttaagaggaaacataagatttgaactgtaaccacaatgatagatgctagaaatggaaaacacacttgtttgcttaattcatttttaaatatgtacaaaattattccatggaaaatgtagatttgtttaattaatattaatttgattgtacttggaaagatacattgaagggaagagactgaagcagagaaacaagatctgttagtaggctacagatgtgcctaggtacaagataaaacagtaatagaaaatacatcatcaccatcgccatcatcatcatactaagcagtgttaaaactgtttcaaaatatttcctgtttaatcttcatgcaatatataagtaaatgatttgaacacagatccatctaaccttaaagctcatttttctctactttaaaatcatctaatgatgacattaatcttatttctgtgatttgttgaagtgtcaatgaagcagccatatagaagtgtcaaaaacattctatcaatgcatgattaaagtatgataatgaggttttcattctatatagttagtagaaacaaaacgatccaaaaataaggactagccttcatatttattaacctaagagcctgccatagcaactactattgctactactgctaataatagcaaataccatttattaactatttctggcacattcgtacaattattactatctggtacatttcttatttatcacgcatctttcttcgctagaatgtaggccccatgagagcagcctcttggggctattttgtatattgctgaatctctagcttttacattacatatagttcaaagtgctgaaaacactattattgaatgaacaatcaatttcattgatctagggtgtaggtaattggcttagagaagataaaacaacctttaaaatgggcccctggggttagagttccctcctaaccacaatgtgacattgtgatactgatgagctttttttctaaacaccatttttctaaaaatgagatataaattttttttttttttttttttttgagacggagtctcactctgtcacccaggctggagtgcaatggtgcgatctcagctcactgcaacctctgcctcccgggttcaagcgattctcctgcctcagcctcctgagtagctgcgattacaggcatgtgccatcatacccggctaatttttgtatttttagtagagacgggatttcaccatgttggtcaggctggtcttgaactcatgaccttgtgatctgcccacctcgacctcccaaaatgctgagattacaggcgtgagccaccacacctggccaagatataaacatcttatatttgatttaaaccataacaccacaaaagtgaaaaataaagcataatgataatagcaattatttttctacaaaatcataaatattcacttattaattgcaagcagtctggggaaattaaggaagaaaaggtcttattcctatttcacagacttagaaattgaaagaggtaggtgaagtggcacacataaatttaaggatgtagcagtaatgacaagatcatcacccagtgtccactgtctctgtttattcactagatgataaaataagagcgcagtatgtggttagtgtgcttttagtctaaagacatgtattcgttaaagcttgtttaatacaagggcatttgtcagtttatgcattttattatccaaaaaacctgatagagtttaacagaagttgaggaattttgcataaagattacttcttgaatgttatattttaattcattttcacttacaatatatttagacacaagtatttttatgaggagttaaaacctgttctacccattgtatttgtggtaactgtcttcaatgtgatgacctgcttggtcagatattgtcaatttctgtaactcaggacttcggcgccatttagtattcacccaatttatcatttcacctttgaattaaacaccttttaacccattattttgccgcaatgataaatcattaacttcaggacatacttaatttttccttttcatgctctaattacatatttgtaaggtcaccacaagttgaatcatttttgaaatttttatttttaacaattctaaggaatatacaatgtttaaaatattttagcaaatttatttggaaaataaatacaatatgggcacaagatgtcacttctaattctaaagtatacttaaattataaatcaaattataaaaagtttttactttaactggatgagcttcatttattaattatgttttcatatattcattagctatgttattataattgaaaaaaacatgagactagaatatgccaatgatttattgaaatgctattaaccctcttttattaatttcccaaagttttaaatctataaaattcagttttatcatagggatttttagatcaaataaaaaggaagaaacttgatccaaaatatgtaaacataaacctccagagatcctaattaaaatcacaaaaattacctaagacttccattattataactcaagctctcacccacctttgtaccctgttctggctttgttgacttttgatgtcattgtgatggtatgtaaacatttattttatgtctgttcatattatatttaataaatacatttttactaaataaataaattttatgtttatgcaataagtaattctatcacaaagttcttctgctgtcagcaaaattaaggcagaaattttactttcaattctatttctatgcccttcattctataaatattaaccaaagttgacaaaagagttgtatgtaatgatagtattttaactaagatatttataatgtcagatgttgttagctttaaatgaaagactaccggtgtgacctcaatctttcatcaagaaatatcctagaagtcccatgaataaggtgatacatttaatcatgtgacaacagtgattaactatggattttgctgtgtccaaataaatttcctttgcatacttccttcatttgtactattcataaatacatttatttcatacatatacatatgtctgttgcatctctctctccatatatatgtatatatgtacacacacacacacatccctaatacatagccctcttattactacagctatatctatatcatcttccttatatatcaaccccattctctctctattatatatatatataaaaaatgatgtatttttctattaataaggcagatgaatggatgttataaatgctattacttgactttaacgttagtgtgcataaacagatttttggccttctaatttgcatgagtcttattctttcattcaataacaattgatttattactttctttcccctatttacatgatatgagaacttacagtgaggactccatgtaatcactctgttacatattatattaaaatcctttagtgcatcttttagctagccaaaatgaaattcagtgtgaagcagtgcctcaggaaacaaaagcagttgtgacagcatttctaaggagagcaactgtatgtatcaccaaacataaagggaaaaagaggacttgcggatatttagtaataactggatttcaaatagatattatttaataaaattaatttatattgttaatcgagaagttatattgtaaattataaaatgccattattaataactattatgtgccaattccgcacaagtggacataattatttgatatttatagtaagatcaccaaaaaataatcagtttgctttatgatactatacatcactatcattcttaaatgaaagataatataatttccatagtagagacagaatgtctgataaagtaatatacacttaatgccgtagcaacattccttaaacttttaaacactgtcattcaagttttatctctatttgtcatccaatataggtttggcaaaattagaaatctcttattaggaagtaaagagaaagtttgtcttcataaagtggctgtgaacaaattcaaactagaatttgcataagccaattgcttatacaactgcctgtttcttcaaacaagctcactaaagaatggtcacatttattagaatttctgcttatttagtatccacccacttaatctggtatccagaaagaactcaaaatccaaaacaatgatggcatctggcaattttactattgatgcacacatttcacagaagatcaaagttgtatgatttgacagtcagcagtgtggattttaatacattcaatatccaagatggcagcttgcatgggagtcccttgctacatacaaagcttccaatacagacacgttaatccaattcaaacgtaatactgcctacaaatgaatgctacagcagccatcttaattctctatatatttagaatgttcctccaaaaaatgtgaaagatttttcttctttaatcagggcatttttccccctcaatatgtagctctgtcttaagcataaagacattcaatccactgttttggttgagatatctggaaaaatacttgaagtgtcaattataataatattctttgatcaaggttttcaaatcagtttttaacacacaaaataagctaatttttttctttaacagctatgcatagaaatattttattagtttttaatcacaatatttttgataaaaagtttcaaataaattaaaaagtaatttatttgaattaaatgtgttttatttgaatctaattttatatttttctaatctcatatttttcatctaatctcattttttatctaatctcatatttttagataaatgtttttatttacatttatattctattcacatcaagaaaatcattatgtggttggaattttcctcttctacagaatctaatccttagaacaatgtaaatataatcaataaaaataaaacatcgtgaagattattcagtgaagttaggcaatatatgatccattggtcattatttagtccttcagaattcttatgttgcaaataaagtaaaacttagccttttgatttaacaatattttgaataatctttctgacctaggaaaagatataaagctggcagaaataagatacatttaaaacagggtccactgataaaactgctttccaaagaaatgaaggtacatgtgttaagaggtttaacacattattcctataggtcagtaggacaggaacattaaaattcacttataatttagaggttgttaaattaattgggaggttgttacaaaaaaaaaaaaaaaagaaaggctgagaaaattccagtgctttagtttcctatgtaagcaaagtgaagtgtgatgtaaacagtaaaatacaacttaagcttagccaaccagaaactgccacctaatatctaattagggactttccaccatattatatcaaaataaggcaaatggctagctgcagcaaattgagcaatttctttactttgcttctggattcagctgataaagccccctactcatgctgctaaaacggagcactctaaaactcttccaattctgggtgctgcccaattcataagccattctttgttcaaataaacactgtcatttttatgcctttgatataatgggctttagggacttggtggggagaagggggaaagggagtgagggacaaaagattgcacattgggtaccgtatacgctgctcgggtaatgggtgcaccaaaatctcagaaatcaccaactcaagagcttatccatgtaaccaaacaccatctgttcccctaaaacgctattgaaataaaacagaataaaatacaatttaaaaaataaaataaataaaaatatataaagatgagaatatgaataatttccctggccaaggattaaaaaaaaaaaaaaagttgagatctgaatctccttctggtccccttatttaattttctcattaactcttataattgttaagttgattgctttgttctttttaggtacagagtcatttcatctgtgaataaatgattttgatcaatgaaagagtttaaaatagtgaaaaaaaactgtcaaatttaatttgtcaaaagtttttcttttaacagcattcactagacgcatatgtcctattaactcattcacttcatcaaaataaaaacacacaaaaatcaataaaatatagtatgaggtgaagtgtataattcacatctgctaacttagatttcaggaggtggctctggagctaaaactagctgctggctcttagctatacctagcacttaacctagcctgagggacaattagaaaagatagtcttgaggaaatcagctgaatttaggagactctctcttatttttacctgcaggattttcttgctttaattgctactgtcaccagccaactggttgactccaattaaccctagggaaaatgttacgaattaactattttgtcttagctctgctacagtcagtcctcttcccctctctttatacttggtttcatttgtaaaaaacataagcaaagagtgattatcaatgtttacaagagaaaatatcatttcaaatttagcatgggttaaactcatgcttccaagagataactcgtttaaagacatgaaagtaatttctaggtctagcctctgtttctattactgtatttccatagtggttgtctagaaactacatggcactgattgatgccaacttaatgaggtaatataattgccaaaaacactgaatataactattgttggaaacatcaaataacttatttggaacagacataagattatcagagacataatttgaaaaagacaaaagttaagtctatatggaatagtccctgggaaatgcaaatcaaaaccacaacgaaatactgtctcacaccaatctggatggctattactaaaaagtgaaaaaacaacagaggctggtgaggctgtggaggaaaggaaacactaatatattgttggtgaaaatgtaaattagttcagcaactgtggaaagcactttggaaatttctcaaaaaacacaactacattccacccagcaatcctattaccgagtttatatctcaaagaaaataaattgttgtaccaaaaatatgcatgaagttgtacgttcattgcagcactactcatcatagaaaagacatgaaatcaacctaggtgcccatcaatggtggactgcataaagaaaatagggtacatacaccccccatggaatactatgcagccatgaaaagaacaaaatcatgtcctttgcagcaacatggatgcagctggaggccattgtcctaagcacattaacacaggaacagaaaaccaagtactacatgttctcacttacaagtgggagctaaatatttggcactcatggacataaagatggcaacaatagacacgggggtctactagaggtgggaagaaaggaggggagcaaggtttgaaaaactaactgttgggaactatgcttactacctggctgacaagatcgctcatatcccaaacctcagcatcacacaataaatccttattacaagtctgcacatgtacctcatgagtctaaaataaaagttgaaattgtttataaaaatgatataaaatagaaccacaacgaaatgccactacaaaaaaaaaaaaaagaatattgtttggttaatctcagcaaagaggaatgttctatacaacatttttgaatcttctccagcacagctttcattctaacttgatgcaaacatttccaaaagtttaatcacaattacaaatctggattatggcaatgtctgaatacaaacattgaacaaaatctaacaaatgttctgtcatttaaagaactccagacaaacagaagagtaggaaaggcagggacccaacatgagctaaacacttcatgtgttccaggaacacagccaggatcttagcaccaatctaacgtcagaaggcagaccactcaaatcaaaaggttgaagaaaggaggctctgagaggtcctccaactgggacaaaaacatactgtaaacttagattcacttgattctttctgttacttgctctatgagttaccaaagtcattaacttctggtggatcttgtccttacctgtaaacttagaccattgattgctaaatcctcttcaatgtctaaaatacattattttaaatatatgcagtcaactgttacagtgttacagtttttttagtaattcagagaaccatctcagtcattattactttcaattctaaactacttcccgtgttattttttgttaccaaaatagatattaaataatttttaaactatattttctttcttttcttaaatttaggaaaatgagctgacttattttcccttatttcttaaatacacattatttttaaatggtgtcaagtgtaacattgttgacaaaagacaaatcatttgaaaccactcaggtttttaaacatgcaactcccaatagtattaattgaagtataaggactctagctgctgagatacttgaagaactccctttggattgcctgtgagtctttcaaaacaattaagtatttgcttcagttctctgtgggcacaatcctaaagatgaaagatgcaattgtctatttacagagagtacttttaagagaaggcattgcttcctgctgccacgtagcagggcatatcagcaggagtccatttgaaatggctggtggtttttctctcatcaagtattccatatatcagacaacataggactgaaaaagaaaaagtatggaaaaactaggcatgattctgaaaattctattttatatttcttcaaagataaatcctggactaaaccatagccttttaatgtttccggtgttcgttgaatgtgattgctttgttattgtttggttaatctcagcaaacacttctaaattcaagagaaatttcttcaatcctgctctttttgttctgagctaagacaggctgataacagtggctggcactagtgagtaaattttataaccaaaactgacatctcactcaagtacccacaatttaaaagagtaatgaattgtcagttttaactggaaaggggtttttatgtgattttagaagtcttttgaatatttattttgttccactttacacgaatctgtctaagatttatcttgttacttccaaatgtaagcctctcttggccagatttggaaaataaattagaatttacaaacattgtgaagaccgaatcaatacattaatattgaggagatgtttgaaagatttattaaccacaaaagatagcaaatattacatcagaaatattaaacatgtgtaatcaaagtcatcaattgtagttatgcatagactctataaatagtatagagatttacttaaatatgctacagattcaatccagtctatcatacgattatagcttacaggaagaaaagcaagaaattaaaactaaaattgacagatggagtaagacagtacatctttttgtgtgttttattcccttatcactgatttttaaaagtaatgccacatacttggacattaaaagtcagccaagtaatattcagtgaaggttttcattcagtcaataaatatttaacgaacacctattagaggccagaacacatgctagatgttggcgataaactttgaataaggcatcatctaaactgataagggacttagaatccagtgtataaacttgcgagcaagcaactgttgtaaaaatatggacaattaaaaactggaatactttgggaaggatcttggtacaaactggtttcaaaaatttgcaggtaacgaaatacctggatacctaataagtaccaacaaccctcaaagacagacgtgattattctcattttacagaggagcaaactaaccctgattgattatacaatttgatattgttcactaaaggtaataatgctgatgctgctagagtgtaaatttaagtccagataatttgacttgaaaatccattctatttttgttttacaactctgcctaccattactgttaattaataagtaaaattccattcaaagttacatttgtttatctggcaaaatcttaagcttttaaagtaggttgagtggccatgtatgagactcttctagagccttaggtttttgtttttgtttttgtttttgagacagagtctcactctgttgcccaggctggagtgcagcgggacaatcttggcacactgcagcctcggcttcgcaggctcaggtggttctcccacctcagcctcccaagtagcttagactatgggcacacactacaaagcctggctaattatcttattttttgtagagggtaggtttcaccatgttgcccaggctggtttcaaactcctgagctcaagtgatccatctaccgcagcttttcaaagttctaggattacagacatgagccaccactcccagcctagagtcttagattttaaccagaatttcctgtagtactttaaaaaaataaaagagcttgagaaccaccctagtgagagaaatgtaattctattttttattgaaatcactgtctagatacaagtctgtcaagcattatacagaagaaaattaagacaatatactatttattagtcaatgacatttcttcagtatatttgattaaagtgtatttgaatggtaatattttaattgtattgaggcttaattaggttggtataaaaataaagcaatatgtaagagttttataatatgatttttattaaaatatgattaagtgtagtactgtggaaagagctctggtcaggaatgagatgacatccacttaaaacctggctctattattactatctttttgatctgcagcaagaaactcaactactctgcattttaattttattttctctaaaataggattaatatacctattcttcggtcctgagggagttgtaaataatgcagaacacatttaactgtaggtatgaataatggtaaggcatggattctaagccccatgagaacaggagctgttttgagagcaccaataccagaaagaatagtggccaagaaatacaagattgttttactaaggttatgtgagtagttagcagcaaagctggaattaggatctttagtctctgaagtgtagttactttccactacactagtgtttcccaaaataaacaggtatattgagaaagaaagaaagggctgttgtgtcaagaaagtttgatagaagatcgactgaacagtaagaaatttaaagggtaagctttgtaattagtctttaacttgagccttggttttggtactttctattggtatcattatgcataatttgctaacctacaagagtctaccaccacaccccatttcctccttcataaaatacagatgagaataatgtttataatttgttgctttttgggttgactaatatattaatgggtatcaagaatgtaccctggtgtctggcaggtagtaatgactacaacagccatagcatatatattatatgtctgtggctgttgtaacaaattatcagatactttgtgacctaaaacaacaaaaaatgcattatcttgcaattatgtatgttaaaagtccaatagtagtcctacagggcgaagaccaaggtgtgggcagggctgctttcttttgtggggactgtaggagagaatgcactttcttgtcttttccagcttttaaagactgcccaccttcctcctagtctcttcctccatcttcaaagttttcaatagggagtaagtccttcccacatctcataactctgatctgtttttctatatttttcttctacttataataaccctcgttattacactgggcataactagttaataaaggatcatgtctctattttaaattcaactgatgagaaactttcatttcatccgtaaccttaaatcccttcaccacaaaaggtagcatattcacaggttataggaattaggacatgacatctttgaagaccattattctgtctactacagctactctgataaacgtcattcttacaggatcctgtctgcatttatgatttgtatgtcttaaaggggagtatagtattcagagtttcaaaacttaatttgagtcccttttattgcagatcattttttggaacttttactccaaagaatacatttgaagcaatataagaataatgtagtctaccatattgtctcaaatatatttgttaataaatggactgtgagaaaggatgaatggatagatggatagatgtatgtacatgtgtgtgtatatatatatagtacatgtatatatgtatttatgtatatatgcatataaatttcctatttgaacattttcatgcattttgtaataatttcaacttaactttgcaaaataattttatcttttatctgacatttttagcactaattttaaattgttggacatgtgtgattcagtgcaattctcggaagaaaattcttatctgtttgagtaggttcaaaggtccacaatatatcctaaattcatgttatttctagcctcatatatttattaaaatatggaagcaatcatttttaattaaattaaattaattaattaattctgagatggagtctcactctgtcacccaggctggagtgcagtggcgcgatctcagctcactgcaacctccacctcctgggttcaagtgagtctcctgcctcagcctccaagtagctgggataacaggcgcctgccaccacgcccagctaatttttttatttttagtagtgatggggttccgccatgttggccaggttggtcttgaactcctgacctcagatgattcgcccacctcagcctcccaaagtgctgggattacaggcatgagccactgcgcccagccggaagcaatccttttttacattacatttctacccttacttaatacaaacaagacaagaaaagaagcctgcataatgtcacttctaaacccatattttgcatgtgacattcccatgttctcgtttttggatgtctcagccttagcaattcgattttgaaggatgaggaaatatgttaatactgaaagaagactcaatgccaaatgatatgccttcataaattgattagaattttctttctattcattttaccctgatttaatttctgattattttatttctagttgttcagcatttctaatcttttataacaaaagaatggatggcacatagacacaaaagaaaaagaaacagagcttccatttctgaattctattattttacagtcatttacacatggttgcaaactctagtaacacaaagtgtttcctctgaaggaaaggaaaaaaaaaaaaaaacagtgataactaagtacactccttagtgtatgcaagacaaacaatatttttcccagtatgtctctaatccctcagtgataagcttctctgtgaagagttgatcacaataccaacattctctccattaacataacaattgctaaatttaaaacaaagacattctaatttgaacaatataagaagattgtgagatatttctggtccttgagatcagagcttatggtcaacttaggatatgattctgagacgccaatcctgaacaggaattaactctttcttagccaatacctaccaccatttatattctgagaagacacagaggacaggaatacattattatatcctgaggacaggaatacattattttccttacttcagtgtctgactcatcttggggccagcttctctatagacagaatttgtccatcctttacttcaacaatcaaaatgtaggtgattgttacattaatgcctgatcaaacttaacctttttggattttttcccacatttcacagaagagctaaatgaggtacaaagttgtgctctgaatggataagttaactggaaataagtctaagcccaggtaatgaaaaccagatactttaaattatttccattcatttgatcatcccacttttcatatgatttcgagtttggtgctatcatttgctgttgtcactcccatttaccagaaagtggtgtaagccccttctctctttcctagagaaatgtgggggtgttggtttagtcatctcatagtttacacaaagcatccacatactacagtattcagtccgatggaaagataatgtttttttcttgagaataatttttgagtagcctcctgatgggaggattgagagctaccacagctcatgtagtaatctctctcactgtctctgtctctgtctctgtgtttcttgcttgtgtcataatatcaaagaagttaggaaacaatgttgtttcccttttcagtgtttccatatagatactcatgatgccatcatttgtctgtaatcactgcctattattacctattttaactaagtggatttctttgctcttgtgttcttatttttgctattgctaatggccatcattttgtttataaagtcttttgggatgctattaagtctttcctcttcctttagttgaaaccaaaagttttttccaatttgggctgcaattagtctctcattacgactgttagaggctacatcatgaagtcctttttttttaatgttttgtcaggctaggagatgactggactaaaataaaaataaaaaggttagcaagaatctcattaattctgattttaaaaagtgactaagtggcatttgaacatatttagatatgataagaagcctttttgtcattacaaagttgaaaaatggcttggcatatgcatttatctatgttgtgctgtcatcactaaagaatagaaaaaatagaaagttggagaaataagcagctaatatttataacaaagttgtttgacacatctattgaataagaagttagagtaataaataaaaggagaaattgaggagcaaaaacaaataactgaccttttcatcgggttatgaatgcacacacaaacctcttaaaagatatttattatatataataataatagtgtcattcattgtactgactttgtgtccagttcttaacacatttcatttcttaattttgaaggaaattctataatgtgggtttcattctccacaaaacttcccatagactaagggtctcaaacttgggttaatatagctcctaagtggcagagccaaggtccacgttcagataagtcttactccagcacgttcatcctttccaatgtgtatgcctgtgtaatatcgtaatttaggagaagccattttctccacagaacatggttccattagtaataataacataaattaattcattaagagatcatatattgagaagtataaataagcatattacttgccctcatgtggtttacctttgagcgagaaacacagatactttaacaagtaacagactatgataggaccgccaaaaggatgttcagagatgttcagagaagaaatgattaatcctacttagagggaaggaagagtgcttaggaaagaacaaaaacacagaggtgtgacacatcaggttctttaagggaagagcaaaattttcagtattcccagagggtaagggtgggcaaaagagagaagagaggggcagaaggattgttgccctgggggaagcagggagtgggggtttccctgccattctgactacacttcttcctacagagatatccttaaactagtatcatttatttaaatgtttattttatactatctgatgcttcaatgtctattaatattataattttaaaagttaaataaagtataaagcataaagttaaaagtatgatgagtcttatcagaaacaaaatgttttatgttctcccttactaatcatcaggatagtaagcaacagacagcaaagtttaagcaaagttctacataatataaagatccttaaaaaatacccattcatcatgaaacactgaaaatgtaaagaatatatttagaatcatgagatcaaaataccaggccaggtgctgtggctcacgcctgtaatcgcaacactttgggaggccgaagcgggtggatcacctgaggtcaggactttgagaccagcctggccaacatggtaaaacaccgtctctactaaaaaaatacaaaaaattagccaggcataggggcgtgtgcttgtaatcacagctacttgggaggcagaggcaggagaattgcttgaacctgggaggtggaggttgaagtgagccgagattgcaccattgcactccagcctggacagcaagagtgaaactctgtaaaaaagacaaaacaaaacaaaacaaaacaaaaaccagagatctttcaattccaagtgcatagtactctaacttatcattagacagattattcccagtgaaagtcctcattttttagtcaaccataggtagtgtttttattctgagcttagcaaaagaggtccatggggctgtgtgtgatgggcaatttctgattatttgactgacaacgggagtctgggaaaaagagaaaggcagaggtcactgtcacattttcttctcagtgtttcctgtgtgtgtatatgccctctatagctccatctgtgtcaatgctcattgttttatgtaatagagaggactgaggccacacttggcacagcagcctgtgcactgggcgccaatggctactcataaatgtcacgctatagtgatgctttggaatgttaaatattgcactgggataaggagagagctggaaaactatgaatcataccgaattaaattgttatatttacttataataacccttattttttcagaaggtgatgtactagaagtctgacctcttcatttatcttgaagaaataaaacagaagacaaatttgtgtctgaaatatatagctttctatttgattaactccatattttaaggcttcagtatgttacatgaaatatctgtgaatttgaagggttcagagattaaaacattctttctctttgatcttgataaggccatatcaattttttttaactacatgcaaatgtaaagagtaagtcggacgggtgcggtggctcatgcttgtaatcccagcactttgggaggcggaggcgggcggatcacgaggtcagcaaatcgagaccacggtgaaaccccgtctctactaaaaatacaaaaaattagccgggcctggtggcgggcgcctgtagtcgccagctactcggagaggctgaggcaggagaatggcgtgaacccgggaggcggagcttgcagtgagcccagattgcgccactgcactccagcctgggcgacagagcgagactccgtcttaaaaaaaaaaaaaaaaaaagtaagtcatatatattttggaagcggccaaattgaacagcaaaccactcttcaaaaagcacaaattgagttaggttgcctttaagaacgacctcactgctgtgtgctctactgcaacgttaaaagaagaacacatcatgcctggcgtggtggctcaggcctgtaatcccagcactttgggaggccgaggcgggcggatcacaaggtcaggagatcgagaccatcctatctaacatggtgaaaccccgtctctactagaaatataaaaaattagccgggcatggtggcgggtgcctgtagtcccagctactcgggaggctgaggcaggagaatggcgtgaacccgggaggcagaggttgcagtgagccgagattgcgccactgcactctagcctgggcgacagaacgagactctgtctcaaaaaaaaaaaaaaaaaaaaaaaaaaaaaaaaaaaaaaaagaagaagaagaacacatcatactgtcaaaaacaagtgtatgaactgtgagctcaaaagcccaaaagccttgcagtaatcccaaccacatgtcaagtctcagaaagtgggacggtttctcctttggagttggggaacaaaaaaacactccaaggtgtgcaaagccagcaactctccatgagagatggatgagccttcaatggtttctgctttcaaataattgttcaaatggtctgcaaggtatcttcattagctaaataaataactttgagagcaattttttatttgttcagagcagacttaaagtaactattccaggagtctttactaggtcagaggcttcaagggtaaatttatgttaccttgaaaaacacacatagctttttgggtaaaatgctctttttaaatgagagtatggtatgctgtgccaaaaaaaaaaaaatcgagtaagttgaacctgaaaaaatgagttttcttctttgtgttgttatcctgacatttcattcttggtcactcaggccccaatttgctaatatactcaaagcctgactcacttcacatcatttcattgtttgctcagaacagattgtataaccagcaaagttagaaggtcaagtttatcgattaaaacccacagcaatgaaatatctgttaagccggggtaactgattcccatgtggcttaatccacatagaatttttccagatggagtgattttgataaaaatttgcagtactgtgagatttcaacaaaacaaaaatataaatagatgcattattattttaaaattacagtgctcacattcacaagttgaatgaatacctccacctctacattcttccttccatttctacaggatccacagtagttctcagctctcactcaaaggtggactaacacaataattttccagctggattctctttctcaagtgtttacatcataattgtgttttactcaaacaaaatatctattatgctgcttccgtcttcctccataatcaaacccaagctgatccaaaaagatgcagaagggatcaccaatataccaaggctcgttatcctgaacaatatttgaagaggacagcctcatagtaatgctagacaatgttcaatgtaatgattacctaaattcatcacactgttatacaacaacatcttttgtggataagttgataatagatgttaccaaattctctattagctaatcttttttgtctttctaatacaaactatcttaaccttttttttttttttttagcatcaggaactttgagaacaggataaaaactacagttactctttccaggggagaagtatcaaaaagtaccaaattttgcatatactctcgttgattttttggttagtgaatcctttaatttaaaatcaagtctccttgttttggccaatgtaacagctattgttagggtaaaattgttcctcaataaacaaacaacaagcaaacataataccacattagccaagaaagcctaggttcgagtttgaggaaagttgtctttaaaaatctcaaacatattttgtcaatcttatcaatatttcaccatttcttcatatatctaagactgtgtttcaatagttattgccagctgcagagatggtggaactgaatggataactttgaactttccatgcaatgacactcataactgctgcttcccctggcagcttcttaatctggggaagctccagctgtggctctccagggttctctgcttaagctctctgcagctgctcctctcagtattgaatggctccagtcagcagttgagctcagcaattatagcctcctacaactgctccccagagtcctccattttccccattgcttctacatgctcaaaccacctccaagccatctccagctccgaggagctgtacatttgagtatctctttgtcagtactacttctaaaggccatcttatggtaatgctctgattgagctattcctctcatcttgtcctgttcctactccttccccacagttcttattccattttatggaacaagacaatgcgagtttatacatctaattgcttattcagcacttgctgagacttgaagtagctcctcattgagctctgaatgacttactatataccctaagagtaactttcaagcagtatactatggctatcacttcatgccttgtaattaaacctcaagcctatccactacttcaccccaaaagctgggtatgatcctacagaaaaagaagacctgccttatgtgccctatatatacatctgtcctagcccctacctaactttagtgcactcatttgcccccaagtcagtatcccccagctgataggtaatttccttgaaaagaaggactaatttttatttgcagatctttcttttccaacacttacaacaatgcttagcacgaagcaaatgctcaaaggatgtggctaagttgctttagagttagtgtccaaaatcagttaactggtttactgaagaggcacaaattgctcttcactagtttctccacccggcacaggtgcaggtgtaaaaatcaaagctcagaatacttctagacagctcacagctcccagggtaaatatataatcacagctctacagcctctctgtaagttatttttcttaaagtttcagtctgtgtggtaatgaaagactcctattttcactcatgccattgtgtatttgtagctctaatattcattaaggatgcaactgaaatgttaatgataatcgcacccaaaagctaataaagagaagcccaaggctcacataaatgccagcatttaataattatgcatacttttagcttttccccaatttatcttactttctaataattagtttaataaatctgagatcccaatatatgtgtaattaattttaaattttgtttttaaatttgcttttgatattcaggaatgagacatatttttcctagaatgtaaggcagtaattatcattatataaaatggttaactatataaaggatagagcttaaacacttgccttttgcgaatatttacaactcaaaaccactggaaattttaagaaaaaatctttaccagttgggatacagccaggaaagtagaaaccaatctaagtacatttgacctttgaacaatgcaggtttaaacttcaagagtccatgtacacttggattttctttcacctctgccaccagacacagcaggaccaacccctcttctttctcctctgctttagcctattcaatgtgaagatgagcataaagaactttatgatgttccacttttatttaatgaatactaaatatattttctcttttctgtgattttcttaataacattttcttccctttagcttactgtattgtaggaatacagtatagaatacatatatattcttatagatacagtataagaatatatatagaatattatatatatagaatagatacagtacaagaatatatatatatatatatatatatatatatagaataccatcgcatggttcatacatatacatacatattttataacataaaatatgtgttaattgactatgtatgttattggtaaggcttccagttaatagtaggctattagtaaagtttttggggagtcaaaggttatgtgcagatttttgactgtgtaggaggtcagtgtccctaaccctcatgttgttcaagcgtcaactgtatttcaaaaaaaggatggtctaatacagagaagtttttacatacgtgatgaaagtctaagaagccagagcacatgaaggagagaacctcagagatttgtaacaagaagaagccgctaatacttttgtaagcaggtctcactgccagagcccacaggtcaggactgttcaatagcagctaggcccatgacatggggtttcccagtgtgagctgtgccaataggaggatgggctgtccagctgaacctggagccaaggaaataaaaggctttggaggagacaccgcctgtgacaataagagagaggaaaatagcctgatttctctctttctccagtctacaatcactctcttgccagtatctcccattgagtgaaccctgccagaaactaaaaaacatagtaggctgggaatgcaccttctggtgtgggggcaacatagagcatagcaagagaggtgcagagaatagctttgagatcaaataggcaaaaatgagtgcataatatctttccgttaattttaggtagaagttttcaaaaaatatacgattattttcaattatgttcaaaaccttaacattggtataaatttgttatatccttttcacatagaatttctccatgagaagggtaattaattttgttgatattttacagtctaactttgttgtctaaattcttagtaaagatcacttggaatcagtgagagcaatatcaattgcatcctaattcaaaaggagaaagaagaaaggacctatatgtacactattagcactttggaaaaagaaagattataactcagattgaatatctactctgagttggacacttcaagaaatatatatctaattgttttttagatttttatagcaaaccagagagctggggattactttttacttctcagaggatggaggtgagtgttaaatagatgaagacagttgaccaagttcatatgctttataaatattaaaagtgaatgtgacttgaggtcaatctaatacttatgccatgctaaactacttaagaaaaagaatactgatctttactagtgtcaacaggggaaacagaccagagagaaaaaatacagaagaattttctctggtcattggctggtttatactctaagagacttcactccttcactctatcatccattaaatatttatttcagccccttttatatgcagcccctgttctgctcactcaggttaggtcagtaagatagatacgatccatattttcatggagcttttcacaacccgccatgcatttgaaaattaaagcatttgtcttctattccatcagtggttctcaactaggggtgattttcgccccagcagacatttaagtgtcacaagcagggaatgctgctagtgtccatatgttgaggccagggcaccttacacttggacagcgatacacacacacacacactctctctctctctctcacacacacacacacactcacatggccaaaatgtcaatagtactgaggttaagaaacttattctagatggatataaaggtgcctttattttagagtgtgtatatgtgtgaatgtgcacggggagtgtattagttttcctattggctgccataacaaattattacaaatttagtggcttaaaacaacacaagtgtatcttacatgtctgttagggtagacatgtctcactcagctatactcgaggtgttggcagggctgaagtcccttctggagtttctagaggagatttcatttccttgactttcctggcttctaaagtctatccatattccttggctcagggtccccttcctctatcattaaatccagccattgtaggttgagtccttcttcagcacatcaatctggcctacatcagcagtcagctccctctgaccattcttttgccttcctcttccacttttaaggtcccatgtgatttcactgggcctgactggataagcaaagttaataggcactttctttttttttttctttttttgtggcagggtctcgttctgtcacccaggctggagtgcagtggcacgatcaccactcactgtagcctccaccttttgtgcccaagcaatcctctcacctcagcctccaaagtagctgggaccacagcagctatttaaaaaaaaattgtagaaatagggtctccccgtgttgtccaggatggtctcaagtgatcctcctgcttcgttcttccaaagtgctgggattataggctagccctgtcttaaaatcagattacatttttccttgccacttaacctaacaaattcattggttctggagatgaggatgtagtcacattgggagactgtatcattcggtctaccacaaggggtaatgaatgaatgtaggtgcaacatttagcaaagttatttgcacatagttggtattgaattaaagtgagacttcataagtctttattgacataaactgaagtcatcctgcctgctcttttaaaatgggctcacttaaaatgaacaactcctaagcagagtgaataacaacacatctcactttattctgcactaataaatagctgcaaaatctgtccttcctcaagtcttcaatatttcatttaaaaaagggtccatccacccatttgttcaagtcaaaacctaaaagaatgagcaaaatcctcagataaaattttaattgtgtaactgttggctctttttaaatgttaaactcttgtttgggtttggcattagaaacgattggctacagtctttgtagctaactctgtcccatgtaaagtatatttttcctcaaaataacattgctagggtagaatatattttgtagaatgctggtgtcttatttgttactttttactacaacacgcattcactattctacacttgtgaaaatatggaaattatagagaataagaaggttttggcctcaaataaaaataagcaatctaagtcatgaatgtctaactaatcctttttttttttcttattatgtcagcattcacggtcttatgtgtcctaaagatagcatcaacatactaagtcacagcttaagcaaaacgattggcatgaagctaggcagaaagaaatacgtgcatttataaaaacaataaaactctactgagtttctaacatttgtcagacaccatcctggttgagagtcaaaaaataaaataaaataaaataagacctagtcatcacgctcaagaagttgacttgagatctttcttggagtccacaaatagatttacggtgttcataagcctgtgctcatgtaaagaagtatgctaaaggtatgtgtatttttccagagaaggggtctacaaatttcatcagattttcaaatgggttcatgaccacaaactgtttaagggccacttgtccaaatgcaaacctgcaaatgcgggctagaaaactgacaacttagtgcaggtgcatggtccctttttccccgaatctttccacttctaacctcttgctagattactaaccagaagatgctgaagggatgggtggcgaagtatgggaagagagatattggaacatagcctcactctaattctgcaaactaagctttgccaccagttttaattgtgtccattttcttgttggtgctacatatgattaatccttatttttctactacagatcatagagtaaacaatattagcagattccaattttctcctgcaaaatgttatctttgctttacataatggttacaaggagtattgtcagttggcatttaactaatgaaaacagtaaattcctaattgcctttatagtgatatcttaattatatacatgatttgggaaaaaaaaaaagaaaaattatttcatagatcaaatcccattaaaacgactccaagaagaaaagttatttcaccagacataggttttatttgcagtgtttcttaaaataaatgtgccagctagaggttagtaatcttttatttatagagagattttcatagtgatagtgtacattgcactgggatttgacatgtattacttacacagttattttctttgttttttttaagagaaaatgaatatactccaagataggcaacaaatataaccactttccaatacagatttcacatgcaaaactaagaattactaccaagaacatgaaaatgtgatcagtctgctgagctctgacatacttatcaaactctgtgcttcaggaattgtaagaaacatccattaatcattaaagggacttttaaaagcagcaaatcttgctgaaagggataattactttaaattattttcaaattgtaattttggactgtgtgttatcaaaaacagaaatactgccttagtctccaaatgaataatatataatattcttcttctttcttatatatcctattcccagatatgtttttatggaatacttgccactctaattcaagctgaaaacttgaaaaaaaaaaggataaagtagggcaacatttctcctcatcaacactgaccacaagctgtataattatttgatttttggccctcttctaccaccctctcaacatattattcatctcatgagtagatccaagacactgaattagaatcttccttgctggtataatttcctagttagcaaagatgcttatttaaattccaatagtgctcctcctttctgctatgaactcacaaagttccttctataggaaaaaaaaaaagagatgactcagatggaagccgacaatgtgtggtggctatcaatatgatttttttttttggctcttccctacttgtctttcattggcaagtaacaacaaattgaaaatgtaaaagaaaatattatcaacttagtaattccctttgtgtagagtaagaagtgcattatggattttggcacagttttgatctaaagtattgttctaatatcagaccttacattaggcaatacataaaacttcatgtgataattttgcttaggaatatatgatctatatatttacatagaaaatcttttggaagtaaaatactatttactgaaatctactttctctttctgctacttctttattcccaactgtagaaaagtaatgttcaataattctgaatattagaatatttagaacaaaaaaatgtgtattctggaagacaagctggtattcaaacaagaattttactaaaagtagctcaattcaccttatatcttataaatcatagtagctaaacccataacctaatgaatgtcaatatattcacagaaaagtgagataatgaattcctagaatctggtctgatatatcctgccatgtaaccatagcaattctagccagaagggattgtgtgaaaagaaagctgaaaatgtccacctgaaaaatgcattaattttttaattgttatgcaagatttccttgcctaaaaaagcttaccccacataagcacagatggtgaacctgagtttttctgtcaaggtatatttggggaaataatcttggatctaaatttgtctgtgaaggtatatttgggaaaataatcttagatctgaatttgtctgtgaaggtacatttgggaaaacaaccttgattctgaatttgtctgtgaaggtatatttgtggaaataatcttgctaaagtctaagatcacgaatgacacctgaaaaacttacttttcccaagtttcccaaattaggcataactattctaaattgtttagatatcagaccattgtctctctagacctcaataatactgcttcatatagttcaacagattaaatatttcctactggataaagtacctggggaatataatggtagtcctggccaggcgtaggggctcatgtcagtaatcccagcactttgggaggctggccgaggtgggtagatcgcctgagcccaggcgtttgagaccagcatgggcaacatggcaagacccaatctctaaaaaaaaaaaaaaaaaaaaaaaaaaaaaaaaagccaggcagagtggtgtgcacctgtagtcccagttacatgagaggctgaggtgggaggatcacctgaggccagggaggttgaggctgcagtaggccaagactgagccactacacttcagcctggacacagagtgagatgctgtctcaggaaaaaataaataaataaataaataaatacacacacacacacacacacacgtatatatatacacacacacatatgtacatatatgtatatatacacacatatgtatatatacacatatgtatatatacacacatatgtatatatacacacatatgtatatacgtatatatgtatatatacacacatatgtatatacgtatatatgtatatatacacacatatgtatatacgtatatatgtatatatacacacatatgtatatacgtatatatgtatatatacacacatatgtatatatgtatatatacacacatatgtatatacgtatatatgtatatatacacacatgtgtatatatatatacacatatgtatatatgtatatatacacacatatgtatatatgtgtatgtatatatacacacatatgtatatatacacatatatatgtatatatacacacatacttatatatacacatatatatgtatatatacacatatgtatacatgtgtatatatatacacacatctatacacatatatatacacatatgtgtatatatatacctatatatattttttttcctgagacagcatctcactgttttatatatatataaaatgatcgtcctgttaactaatgaggcatatcttccaaaatgctaataagatcctgtcttcataaattgcaaaactggacatttcagatcaatagaaatagaaaaatgcaatgcaatgttcttaggcctagttccattgttactacttcattgtggggaaaatttgtagggactaatacagtcttattgttatcggtaattgaacttacttggtctttcaccctgtgatcagtagtcaggtattgattagtctgcctgagctcagtataatttgtcttccattggacctgcactataatgtaaatggggtaagtaaataatgatttatggtagaacaggtcgaaatcccctgcaaagggaataagaatgagtatgtatacccctatccatgtaacatttatcttaaatatttgagatcacttttagccaaattatagagagcaaataataagcattttcttacaagcagataacaggtatttatcatatatgttcttagaaatgtagctttgttatctagttattgatataaagaagctatagatcatgtacaaaaaaacatggacaattttgggacacctactcctagtttttactggtagtagctccactaacaagttatcttttttcatttatctaagattatgttttgtaagtatgaaggtgcattccttaaagataaagatattttgggtagggtaacgacacataacgggttattaagccatttttatttcatatggtttattattgtttccatgctaaaaatattaacagcatgaggtttgaatctttgtccatttctttgtgttttagagcatgtccaagattgggttcccatgtataatcttgatctcctccacaggtaaaaatagatcctgaataaaacagactaggatccaatatgagagtcttgtcatgagccattattgcatccagacaatgactgtttcaacatctgtagctctgtaaaatttttgttagtggcgataatttttctttggtttcattttttgacttgttgaaaattttgaaattttcactgttgcagcacaatggcttgaattgtccaatgtatgtagtattttttcatgcttttttcaccattactgtttttttttttttcttcttttggtcttttgggaaaagcaggcccatgtcctgtgatgctgtttattcccatcagctcaaactggaacagagtgtggtgtccttctctttcagtgtgcaccttgtcaaggccttagtattcattgaaaggatgttaacattaggcaaagatgtgctaatctttggagaatatggctttatacttgtggccacatagagtaattgctctccagataatcattggtaagtataactttgaagtatctgcacttgaattcctattcaacgactaattgggagaaataatatttgtggagttttgcctaagaaggataggttctaaaatttattcatagattaaggtggtaatcaaaaagctatctccctgttattggaatggcatcttattgaatttatttttaaattttttttttacttccctgctcttcaggttatattgaaagctgttataagtaaaagccttatgaatgaatgctatgtgtaccaaagagatgttccttatacctcaccgtgatgctctgagatagctcatggcagaaatgctactttattctgaataacaggatcagagtactgagaaaagtaagttttaacctatgaactatgaaatgaataactgattctgtttctctagatatattggctttcagaaatcttagaaataaatttttgacatgctctgaaagtatatgaaaatcatattacaaattttatgatctaacctcacctctgactgcatcctactcttctcttgtttattttgttcttcctatctatcttggtgttctgaatactcctccataagccacttcaaatccgttttaacataaaatagaatattaataataaatgatgtttgaatgccttttcactttataaaggctttctcaaaacaatgactaagcaagagatatggatctgatgttgtcatactttaggatctttgtgaaacgaattcaaacaagacagagtttagagtgcaagatgtttattaggaaatatccttgtgatcagccgctggggacggaagaagaaggagatgggtttgaatatagtaagaagtagagctgcaatggagtctggacaatagcctcagctgcccatgaggagctctgaacctaaaatggcccatcaaagctgtcctacattgggctaaaaggaaaaggtctttatactccttgcctcaagcagtcattgggtgttggctgctctaggcagggcttgacttcagcaaggaggctctctgcagctgaggctatcctcaaaagggcccggaatgttgtcttctaactacactcccaggttctagagaaataagcccacccttgataagggaagtgtagcaccccacctattacaaatactctaggtgagttatgtaccctaaggaaattacaataccctggagaagttaaatacctttgagaagttattttgattatagagttatgtgctagtcaaatctcctcctactctgaccagagaaaacttagagtgtatttccttgaaagggaatgagttgaacactaaacatttcatatgtttatttaatacacgctatctatgagtgtctaatttgtgctctatacaatctagactttaaacgtcatggagaactaaaagtaggaaccatgtcttagtccattttatgttgttataacagaatttcccagatcgggtaatttataatgaacagaaacttatttggctcatatttttgggggctgagaagtccaacagcatagtaccagcatcttccaagagcgtttgtgctgcatcatcccatgacagaaaacagatggacaagaacaagaaagcaagagggggcctaactcacttttataacaaacccactctcacaacaactaacccaatcccatgacagcaacattagcccattcatgagagctctcatgaatgaataaccagcttttatttgactgcacctcaaacattgttcctttcaagattaattttccaacacatgaactttgggggacacattctaaccatagcacaattcctgacatatattcaaatgggcagtgtctatatttcatgtttctcaacattacagtattgtaataaggagctcttgcttcataacaagtcctccagcctcacacacttttatacttataaacaaagaaattagttcttagtaaatatatcacatagttcaaaacagtgaataataggtcatttgatttatcaaaaccatgttatatataggtaatgaaaaaaattattttattattaagtctattagtcagtttcaacccttttaaagccaggctccaaattatcacattctccaaatttcataaatacataggttgctcagctccattggataaagaaaaaatataaagagaaatgaaatgtacttgtggagtaagtagtaacaggagctatatgtaaacattagtttgcatggtgttcaataaaagttataaaatatttttcttttttaacttaaatatttgttcccattaaatcaaagcaaataattgacgtgggatttttgttatttttttatttgttttgtttttttttgttgttgtcatttgtctttttttgactggtgtggaccttaaagaccttcttgtcttatgtctcttttgaaatgagaaagccagagttcagagagacttaataattgcctagtttatgcaggacaattccagattagaatgcgggttttcctattcctactttagtgttttccctcctccactgctccatttatttatattaatagctctaagaaatcaatagcactaataaatttctcaaacatagtgtctgtgttgataatatatcccctttttatcccttttcaaaatgatttaaaaaaaatagttccctggagtacatgcaacaattgaagatgagctttgtttttaccagccaatgtatgtttgacatcagtgattaatacagtcttccctcagttgctaagcttctttatcttggtgaataaaggattgtcagattgttaggcaaagagcatatgcttcaaaactatgctgatacccctgagcatcagacaatctcacaaatttagggactgaagaggtgtacacatcagtttacttttgttcattgagaagaaatgtagcttaagtggggttgactttttatgacatttatttagtacttgaattgactgacaagcctattaatgtattccctgaactttattaatgtaatttgaaaaccgcctacatgtcaatcaacttctaataagtaattatgttcataaatactgtaaaattattagcttttaattttatccaatcttatactttcaaaacagtaacatggatttttctttttctagaggaataaaatattaaactgaaggaacattcaataagtacattcgtaactgctcaaaagttcaccatcgtctaatgaccagcaaaaaagagtactatagtaagacatgtagcagttttaaaaacgtgaacaatattaaacaacctatgtaatataaagttattttaaaaatcctatgagaattaaacatgtacctaggctggtcttaaataccgatagtctgggtatttaaaatatagacctaatatggaacaagagagaatggaaaaaggaaaatggaatatatttattcttcagaaatatatcatttaaacctacaagtttaaaatgtacaagccaaatgtctgtgtcttaagtaactcgaacatattattgttcaagtatactttcttttttcacataatgaaaatcttttagagtctttgagctagaaactcaagtcaaagggcagagaactgaacaagagaacaagattaagcttgaataacataagaaatgtgttttgtcttacaatctcatgtcggtttctgaaggtggattaactcccaccctctggagtccctgaataatctctgattaaagatgaacttttgtgaaaatgttattatattctgatataccacttttaaataatgaacatcatcacagcctacaataatctgtaaaaaaaagaaaaatcactgaggaaattcattgacttatttttcaatttatactttcctccttaaagttaattgtttaagaagtttaacctcatcacaaagttaaaatatttactgtactaacaattgaaggtgtgtttgaattcaagtttacctttacataaggaaataaagctcagttaataagtctatagattaacaatctttttcagacttaagctatgcacctaagttaattttaagccttgacttattgaagggtaaactcaaagagagtacagctgactttctcactcaactttcctattaggaataaaacatgcatgctctggcaccacattatcacataatttgttattaattttacttagaaataaggcaacttcagttttagttccacagagcataatatttctaaacaaccaacacacgattaatttataaagcagaaagaaataatgtaaaaggtaaaaaataaacgttttccattctcctagcataataattaaatttttcttgaaaaccatttgtattttaggggacttatgctcttacattttaatatggaagagaaataaaataatttgatgattctgtttgtatctggagattgaaagttagctagcataattcatgatctactgaaagtaaatcaaatataaaccattgtgtacatattttctcaattactctatatttaaataaagaaatcctagaaggctgctacttttcattgtgacttgaatcaaagtaaacagaggttggattgagacagagtatttgaatgcttggaggattgcatttaaagagttactgtgcatatttcaaaaagttctaatattttcatgtatctattgtaggtttcaaacatttaatgtgtcaatcatgggctcccaaagatttattgaagggatgaatcaaaggaagatatgaggtgaatcagttacaaatgtcataatatggtgttaatggatatttctttatctttgtaagtagggatttgtatgcctgtaatagtcattacacttcttaatgactacaatacttgcatacctttttttaaatgtgtgtatgtgtgtgcgcgtgtgtgtttcaactgaaagccagtcaaaagactttttcattctgtctgtatgactcttaatgactttctgatgtctaggaatgtaaattcctgaaaactatgacaatataattcaacaaatatttcaatgacaacaaatatttcaacattgttaactgcttcctagtcattttgatacctaaatattaaatatttctaagcacagtctttcacaatatagcagttctgaaaatacataccttgcacagttagatgcacctgcattgttctgggtgtatgttgagtctgaacagaacacgtgtatgggccatcatctgtcacatctacattctgtatctggaggctgtagtcccttttattcaatgttgaaattgaaactcgaggatccactgaccacttatcacctcccgcaaaaataatacttgaccggttcagccaggcaccctttgaagctccatcttccaaataacacctacaaattacaagagatacaacactattaatcaaaataaaaatgagagacaacattattttgttctgagtgtttttttcttttgctgaataatagcacagcatcaaatgcaaacatcagacattaactcaggaaacatgaacatactgatgcatcttccattcccaatgcaaatgtgaaacaatacttgtgtacagtttttttaagtgtgtagtgtgtgtgtgtgtgtgtgtgtgcatgttcgtgtgtgtgtgtttcaactgaaagttagtcaaaagcctttttcattctgtctggatgacacatctaaataaagctaaattagtttacacaattttctgcattaaagcctatttcattgtttgaaattatgagaagcagtaaaggtcatgatttagactgacctgacccaatctgatactgaatataatgtaccagatgcagaaatcatagactcatataagggtgggtttatttatttatttatttgtttctttctttatttgaggcagggtcttactctgtcgcccaggctggaatgcggtggaaaaatcttggctcactgcaacttccacctgttgggttcaagcaattctcctgtctcagcctccctagtagctgggattacaagcgcctgccactgtgcccagctaatttttgtatttatattggagagggggtttcactgtgttggccagactggtcttgaactcctgacctcaggcgatcctcctgccttcacctcccaaagtgctgggattacaggcttgagccaccatgcccggcctataagggtttacttttaaaatagcttgcatttgcacagtggtaagcttgtacactgaaactgtaaactatgtttcactgataaaactataaactatgtttactgattgctgtagtcattagatataaaaaagctagtataacacttttattaataatgttgcttgtttttgcaatttattgatcaatacttttttataaagcattcatttagctagcaaacatttataagatatctatggatttaaacaggtattgtctgttgctgtctacaagttttagtctagcgaggaagacacaagagcaaaccaattattaccatacagaaaggagaatatttttatgaaatcacacacaggatgcatgagagatcaaagagagttacttgactcagggcgttgaaggcataaaggccttctgaaataggcaatgtctgagataaagagataagtattgtaagatatggcattctagacagagatgctatatgtgggcaacaccaggtaaacatgagagaaataggaatttcagggaactacaaataaccatgagatatatggtaaaaggcatgagagatggaattggagaaataaaactggatccacatgatgatgacaagcgtaatgacaattactggattttaaggtcaaatttgcagccatttatttagtcatattctgtaacaggtttcaaaaatacagcattgtgtttaatagtagtcaggcacatcaagctttagaacagaagaaggctgtggtcatataccagtgattttgctgaggcctggaattctgtttcatcttgaaaatgttctgttacaaattaaagactggttttcttaaatgagtacaaagcacagctacagaacgaaaacacacatacataaaaatagtttgacagcatttccacagaacaccttgggggattgaacacagtgtttgagattgctacaaaattgtaagctgaaagcaacagggtgggctgctgtcaactgtatgaaactaatcagtgggtgaaaaagtaaggaacaaggtacattgcagaatctaatttgcagtcagctttgccatctacagaaaccaaaacggaagtcataaaggtcactgttaattgaaaagcttgtccttatgtatttaataaagaaaataaaacccctttaatgatgtaattaaataattccagcatattgtcattcttaacaatatgcagaaagaagatagagggtacatatttcccatttcacagatcacatttgtgctggtacaggacagaactctgaaatatcaactgctaggactgtgataattctagtgtgtcatttagtatctgcattcatcaagtgtttctgtgtgaccactgcatctatggccttcgtatgtttttctattgcgtgttcataacaactctttcagggtatagattgcaaagctcttgatcactagaaaataaatggagatgtttaggttaaatgactggcctaagccacgatattagtgggtgccaatgttgaattcataatcaagtcttctctttccacattcaacatcctttccactgtaatgcagatcaaagacttttaaaataggtttcagaaatgggaaaatgattagaatgttgcagaaattactgcaagtaatttcttatttactgaatgtgaccaactgcttaacctgtcctagtataaaggaagcagaaaattaattattagtggatgttttaccatgaaagtctgatttagaatgctctattgggcatttccatttccccagaggcagtagcagctttacctttatttggggggtattagggaagactgcagagattaaccagtagtcttagcataagcactgttcctcaattctggcatgacatgggctgccacagaagaatggaattcaatttcttcatgatgaaaaaaatgaaaaaagggatcatttatgtctccttggcttcaataactctattttgtaatagccagtgttcccaactcaaagttttttaagatacacattagtaatactcttgaatgacaatcagaaaaaaaaatattttccttttggaaattttgctgaattttgtagaattattctcaaatgttctacattattatgttagaacataaataacccaaattaccatacatggaattttacaaattttgaatagcaagtctacgtagacttggctatgttatgaaatcatatagagaatacatgtagtttaaaggtctagtatgagatgactacatagactatgtgaataggccaaacatacacacatacacacacacacagctgtatgcatgtgtaggtgttttttttttttttttttttggtcattataaagattccttgagaataagaactatgtcttcttcctctgtacctccttttcattctccatctacattctattttttcctttgcaatacaaagagatattgcttgacatgtgtatgctgtattaagaaattttgtaaggagggaagctatgtagggtacaatggggtggagggtgagagccaagtagaggagcatgatagcaatttatttttgtactctttgggtaccaacatttttttttcttggtttaaaacgtctagtgtctacaaatataaatttgttggaatcctggcccaaacagaatttataatttagcaaggatgataaagcatgcgcatgaacagccatcatgcagaacagggagtgaaaaatgtagtaattaaattgtcattataattggattattgagattctctgagagtctctggcttctgcccttgacccttgtagccaggtccattcttcccacaataagcagaatgaacattttagagttcaaatcagatcatcaacaactccaggccttctatttaattcataagaaaatttataattttgatagtagtcaacacagccttatagagtctggtcccctgatgcttttctgactttacctcccactcctattttccactttactctgctctaggctggggtcctttagctgtgcttccaacaagtcaggcattctcttgcctcagttagtttgtatttgctatttcttccctgcaacttttttcccctaaagttctacataacttgttccctatcttccttaggttttcattaaatgacctaatgtattaaacagcaaaaatagcgcgactgttcccacactccctttatacatgttatctatttacttgattgattattgtctgtctctttccactagaagcaagatccaggaattttgtctatttggttgcttctatatattccaagggcctaaaaataatgaacaataaatgtaagcgtgtgttgagtggataaatgaaggtaaaaattaggaaaattttggagaaaggaataatatgataaagtgtatcaaaattcccaaagtgaggcatagttggaaaagcaaagtcacacccatgtaaactataattacatgtaattaaatgcagatatatgtagtacagacaataactggtgaatgatacagaggatgtgctaagcaatctaaatcagtaagtgaagaactaagctaagaattcagtgatcagaaaaaaaggcaagtcaggggcaggggtgggcagagtgccggtggcagatcaagaaaatcattcatacacatagctacttgaaataagaaagaactacaacatttgactctacacttccgaaacccttttaaaccattagacattctgcttagtatgtgctaggaggtttgctaggcattttacatttattataccatttaagcctcacataaccctatgagccagatactactattatcttaattttttagatgaagaagcaaaggtactggcaggttgtgattgaacaaagccagttggcttgcattcttaaccacagtgacagactatgctagtatttttagagtcaggcagcagcaagtcagggggactacctgtttagaatggaggaattagggtgtaagggggagttcagtgaagtgagggtggtcagatcattaatgggacagcatgaagtaacagttctctggtcacaaattcagatcttttttctttggacttcaaaatggaacattttagcagcaagtgatcttaaggtccctttgaaatatagacaatgaaataatctgaataaaaatgttcaataataaatatatcctttaatcgagtatggcatagctttccttgatagtggtttttatctttcactttaaaaatctgctagactacctattttgcaaggagatgaataaaacagttccaaaaatacactcttcagcatatgctctgttgacactataccaaatatcatgataaatacttaaattttcagtcagtcatctggatattttgtgcacatagttccaaacatctggctattggaaaatacataggaaatagcttgaacatttctttttgcttcatggttttaattatataaacccaggctaacaatatttaattcttttctaataagaatggcactgctgcctaaattctttttaggggcccccttaaaggatgttactacgcattaggcaggtctctgttttgggggtatgaagtcccattgggtgagatgctatttgatcaaactgttaggaaaattctaacagaatatgcctgtgatactaactcctgtggtgattaaattggaaaggtggacatcagagagtgtagcgaaaaatagcatatttagggtatttgttattttttaaagctcagttaagtcaaaaagcctgtggctgctgaggaatgattttgtctacttatatctcaaattctttgttgcacagtccaaaaacataagcattagcaccattaccagtattccacacagcagaatttattcagctgtatggagaaagaacagctttctcaagacattttgattaatgaaagctcctattaaaggcaccaattaataaaaaataaaaagtacatttttctcttggactcaaagctaaactgagtgaaaataatattcctatgaagagacttaccagctacctttactgctgtctcttcattgcatcataaagtcctaaatttgacagaaggagaactttcaaaagcatattaacagagttcagaaccccataaaatctccatgctgattttgcacacaaagagagttttgatatcccaatttcaagaccaaatgaggtaaggcaagtgaagcagagattatatggaagagaacagaaattttaccatctttctcccctacctttgttttttagggcactctcttcttgatatctttcatgagagttgattcctagataatatgtatgtatgtatacataaattgtatggttatataaatatttcctagataataatatcactttatataatcttatgattgacaatatttaaaattctcttttacaactactcagacacagaaatggttcttattatctttctatttttgcaggtgtggcagaggtggaagacagtgaagggtggtgggaaatccatggtaacaatttgtccagtgaacttcaattatttaatgaagtcctcatccttagagatgataagaattgtattttaaaatatgttctggtgatatctaagtgagaactgcacttcagcaggtaacagttcaataccgttcagtatacaatagtaatatgttaacattactatgcaccagatacattttaagcatgttatgtatatttttcattcaatcctcaaaacaagactttgagttaggttatatcaaaaactattattattatcattatacccattttacaatgaagacactgagatgcatctgttagttaagtaactaacagatgacttgcttattaacatttgtattatatgagaaaaactttattatgaaataattacactaaatcttcaggccttagaaccaaagtaatatcaataaaacatgtacatttattttcaaaatgggagttatgccaagttgggtatattttacttcttgtgtaatagcaaaaaagaaaaaaaaaacaagtagcattggtttcttattttgttggaaaaagaattctattttctatgtatttcactctagcaatttgggataatatgcttatttttaaaatattttggatacaagattgaaaactatcagccactattgattataagaccaaatcctcgaacatcttaaaacatttttacattgtaaattagatgggaaaaaaaactgaaaattaagctttgtgaatttttcttacttttttcatgcagaactatacttaacgcctctctgaaatctgtgaagtttaatgtaatcaagtgatggtattaattcatatagtttagttttactttaatgcacaacttaaaattctttaaatctatatatatatatatatatatatatatattttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctaaatctatattttttaagagacaaattcttgctctgtcacccaggcttgagtacagtggaacgatcgtagctcactgcagcctcgaactcctggactcaagcaatcctcctgcctcagcctcccaaatatgagtcaccatgcctggccctaagtttgttttatatatatatataagtatatatgtgtatatatatgtgtgtgtatatatatatgtgtatatatatacacacatacatatatatgtgtatatatatgtgtgtgtatatatatgtgtatatatatacacacatacatatatatgtatatttataaactatacatatgtgtatgtgtgtgtatatatatataaaacaaacttaactatacatatatgtatatttataaacaaactatacatatatgtatagttaagtttgttttatgtatatactcacacatacacacacatacatacacatgtatcatacacatatatacacatgtatcatacacatatttacacatgtgtgtataaaatatgaacttagagccatttatatatatacatatatatgtatatataacattttaaatgcctgggaaatcattcaaatttggttatgattaagtcacattttcaaacattaaaatcactcattttaactcataattaaactgtttttctgcaataccacaaattgctttatcttattctttccattaataagaagcttccaagcaagaatatatgtctgtgttaggaggggccatgccaaacaatttttacatgtaaagggtgcttcaatacattatttgtaaataatttaacatataaattagcatttatgaagtaaaataagcatggatagagtaagagagatcttgtacattatgattaaagaaactaacaaagtctgaatatcaaaatatcttcatttttggtctgttactaattactatcctcttatcccgataataaatttcatttgcagaatgattactatgggttaagaggcatggaaatattttttaaatgtatgatctcatttaacactcacaaaaacattctgagaagtagataggtcttatcatctctgctctaagattactgaatgcatgaatacaaaattgataaatgaagcaaagaatgtaaaagtcctaaaaaagaaaaaaaggtgttacaaatttgagtggtttaaggctagctttgttccaatggctttaaacatgaattaagcagaaaatttctttgtcatctctactttttaatttttgaattcaactaaatcagcttgctttctcccacatggacttgattgaatgtgagatattgggatctggaagggcttcaagatttttgataactggcaggtgctctgaaccgctgtggggaaagttctgtctgcaatactgtctccctggcagctgcttcctggagaagttggactttcacctcaggagatacaaagataatgaaaactacattcaaaatgcatgcaggaggtgtttaaaatagcagtatcaaagacagggaatgcaatcagatccagagaaatgactgagataaagctctaggctccagacaagcctttctattccatcctctttgggatggagccaggtacatacaccttatccctaaattgagggaataaaggacatggacttctctagtaagaacagtatcagcaattgcagctcgtctcccttccatcagccatctttgtgttgaagtcattaaaagtattctatttgcatatattaataaatagagattataaaataagaaacataacacggatggatatacggaaaggttctaaattcatgttttgtaaaaataataaacttatgctactttacagtatcaccaaatacagacatttaaaaagcaaaatgaattctgttccccaccttcccaacccatctgcttatgttgatctttaagcatcctgccaggcactgctggatttttcttattgcaatttttcctaataaaaaatattctgaacacaaattttgttttatgaataaaaaatggttacacagtcaactaattaaagctagccttgcaatcagttactatagtagccattaacccatatttgtctgtcttctcgagaaaatggactaaaccataattcagtatgaactatgccttaaaatataaattaaggagtatacccaagaagaaaaaaattaatgtttttttaaacagcttcctgtaaaaaaattaaactttatatttttgaaagatgttaagttaaaaatagtctcaaatttgagtctttgctagatcttattttttattataacttttccttaacaaactgtgtagtgtaattatagttaatattgagttcaaatgtcatctttcttgtgtactaggcctggaacctgggccaagttaatttaccttagttttctcacctgtaagatggggttagtaaaagtacttacttgacaaaattgttatgaggattaaattaattagtttgtttaacttgtttaggacagaaggaggtgcatgataagtatgcaattcaggttaactattattaccctacatccctgtggttaactttctgtttgaaaacaatactactgccagtaataacaataacaaaaaaccctatgtataaaatataattagaagaaggaaaaaaataaagaattcagagtctggcttgatgtagcaaaactttatttttctatactgtcagagcacagagctggttcacagaactaattttataggtagctaattgtcatatgtaaaagtacttcattcatttactcccctttgaactgccacaaaagtttctttttttatacttccccatcttataagcagaacatgtagaaaaagacagccttggtgttatattttaaaaagttataaaagttgtactgggactgaaaacttacattcagaaaccatattcctagtttactagcaactgttttgggcaagtaattcaacttctataaagaatttaatagttgcaaaattgagataatatcacctgtgttaagtagcttctattttggtataagatcaaagaggctgtgcatgggagataggtttataaagttataaagtgaattataaatgtaaacattttataattattacaatgttttataggttaatgctcttcataactctaggttatgattgtgaatttctatatagagactgcataagcacactgatcttcccaagcccattaatgtaagtaaagggttaccaattctattcgtttctttttttttgtgtgggagtgacagggtctcactctgtcactgaggctggagtgcagtgatgcaatcatagctcaatgcagacttgacctcctgggttcaagcgatccacccgccttagcctctctccacatgtcctacattcccgaatatctggggctacaggtgcatgccaccatgcctggctaaatatttttatttttatattttgtagagacagggtctattatgttgcccagggtggtctcaacctcagttttttttcttcttgcttgtatggttcatataacaattttgtaaattatgtacacctttgaactctcaaaaattgccacctaaaattttcatcataatccaaggtctttgccaacctataatttcttactactatcaatattgctattttaaaataaaaccgtaagttctcaattttaaatatgtccaaagaaatcgaattaagagtgatgtgatgttcattaacagccatttaaaacaagatgaacaaactctactttaaaataaacgctacgttgctttttctccttaaactgatattattctacttatccctcataatttgatcctaatttttctttaaagccttttattgatatcctatcttttctactgtaaaatgctgtatataaattagcattaaaatatgtcttgtgaacatacaaatctaagtgaaaaaatattcaaaaataaaataacttttataattattaatagtatatgattgaacaacttttatatttatatatgtatcccacattttaataaatatttgtccagcactttggaaggctgagcttgagctcaggagttcaagagaagcctgggcaacataacaaaaccccatctctacaacaaaaattacataacttagctagacatggtggtgtgctcctgtagtcctagctacttaggaggttgagatggaaggatggcttgagtcttgagtctgggaggtggaggttgcagtgagctgagatcacaccactggactccagcctgggcaacagagccagatcctgtctcatacacacacacacacacacacacacacacacacacacacacacgtatatgtatatatatatggataactttatatagttaatatatattatatatataaatcatatatataacttaatatagttaataatagaggtgttaatgaattggttttatctagatacatggaaaaactttcttactcaaatggcaaaactttttacttacaggaaataaagtccagaatgaattcttcctagattttgttggaatggattttatggacagaaaccgtgagaaaatctgttttcataaataagtctatgggaatggaaggtgtcctatttaagcaatactactaattcttcaacttgatgagagggatacaacaaacaattacaggaatctcacccaaaatcattcctaatgctttatcagttgatgatgatactatacaccctgtagatgtatagaaagcaagttgtaaaccacctctattgcaaaagaatttagcaacctctagatattgttttaacatcaacattttaaatagcctctttgtttactttctgcaagttttaaactttgggccgtggcccatggtatgattctacatgttcaacaggttttgtgaaaggtgacagtaaaagcaggaagtaggaaccagaaccagtcaaaatacagacattctccagcaggttggtcacttaaaaaaaaaaaaatatggaaattaatgatcaataaatttcttagaactatctgttcctgcacagtccttggaaagtcatcatgtacctaagtgtatttatgtctaagatgctgtatttggtatatttttctaatggtaagctaccaacatatttgagtagtatttctccacttctaatcttccctttctatcttcctagaggttgggaaaggagacaactgaatatatgtgagaattattataatataagtttacacattgaatatagtgccccaaagacaatctttctgaagaacacggacttttaaaatacagttgcttaaaaaatcttttcactttgttctatcttgtgtagatttaaagttgcttaaattctgttaaaacaacaactggaatgtagcacactttattataatttccatggatcagcgaattaaaatatttatgttctctcttgaaaataaaaattgtgccctattctactaaattctatgggcttgaatatcgtttgtatttagtcaatatttatgtactttagaaaaacttaagctgatatccatatattataaatatttatttttaaatatgtgtttgtagtctagggtttcttttcattttgagaaatataaaaatatatctttatgatcaactctttgttattgttaaatatttgcttcttcaagggatatgtgtgcttcaaaaggggcgtgtgtgtgtgtgtgagagagagagagagagagagacaggagatatttggtacgaaaatggacaagacatgaaaatgagtatttattattacatgtatagtaaaaaaagtgacacactttgaatatgaaaccaatatataatttaaattaatttcatctgagctctttcttacagaaagtgccagaatctccccacatatcgatgcctctcttgctagaggatccatccagcagcagcatctagtggacagctggacctgtcatatctcactgccttgctggctcagaaatgcgagtacctctaagggatgtaaaatccactgcgatttaggaaaaccgtaaatttcaaccatgactttctggctggagttgtctttactagattgctgcatatttttcgagccccatgactatcatctctcaaggtcagaattttgtgatattagttattacttccttgagtcactctaaaaagttaacctgaagaggaaaaaaaatacactatcactctaaacacaggtgaactggaatctgggggaaatactgatatggcttcttcaaggatattgtactttgggttcagactaacacaggattgaatcataactcttcctgtgacttctagcctgaggaatttagggactaaatttttctcaaccttcacatttgcttctttaaaatggggatatgaatacgcacttgaaagggctattttgtgagatggactgaaatgtctcatgtgataagatctaagcacctaaccttagatgtcatgtctttggaaagctatccctgacatttccattcaatggcctcagacaggtgtaatggaccctccctaaggtttgcactgccctagcatattaggcatcattctttattgccctgcactgttcagtcactcatttaatcaattattgtcctgctaaactgtacaagactctggcttatttttcattgtgaagtgtagtaagaagttcagtacctgtcacgtagttggtacttaaaaaatagttttttgaatactataagaactccaaataaaatactgtgtgactgctgcataaaagaaaagatgacatattctactggaacaaagaatagggtaagaataggtcagggcaggtttagtaggagaggcagcattaacaccagccttactctattgtactttagaacttttgtttcaaattatcctaaattgaagcacacacagcaatctctggatttcctctatggttcaaaaattgaatatataatttggaacaaatggaactgcccactgtctagagagtctccttttatcttcttgttcattttactttaaaaataacttagtgatactaaattctagccttgacacactgaaaggagaacaaactgctttctgtcttagaaaaacaaatggaagctgctcatatagtttcgttttctttcctatgtttctggaacatgtaagaaaaactcaagaggccaggtaaaatagataaagaatgggtaaagaggccgtataaagaaaatctacataagttaacaaatattttattaaactgaggaaaccttactcatttggttttaatttgactcaaacaacataatattgtaattattattcttatgaattcaaagatgggttttttacatttttatttcatgatccaaacatggtcttggtgaaatatcattcctgtttatgtagttcagagttcctactgtgtggcagtaactccttcatttcttagcaagatacatatttgtcattcattgttcttacatttacctgcattttgtggataaacacactggtaatcacttttagtataatttgtagcaagcataacacataagtaacattattaaatataataaatgcatgggaattataaattagagaagaaggaaagaaaaaagaatgcaaattgagtgctttttgaaattaaaagtctaaagtgtactgctccctaaaattctattttacttgaaatattttcatcctcaaatactgtttcattcttgaaccgatttcctatgtaaagaactccttactgctttctctatagttctctaccttagccattaatctctcacgtgaagctgtcaaaatcttttatgaaaatcaaaacctactatatccacttttcttatctttcacagtgcattattttcaagcagccaagcaagttagttaagcacaaactgccttgtaaaagccatgttaggaatacagccacactttccttagcttttattctgttaccaatatttcacaattgtctttgtagtcaatactaaacacagaggtctattgtttctggctgtgcttgtctccttaggtccttaattcctgactcgcttctgatgcaaaaggactacatggataccatacgatatatacacttgcatcttttctgtctctctacttggactctctaattatgaacctttgaaagaaactatcacatttttctttttgttttctctaaatcattaatttatcatatgtgtgtcttcaggatttcaagtcaacagtgtacaattatttaatggcctcctttatttttcatggacttagtacaaaaaataggctataaaataaatataagattttaaggacagctaatagattttaaactggcatttaggaaaatgaatggattaattttttttgaaatgcacactgctccaataattagaggaaaccatttttggcaaagtatacttttgatttagccaaacaccaaattctcttacatataatgagaaacagttgcctttcatctttaccaatggctgaaagtcatcattatctaacagatgctcggtggcccttgtgaaatgaattggtcatcccaatcaactattaatgggcaggcaactgtaacaggcaaatcataactattacaactaattaaactcgagttttgtatttacacagacagaacaaagtgaaactgagatatagctatcaattttgtgaggaaataacaatacttcaaaatgaattaaaggttgttattctgagatagcgtctgagtcaactcccctttcaattcctccaacaatttctttttgagttctggccatgcaagtagactagaaaatttaaaaatataaaaaatagcttcttttaataaacttacaatctagaagacagaataagcaaaatatttacacaataattaccatgatagacatgatagaagtacaggcatacctcattttattgcacttcatagatattctgctttttacaaggttaagctttgtgccaatcctgtgtcaagcaagtctgttggtgtcatttttccaacagcatgtgctcacttcatgtctctgtgccatattttggtaaatcttgcaatatttcaaatttttcattattattatatgttttatggtggtccataatcagttatctttgatgttaccattataatttttagggaggcattacaaactatgcccatacaagacggctaagttaataaatgttgtctgtgctctgacttccccaactaccagtcattccccatctctttctctctccttgggcctttctattccccaagatacaacaattttgcaatcagaccaattaaaaaccctacagcgatctctaaatgttcaagtgaaaggaagagcatcacatctctcaatttaaatcagaagctagaaatgattaaggttagtgaggaaggcgtgtcaaaagacaagacaggttaaaagttaggtttcttgtcccaaacagttagccaaatggtgaatgtaaagctaaagtttttaaaggaaattaaaattgctaatccagtgaacatatgaatgataagaaagttaaacagcctttttgctgatatgaggaaaattttagtggtctggatagaagaccaaaccagccacaacaggctattaaaccaaagcttaatccagagtatggctctaactatcttcagttctatgaaggctgagaaaggtgaggaagctacagaagaaaagtttgaagctggaacagcttggttcattaggtttaagaaaagaagctgtctctataacataaaagtgcaagatgaggcagcaaatgctgatatagaagctgcagcaagttatccagaagatttagctaaaataattgatgaagatgtctacattaacatcagattttcagtgcagataaaactgccttttattggaagaaggtgccacctaggactttcacggctagagaagagaagtcaatacctggtttcaaagactcaaaggacaggctgactctcttgttggggactagtgtaactgatgactttaagttgaagccaatgctcatttaccatacccaaaatgctagggaccttaagaattatgctaaatctactctgccagtgatttataaattggacaacaaatcctggatggcagcacattttttacagcttgatgcacagaatattttaagtcatagttaagacctactgctcaggaaaaaaaaaaaaaaaaggttcttttcaaaatactactgcttactaacagaaaatgcacctagttgctcaagagctcttatggagaatgtacaagaagattaatgttgctttgatgcctagtaacacaacacccataacatccattctgcagctcatgatcaaggagtaatttcaactttcaagccttattacttaagaaatacattttataaagctattgtttccacagatagtgatttctctgacggatatgggcaaactaagttaaaccgcctggaaaggattctccattccagatatcattgagaatattcgtaattcatgagaagaggtcaaaatatcaagtgactggagatgcggtggaaatagtaagacaactataactagaagtggagcctgaagatgtgcctgaattgatgcaatctcgtgataaagcttgaaaaatgaggagctgctctttacagatgagcaaagaaagtcgtttcttgagatggtatctacccctggggtaactgctgtgaatattgttgaaatgacaacagaggatttagactattacaaaaacttatttgataaaacaacaacaggatttgagagggctgactccaattttgaaagttctattgtgggtatgacgctatcaaaaagtattggatggaataaggaaatctttcatgtcagaaagagtcaatcaatgtagccaacttcattgttgtcatattttaataaattgtccaagccaccctatccttctgcaaccaccactctgaccagtcagtaagcccttcacaaacagaacaaaggacttgttgaaggctcaaatgataattagcatttttaataagaaagtgttttataataagtgatatacttttttttagacataatgctattgcatacttaatagatgacaacataatgtaaacacaacttttgtttattggtaaattaaaaaaaataatgtgacttaattgagatatccactttatcgcagtggtctggaaactgatccacaatacctcccaggtaagcctataccataagagacataatggtttataggacttcaagaaagaagagatcatatttcactgcattagaatttgtaaaattagctggggaaataggaatgtgaaatggttctttatagacaggaatcatttagcgttagaaaagaggatgaataagagctgtcgacataacagttctcagcaggggacaccaagagaaacacagataaagagacacaaaataaggagtgaggttgtggactagcataaaatctcatttgattcaatagagtgtatgaaagaagtggggatgaaaagttccataattcgcttggaggtaaatgatagatgattttagatgtcaacctgtgaatttcagaataatttcagtaggcaaaaagatgtttcagagtacataaggtatattattaaaaaaaagtttaggagaaaggcttttttgatcatatcctaagaactggatagtaagctatgattctatatatactatggaatttaaattatcatagtaaccctctgaagtatatattattatcccattcatatacctgaaaaaaaggaggctgcagagttatcaatatatttcccaagataggagaatcagaaaaaaagagttcaggataattcaaatatgttataaactcagataatgaactttaacttgaagatgaggaaagtgttggaataattatcattatttctaatgatcaatgcttttctgacttccaaaaaggaaattggagaaatcaagaaattaaaaacacaaatccatataagcacattgccaaaaatacaagtacaatcatacaaccaatcctaataaaaagtactgcagtcttgtggctgtcagccacacacagctatgatcaaataacaattaccatcatcattgccatcatttattttatgaaaatgtatatggtgataacctagatattaataaaatatgcaaaagtaatttatagagttaatgttgataaattttacatgaggaataaattttacacacatctctagaaaattaatagtttaaagcaacaaattacatacaggtagatttcggatttaacctcaattccaactgaatccaaattcttggccctttgtaccatgctttacagattactacaaagtacaattctaagatatccttcaaattatccatatgccactgggaaatatttttgtgctagtatgttacacggagttgtctaaatgagtccaggaaataaataatatattttggtaggccatagattctgtgtgagcctacaatctaatgtggcctaccaaaaaatattaatggcacagtcctgaatagaacaggaagtcaaataatttaatgcagagaggaattctattaagtggtagtggatcaattcttgaattttaatattgtccctttcctactttacacatataaatggcaatgaactcagggttctggatcctctgatatgacagactgcaaactccccgaaggcaacctcgaccaccaaaagtgaagcagggctccctgaagaacaaagaaatagtgcagtgcatcttttctcttatacactcatttcttatataaccttcaaattcttgtttgcatcagccatttgtgatttaccatatagatcagtttctgtctcagcattaaagcagcaaattttactagttttatactttgtatttttgcatttccttttcccaaaagagtttaacattgggaattattaaagtggtatctttaaaaatatccaaacctcagttataattcagcagtgacactgaccaggagacacatctttgttgtcagttcctcttgtgcttttctggccgatagcacgaaattaagttttcacggaccattctgtttcagttaactgtactgttgtagaggaaaaggaagggcttataaacaaaacgtagttctttgtggaggcttatgttcacacattgtctatataaaacatttgctttgttttaaaaatgaagatgttttgaagacatcattaatatggataaattcaatttcttttcatttgtgtttaccggtaaaccaggtatattttaagtacataaataaatatttttaaaaggcaaggctaacattgtttagtttgggcaaccatatgctattccaacaaactgatatattctttctgatttattacagtactaaatatagcttcaatctgtcaacttgattacagacaccttgagtatgaggatttccttgatgccaatatattcacagagcctagcacagtgtctgacatttaccaaatgctcagtgattactggttgaatatattaatagttgaataaattatcttctaccgtgattattaatgacacaaattagaaatatattcaactttattagaggaaattttaaaaaatcatcaaaccaagagaacaataatgaagtagtattcttttacaaaactaaattctaacttttcaatctgctcatttaagtacatttattgcaaaagttgcaggtaattttggggagagagaacactttccatacataataaaaataataagaaataagtaacctgagacattattagtaaaattttgtcatcaaagtcaaggtgagaaacaaaaatcaatgtttttataactgatattttaatagttatttcacatttctgaaattatctgtcaatacatatcagtcatatcagcaggaaatatttctattttaccttctgtgaattttaatggacatgtaagtacacttggtctaaagtctaactacagaacatgtgggatttttggtaacacagccaggataaagagttcaaaaatagaatgtgaagacctgtactctaattgttattctgccaccaactaactgctattccagacatagtgtctgtagacttaagttcccttatctgtaaaacagaatcagcatttcccaaaggggtttccatgaaactacttccctgggatgttaacaagcatctcttcaaattctacttccatgtgcatataaatgaattaaaatgagcacatttcctcatcgcaggaatactcagaccatttagtatgttaatgtccctgaggactctcaaagagacagaaataatacacaagtattcccaaatttatgtgtctctgaatatgatatccaagattaatcttccagaattagtattccatggagcaaaaaagatgccaaagtgaaagtcatgactatatcccagtggaagtcttcagagagtttcactttgtccattctggctcatttagagatttagtctacggagcagaaaactaaatgccagtagctacagcactagaattaaattcaagggtaagcatggtgttatcagatatttgcttctattcaggtaaagtgaaactctaaaatccagttttatgaacactaaaagttattcaagccaatttgaggcagagagctagtcattctatataaaaatgaactgaaccaattgatatatacttggtatttttatggataaataaaaaccaatattagtgacccatgatcagtaaatataaattttttgaaaatgtataggaggaaaatgcctatatttctgcagctgagaggaatatggtatatagcaattaaggcctttgtaaaagattaactttttgtgagcaaaatatttctgaataatcactctttagtaatcacattaaaatgtcaattgggtttggaaccaatttaacatatctactaccattctacccacttttatcagattgtcctgaaattctagtgattacataattttctgctcagtaccatctcacataattcctcatggcccacagaattaagcccaaaggcattatcctagaattaatgacattttataatctgacctatttcggctttccagccatttctcctagaattttccaatatgacctttgcatagtaggtaacttggtctattttctctttcccctcaaatttttattatactgaggccttaatgacagagttgcctgaaatgtcctcattgtattttcatttaaaacctccaccatcctttaatgtccattataaattacctctttgaagttccctttcttatcaccccacatgaatagagtttccactgaagtatgtgcaatttgtgtaggtcataaaggaccttttcaaacattttctattttcccacatccactgagtacagttatagcattttcatgacaaaatgagagatgaaatttaatgccttgtagccttccctttcttctacatttccccccttagggacatttattcccttagtattcacatctttcaatttctaacccctttctccaaagcaggagtgaacagatttcaaaatatatattcatctgcatcagtatgttaacttaaccagacatttgctatttaagcctaatttataactggaaataaaacttttgtctctacataaaggaatccagataaaaactatgaaatataagagaaaaggaaaggacgaagaggagactttctcatactccagggaatcatactactcccaagactgactctgattataatactgatttattatttttaatattttgatgagtaaggtacttactctgcctcaaaaaaattcatggtcaccaactcctggaatatcttcttcctgcagtttttactctacagctgacaagaactaattcttgttttaagaccaaacttttcaggctgggcacggtggctcacacctgtaatcccagcactgggaggcttaggtggatggatgatgaggtcaggagtttgagaccggcctggccaacatagtgaaaccccatctctattaaaaatacaaaaaaaatgagctgggcgtggtggcaggtgcctgtaatcccagctacttgggaggctgaggcaggagaatcgcttgaacctgggagggggaggttgcagtaagccgagattgtgccactgcactccagcctgggcaaggctccatctcatctcaaaaaaaaaaaaaaaaagacaccaaacttctcaatcttaatgttgtcgtctatgtggtatcttccataatctctcccaaacatagtcatcttttgctgatatgatctcacagtattttttgtttacaccattataatctcattaactgcagcaacacaaatgacaaaagacaactgatttttccccttggatgatctaatttactttcactcttccatcatcacttatgacatgatgattctcaaattcatctacctaaaatctatatatataaaaatccctcccttgaattccagatccttggagacaaacacccacatctaaaaccaaatttgtttaacactggaccagtcatcctgtatgactttccattttgtcactgttttgtcagatggtataccaatatccacccagttaaacaatatttccttgttttttctggtacaaacccaaataaattacaaacatcaataaaactaaaattctaaaataactcactttctctatatatctccttgctggaaaaatgggttacgttagttcttttaaaaacatgcatgataaattgtactaaatacaatattcaggtctggacatactaggtataattttctgtgtctctggggtcttacatatttaaggtcaaaataaacttaagtttattaagcttattaatcttcaatttcatcatcctctttaacagttatgttccctggtagtttcattgccaataatttatttgtcaggttgccaggtgcttctaaacttctatgtattttttcatatccaattttactttaaatatttttatgaaaagaagcctgttaaatttcctaattatattattattttttcaatgacgttttgtgacttgaaaacccttaaagatatgaaatcattttttcccaatatgtaccacagacaacgttgttaaataaataagaagacagaaacggcattatcaagagagaaatattcaatatatcttatatttctgtcacacatttttataccaactgtgccaaaagttgtatatcatataaatgataacaaatttacaaaggcattcctttatcccttagctctcaaattaaaaactttcataggtaggaagtagggcaagcatatattccctttgaaaggtgcaagaaaatgtcattggcattcacatatggtactcttttctttaagcttaaaaaaatggactataaaacatttacaaacatagcctacttattgggcatctttatgtttacataaatattgaagatatctcacatacctctttcaatcaaattatctcactgacatttattgaccactttctatggggaaaaaaattgtgtttgccctggaaagcttctttggaactcacttcttgaataaaaatgttctcctaattcctagttttgtgtgccttgttttatattctatggtcaagatataacaaggtatttgataataaagtcaggcctttaaatgaaggtttattgccacacatatttgaatctgataaaagcaactgcatataattttacaaaggttctataatgtctagaaaattatcatagcataaaatgaagatgtaagttttctttattttctattaaagtttaatctttaatggccagagcagagtttcaaattaattattttactgttattaggttttttcatttcttgtatccatccgaaactctgtccagcattcccatgaacattagtggctcattaggaggctcagagttaatccgcagggcaaaacatttgttccgtcattaaggcctgctttcctgggagttagaaataagcagaaatctaattttggttaatttcattgcttaggtcatagtagtaaattcaactcagtcagctcttataaaattatcttttattaaaatgaactgtaagttttgtagaaatgcaaaaatgtctccactgagacaaaattccttagatgacaaaatacaaaataaaattatgcttattttcctcagttatcatttagtataatattaactctatggtttgtataatttgataatttctaacttttctacaaataaattattatagcaactacgtatcagacttttaacaaatacactcacaggaattttaccatattcttttattgcctatctaatttcctgatcatattttaggctcactaagaagcattattcactattaagttgccaacttgaactaaactttggctgtgggtgggctaaaggctaagtaaagtgcccattaataactactttcattcccagagtttgtgtgtgattctaagtaagcaattccttttcctgtctcttgaggtacgatgctggaatcaactctgatacatgttttattgaacattatttatcgctggcttgcaagcagggctgcaaagtaaaattctacatttatagatgacactaattttgttgactgagtaaaatgccaagagggtaaggcttaactaaaaagcagtcaggtgagaagtaattttggagttggtagatgtgagatccagcctctagtgctgccacttaactatttctagtttgtaacctcccaaaacatcaggttttctctactgtaaaatcaagatttaggaagtcattgactgaacaggtggtaatgagaatgggtgtaaaatcattaacacaggtgaagcacaataaaaagagtcatgggaatcaagaggtctgtcttcaaattccagagctatcactttttaattctgtcatcctgggcaactcactttatttctcaatctttcatcttatacctctgtaaaatatcaatattaacaactatcttctggagctattttatttttaaataagatacatcatctcattaagaacacaggttttgggtcaaatggacttagtttgaaattccatttttccacttactagttatatgagttgagaaagccacataacttctctaagctccatttgttttcccttttaaaactaataaatctgacgttagtttttgtaaggcttaatgaaataatcaagtttgggggctacattaagagtggtatttgtattattcttaagaaatccttgtgaatggggaaaatgaccaacaaagttgactgttggcaagtataaagtaatgctttcatgaaaaaaaatccaacacagtcttaaaaagtgatgaatgccaaaatgtcagatgagacagaaggaaaaggatctattattacaccctctttcctgaagacaagagtccaatgtgcacttgtcaacacaaaaggccaaaacaatcgcaggcatcatttaaaaggttattggaaagaaatcaaaaaacatgatttcttttcggttttacacagatatgtcaggggatgatggtaaagggaagtacataattattgtgagaaaaatccacagcatttgcttttgcatattcttcctttaaaaataatttattctcttattaaactaccattttacttgctctcaagtaaaatgagcaggaatgaacatttacaaaagaaattaaactctcttgatctagcatggtcagtggtcagattgtgtaagtggggaattagcctgcaatcattcgtataatgatattacattataatgaaaatctgccctagttggctctattcaatatacttaagaatcctttagaaattaagacacacctatctcttagataataatatgttaaagcatatctcattatagcatttacaaatgctaatttagaagaataaaaaatgtctcacgttaacttctctcaaaaaatacactgttcaaaaatttggacttagactttactctgtctaaattctccaagtttttttttttttctgtaagtatatcttttgttcttcatctcaactgaaaaaaaaagatgagtcacataagagacagttgttctcaaccctgaatggacatcggattcacctttgcagcattttaaacaacaacaacaaaaacaaaaatatcctaccttttgtcttaaaaacaatgtatgcttatgataaaaaaaatacagaaatactcactctttgttctaaatctcccagtgccactcccccaacagaattgttttctatgttttgtatgtcttttcagaaattatgtaagccagagtatttttctgtatcgatatctatttttttttaaaagttgttaacagaaatagggtaatcctatacataatatactaaaaaacagcttgcttgcctttataatacacctggacatttttctgtaatgcctacaggtaggtacttcccctttctttttaagtacctgaagattcattcacaaattatttacaagagaagacctagttgatccattaatcagagccaggttgtactaagaaggaaggagcctactacctctaagtggtcatcagcagttattctatgttatagagataatacagagaactgttactattcacgtcttttaggtggaggttggttggtcttttcccagtatttctcctctaatacaacgctgccatgaatagctgttaaatgtaacaatgtaggcacagctaaagtataaactcatagaggtagaattgctggttcaaaggctatgtgcctctttaattttcccaaattgttttctaaaatgtcatgttaagtaacactctcaccattcctttgctcatgggaatatttttatatattttaatgaatatgtgtgattatttaaatatacagagagagtgtgaaagagatattgtactgcaaacaaactttattaaaatgtctatgattgggtctggaggctcagacatatttttcttaaaatctcccaaagataatcccattgattaagcatatttagtaatcattttctcatttttttgacagtgtagatttgttgtataaacattaattgtggaaacctatcactagaatttgtgatgcaagaaatacgagtccaaatctgtaaaactatacattgtaaatctcgggtgattaacacagctgtactcaggaatcatttttctacattacatcagactctattctacatatagtttcacagaaaatcaaaatgatgaggggtggtgttctttctgtcctcaaaatataccttgaattgaaagttaaagttctacaaaagtgacagctaaaaaatttaaaataacctcaatcatactatcattatcaattctatcccagttctctttgacctcattttactacttgtggcagactgtattttacaaaatgaccacatcgcccatgccacagatgcttctgcgttatggccttgacacccccatcgaaaggcagagtttaaaaacccttctccaatctgggctggccttagtgattatcttgtaaccattagaatgtggttgaaatgacgaggcaggaattcttagggtaggctcaagaaggccctaggaattccactttggtgatgttcactctccccattactcctctcaggatgtttgtttttggaatccagtcagtcgccaaggagaggccatgcgtagatgacctaatccacagtcctagctgaggctttgattcctacctgtagaggtgccacacacatgaatgaagaggcctccaggtaatttcaaccctcagccattcgagtcacatcccttgccctttgattcttctcagcttaggccccagacatttttaagcagacataagccaacctcactgtgttctctgcatgagtttatgacccagagtatccatgaacaaatatgaaatggttgctattttataacactatgtttgcagtattttgttatgcagtaatatcaatgaacacatagctacaccactggaacactattttatactttctaaaatgaagaaagaacatctgctgattgtatttatatataatcacattaaaaaaaaaaatcactccctaaagtgtgtttaagggttatgggtttgggaaagaggatttcatgttcaacttgaggaaacactgggtacaggtggcactgttagttctctacctaagaatttccagatgataatcaataattgttcgagtttagcatggtaatactattccttttttagttgttggtttagtagtaggcttgtatccaagttctggccaataaaagctgacccagacccaatggaagcattctgggaaatattttccttctttgataaaataatcgagggtcacacaaatagttactttgcaatgttctagccatcaccacttttgcgcttttacaatttctcatatgaagacttgatcctggaagcagaagcagctaacttgtgaatataaaggtaggaccaaggcacaaaacacaggcataaaatcagtgaaccagggaataaaacctgaaaacactcatttctcatcataaacaagacactgcatgtctatattactaataactttagcgaagttttctgttacttgcagctgaatgtattataaacactacactatgcttagacaaaattagcatccacatatggccacttaagcatgcttcatagtctatgtcatgaatgatactactggatttgtgtaatgcagtggccctatcaatatgcattctaaatcttcctagacctaggcattttgctttgaatggaagtttggtgaggatcaaactgatgtgctttatttattcatggaaatgggctaaagaaaaactggtttgcacctctaccaattttctcttgtaatttagaatattaaatatcttattgtaggttagaatgtaattgttcacttgtgattatgaaaatataaactttcctaacagaatccaatataataaattaacatttagaaagttacaattaggaaatgaatatgaactcagatctaaatcacctgaaaaatattttaagagattaatcattatgtcctccttagataacagctttatttgatcctcataataaagtagaaaaagaaaaaaatcatttagtaagtttagacagtaaaagattataactgcatcaatattttcccaaacttgtggagtgtgccatgtgataaaagtggcctaaataggaaaaattatattattgcatctgttgattcattcactaattcaataaccatgtgctaaacattgatgtagaatgttaataactatgttatcctaagttcaataattcaccacattcattcaaataatatttgttactagtagattctaggcataatgttacaagtccaaaatttttagtaaaacctctgggttttttagtttaaaaataactgcagctcagattcataacacttcattaaatgtagatacctcttgtttaattacagcacagctacttcttcaaatgacaactagttaatctgacaaacttattcaagttacagctttaaatattaacttaacacacgtgctctgtccaaagcatcaattttattttaatatgtgcatggatcgaaaagtattttaagtgttagaaatttcagatacatgccaaaacagtagaataggcctcaatgctccttcaaccacaccggatagagttactctcagcttggacatatttgagttacacgctgttttttctatacctactgatggttgccctctgcaaagctcctcaaaagcaggtttcaaaatgtgagtcttatgcttggttttctaagtgttttttgcaagtgataaatttctaattgtttctaacttatatgaaagaatcaaatggtattttaaagagtgaagtgcatagaagatctcaaactgaattttcagtgaaacaaaggcatcttttgcagcatgctgaaaatcaacatgcctcaatcacatcagcaggcaagtcaaaattcctgcaggtgatgacagccaatgcagatggtaacttctcccctctgattttctgctctgtggcaaacagaaaataaaggagttaaaagtaacatacggtttgagactctagaaaagtggctgatcatgcccaaaggacaagaaaataagcagcttttacaatttttcatattatttaacatgctcacaacttagaagaagggtgcaagtcaattttactataattttatattcagtaggctaaatctaggcacaaccagctgggttgttaatacaggtcaaggaataattagctacatttgtttccattttagaaaacctaaatgagctctgagtgggtttgaggctaagaaagaaacaaagatttcttcactgatgtaatagattctgacaaaaacatgagagcagagaacaggggattattatactaagatgcacttatgaaaaaataatgaatgaagaactgatattatacttgcaaaattcaaataaatgccacaactctgtaataaatggattatgacggtgggaaaagtccatgctgggtgttcttcctcatagtaagcagtcagggaaagaaaatagagcaattcagcccaaccgtcatccaaaggcaccaatcatttttcttccatggcacactcaggcaacagtggatataaattttatatcaccagaggcttttgtggggaaagacaaattataagcttgaattttaaagaatatgatcatatgatttttggaatctatttaaaatatgaacacattgagtaactagagacatacatgattataatttttatagagttttatctcaaagcaaattaaccttataattatacatataacaaataaaaaatatctccacataatcaacaactgtggcttggtgaattcccaagaaacacgtacacacaaataaaaataagtgaatgcatccaggggataatactgccaattatttatctttcatttacatgttttatttcaaatgtaaataatccggaagcactacctttcttcatagagtaaatatagcaaatgtctgatgctacattatattgttttctgaaagccacatgactggaggggaagtggttgcacagacttatgagcagtgccaatatgcagtattctctatatgacatcaactttctcttttactcaaagattctggtgctgaggtgggaaaacattttatagtaatgtgtgatgattagacacataaagcacttgataaaatatccagaccacatcttgctacaactacggaagaccagcttcaagaagccatatgaatgtctcataatgttgtatctttaaaaatatgctatcaagaatatcactgactgtattatttactctctctaaagtctctgggactttatcaatttttcccttcagaaatgtaaatctgtacgattataaaaaaatgtgcaaattgcactggaaagaggagacactgaaaggatccactcaaccaatgagagacacaaccagcaagacacagtaccctgccaatgtgcataaagatgatttaatagggaaacaaaacattctgaagttgatatgaaaaacaaagtattacaaaacaactttgggatatcagatttgttgcggtcagttagtgagtttaagttacagtacatttcttttctatttgttaattttttcaaaatatttattgaatttctattgcatactggttctagaaactggggatgcatccgtgaacaaaacacataaaaatcctgtgaagctaacattcaattcacaaaatcctagtttactttaaagggggaataatatttactgtgctactgtgcttaacaatgctatgaggaagagagatttaacatattttgtatagaaaaggttttacaaattaaagtgctaaatgataatcaaacattctataggtattattctgaaatgtagtttgctcctctgtaactctgatctattattttctaattggaaacatctaggtttcattatgtgtaaaattgtacactaaatctataggtactctacatgatggcaagtgatttttttagataaattgataagaggccttggttttaggcagtaatgcttttctcatggaaaaccagcttgctgtaagaagacatgatgtttcaaaatgttccactctactataggggaatgtggcttcctggtaaaatcatttgcatgaatttaaataagagctgccatgctgtgagggctgcagctcaacccctacatctcatatgttttttttgtttttgttttttttttgagacagagtttcgctcttgttgcccaggctggagtgcaatggtgcgatcttggcttactgcaacctctacctcccaggttcaagcgattctcctgcctcagcctcccaagcagctgagattacaggcacccgccaccacgcccagctaatttttgtatttttagtagagatggggtttcaccatgttggccaggctggtctcgaacacctgatctcaggtgatctgccagcctcggcctcccaaagtgctgggattacaggcatgagccaccatgcccagcctaacccctacatctaatattgtagttagcgtgcatataccatcatgttctaagaactaagattcttctgttgaaatcctgttatacagtattgccttgcttctgtcatcatgtgagtttagtgagctctagaaaaagcatatgggtaaatttaggttctgtgcaaccccaggatgcatgcagtcaaaggccttgaccaagcaacccagtcaatcacattttctgccatgacagccctaccatgcagatctattacttgcctccatattttctcagtgtgcttccacacttaccattgggggcaggtgtggaaagaaaagtcagtattctgtcttaattattacaacatgattaggaagttctagattcatgaagaaaataacagaagtaagtgaaactatggacatattatttgattcccagctgcttgtgggaagcccaaatgtgtttcctccttgagaagcattgcactgaaaagtcagaataagccttttggaaataagatgatgacatcaagtcatgaattattaggcagttttctgcctttgctttatctcatgcctagagatattctggcttcattttttttctttcaatagatatttgagtgtcagtcactatagtcttgtgtatactgaaatatattgcatagctgtattgaaattgcagctgaaaatttaaagttgtgatgtctgctcccacaaatgactgtaaggttaggtgctacttagattattatgggagcccatagcaggttcaccaaacctattcagggatatcagaagaaacagcctagcagaagtggcaaggtgagaccagaagaacaggcagaagaaatagcctggcagaaagagtgttgtcagcagagggaacaacataggagaaagcttggaggccaggatggtagggaatgtacacctattgggtggggaaagagacgtgagctggagacgcaaggaagggccagatcctggtgggccctaaatgttacttcaaggaatttgggttttattttaaaggtaattataatgcatcaggggaattttaagcaggagaatgcatattttgtgttttagaaaaaagtcactcaattaagggcgggactaggggctcacacctgtaatgccagcactttgagaagttgaggcagacagattactggaggcctggaattcaagaccagattggccaacatggtgaaatcccatctctactaaaaaatagaaaaattagccaggcatggtagtgcgtgcctgtagatccagctcctccttgggaggccgagggagtagaatcacttgaacctggaggtttcagtgagccgagatagtgccactgcaatccaccctgggcaacagagcgagactctgtctcaaagaaaaaaaaaatcacttaacttaaataatactgctctatgtcacatgaccttgggcattcttatatgtaaaaaagagaacatatactcagagggttggaatggttattaaatgaaatatgtaccgatcattgtatctgggacaatcatacacattcaaggggacagactctacagtatgtttgtgtttgaagagagcattcagctccaccattgtactggtaggaaaggtgtttcccaaaatttaatttgactcaaaacctcagaattttaccttattaggaaagagggtctttacagatgtaattagttaaacatcctgacatgaaatcatcctgaactcagagtgcccctaaatttaatgactgatgccattataagaaaaggaaagggcacagagatacacagagaaggacacatgaagacaaaggcagagattcgatgctacaaaccaaagaatgtgtgaagccaccagaacctggaagaaccaagaatggtatttttcccagaggtgtcagtgttagcgtggtgctgtcggtacactgatttctgatttctagtctccagaacttcaagagaacatttaatatttgtttttgttttgctttttctttttttttaagctgccagtttatggtccatgctttgttatgacagcccaaggaaatgaattcattcatgtagtcttggtatgcttctgagtaagctacacaactttctgtgcctcattgcttctttgtaaaattggtgtactaacatttcatgtattgattgggttgtcacgtgaattacatgagattatacacatgaaatatgtagagcagtgctttgctcaccacaaagtaaataatgaatgtcagttcatgtaagtgctgttgtaagttaaagtactaggtagataataaaatgaacatatttcaacaattaaaaatattttggtttttaatgcatcacatccaaattgatcatgactttgtaagttttacaaatatccatgccacattccacaatatttgatgttaaaatatttgcctttatggccaaatgactacacacattattttcagtcgttaatcaaaatatggtcacgtatttttaaagaaaaattcatagtctgctcttaaatttccatatttcacttttatcataatattttcaaatgtatttgctaacgttatctgcttctttctctgaatgcagttttcctctcctgtaggaacagcgttggctctatattcttaatttcaaaaggtactcacatttcaatataattctcttgagactgtttttaggaaaataatagagtaaatgacagaaatgaactatccattgaagtacaatttatcatggagtgttgcataccattatctcagaaacatgcagtgtagtaatcacttggagtagtgataacacataattgtatgctagtcataaattataggtgaatggcagtttcagctaatgagtgccaaatagcagtgcaggcactgtagtgattagggaagatgtggatatgaatgcatttattactggtgtattacaaagcttttcaaattaaaaatggcaggtctataagtagacaccatgctaggacacctatatccaaaagtaaaagacctaaggatatttcactatccccacctcccatatcagtttaatattgtgggatggggggacataggaggcaataaaaattaatgaaaagtagaaactaaaaacaaaaataatataaatctttctacatatatgggtcctttcttcaaaaatacttctgtcaggttaaattcattttatattaccttaggaagaacttagatatacttaacctcagctgtgttttttattcccttttacatcttaaactttatttatgttgcttctctgatgtgtgaaaaaggtcactcttcactgactggtagtatttgtctctctagaggtgacttcaaaatcttaccaaatagctacgattttatttcctgccccacggatactatatattccactagtccctatttatgcttgggatgctatgaaatttctatttattttgatacagctgaactcaaaggtaatttatgaggtagaactgagtatggatgattgcagtaataacatttcttccccagttgattcttcactttaagatatattgtatacgttagttttattgtagccctttggttggaaatctgagatgcaataaacacggttttaaatagtaagacttaaataatgatgtttacccccgaagtcccatcttaagtgttgttacaagattccctcgcagaggtaagtgaacatataaatgcatattgaaaaattcagaaataccgaagttttaaaatataaattagatcattttctctcaaattatagtaaaattcataaggcactcagttaatattttaattatactaattaatagagaccatcctggctaacacggtgaaaccccgtctctactaaaaacacaaaaaattagctgggcgtggtggcgggcgcctgtagtcccagctactctggaagctgaggcaggagaatggcgtgaacacgggaggcagagcttgcagtgagccgagatcgcgccactgcactccagcctgggcgacagagcgagactccaactcaaaagaaaaaaaaaaaaaaaaagaaacagaatcttctgaagagcctagggatggaacacagtcctggcagcaccttgattttggacttttgtcctccaggctgtgagagatcaaataataaatatctgttcttttaagccaccacgcttttgtcaatttgttataaaagctctagaaatctaatagagattttaattttcatccagaaaccattgggatttttaatctccatgcagaatggaagggacaaaaacatttcattaaaatatttatctttaagcaagttttgaaaattatttgattatgtaatttaataaaattatatcatctctttttttctcttagcaaaatgaatctcacaggagatgataaaaaccagatactaaatttgtgctaaaatgtgaatgaaataacttccacctttatttggaagcatatgcacagaatataacaacagataattggaaccaaagaggatgtcctaaaaaggctgcctggcttcagtgttggtgccttggcttgtggcttcttgtgtctgcactgttacaagaatgcttcctttttttcatttatttctcttgttcttttctttatttttcttttttcttttcttttctttagcaccttaggagtccattctgattttcatgctgtatttctatttgattcattcattgtgcaaaagaaattttattagaggaattcagctctttacagaattcagtcaaggaagtagattacttagtagagccatcatcaccattcaccttgtgctttttatcttctcactgcagatactcacaccattgcctcaggaatccagtctaaaggacatggggccatgcacattagccacattacttcaggacattcacaactgttcattggacatgctgattttccatattacattactcactatctctgtagggattcaaagtaagcttgagagtctcctatcttggtaatatttcagccaaatcagattaggttcacattaatatgtattcttatgaaaataaacaaaatgaataaaatagtaaacatgcttttacacttgaggatattaagtaaatttctgtttagtttctaaatcacattattaaatttgttttttctttgagcctctgatagactattacactattttgataatagcattattaaaaataaaaatattctacaaattgacataaaattataattaaacggcactagttttgaatacagcactaatgaaatagtcattaaaattaataaaagtaatagtggtatatcctaatctgctagaaatatttaaaaatttaagggcaagatatttctgaatcctatacaaataacagttcttttcattttgaaattagtctgttttatattcaatggtatattaattatttttgcaaatgcctacatctgaattcatttactcagtatcagagattagcaactcttgtctattccataaatatgacagactaatgcaggtgatctttgaaaagatgtataccttaatcatgatgctacattatctttattcagtttcccactgaaattaatagaagctttaactaactcgagaatagcacaatactgaaaataaatatatattcctttatgttaatatttcctacactaatgtacagtgagtcagtttgggactcacagaaaagacatcatgctaatagaattctggtgagaaaaatgtaacattaggaaaagatatatcaacttttttcttcagtcaatgtttgttattccagaaagaactgtttttgcatgttgaatcacttattgtgaaaaaggaattcagagttttccaaagaagcacataaaggatttcaaatgcattcctatggtaaggtagaatatagtccacataattttagaaaagcaatatatgcttaatgggaagtaggtgggggaggcaggtggggcattgatagtggctattttctttctggtgtatttcttctgatttcctttgacttcttatatttatttccccatcttttacagtcttctgaaagtgtttctaatataccaaggctatgtctaaggatattaaaaaatactgcaacctaaagaagtacagataattagattaggaaggacatgataggaggagaattatggactcaaactggagctctgccacttcaatggaatgctcttctgacctatttctcatgcaaaatgtagaaatctgtagcattttaaaagtgaggcctaatactactttcacagatgctgctagatctatgtaatgaaatcaacacaggcatgaaccaatgctagattagcattcataatcttccttaaaacataatctgtagagtaaaaaatatgcctgactctgcatcccataccctcttcactgtactgagctgagtcctagctgcagatgtgctagctattcgccatgcgactgaaggcgggttctctgtggctgactttattctctagaaaacaaaaactttagataaaatagataatctccgagatccctcccagctcaaaacttttaattattagattcatttttaccatatagtcaaattcacctatcactttgggaagagactgtcattgaattcaagcaccagttatttggagagagcaaactacttatttctgatttctcctgagtgcagagctttagactgtgttgtgtggttatcatcaagcccaatgcttcacatttcataaatccgcgataaacatgattttttaacaaactgagaccctattaatgttctagtgttggtctctataatcacatttatttattatcaaaatggaaaaatatacacataagactcatgcataatcacaaaatctagaatgaattaatctaaaactcccaaaaggcaagtttacattttttgtttctttccttttgttttcgcttcacttcaagaactcacatcgtcatatcataaccttgaaatacagttaagaatttccatccaaatgtagatcactgaagcaatgcggatcccatcagcttatgcaatatgtacgtgaacgaagagataaaagagtaatgaggtgggtgtcttagatattactctgaaatttcagtgctattgttttattttacgatttactggaagatttcctgtgaatatgcagacttggaatacattggattcagatgcagggtttccattccatttatttttaacacctgataagtgaatctgattgagggagactggctcccggctataggagctggcagaatttttttgcatgatctcaactgcagataataattatctttttgtatttgggatttgggtagctttttttaaaaaagttactttaaaaaaatgctttctgagtttataagtgaaataaaaataaattttattgtgcaatttttttataacctccttttgtctttgcactaaggttttcgaagagaaacatttatttccaatcactttaatctcactgactctaaaagtaatagatatgttttgagtgaaatgtcaacaagaaaaaaacagtgtatttttagtatattcttcaaaggatttaattacagagctcacacaaataaataatttaaaaatagtgagacatttaatatgatagttttggccttagtttatatttctttcatctcttggagatttttaaggcacattcaatatggaaattttagataatagttacagaattctaggtaatatgagatataaaggataaaactagaaagtggctgggagtggtggctcatggctgtaatctcaggacttcgggaggccgaggcgggtggactgtctgaggtcaggagtttgagaccaatctggccaacatggtgaaaccctgtctccactaaaaatacaaaaaaaattagctgggcatggtggcgtgaacctgtaatccaagctacttgggaggctgaggcaggggaactgcttgaaccagggaggtggaggttgcagtgagctgagatcatgccactgcactccagcctggacgatagagcaagactccatctcaaaaaaaacaaaacaaaacaaaacaaaaacaaaatcaaaacaaacaaaaaactagaaagtgcctgcttgtccttggatttcaaaagattataaataattgaagatgctatttcttatttttcagataaattctctgcttgaagaaaatctaggtatcttaaaaatggtcaacgagtgtatctcaacaatgattttttagatgaccactttaaagatttcgtaaaaaccgaatctaaaagattttcatttgttgtacctacttttattttttgtaacagaaaagatataaaagttgttcttttccaaaaaatatatatgcaatttggagaacacaccagcttgcatacttttactgtcttgtcattatgaaaatttttaaaagaatattttcctttctaaaaattataatgggcaacattctaaggaaaatagtagaaaagtagaagtcaaaaaaaaaaaaaaaaggaaccccaacaaagagactaaagcgcaaaacaaaaaaaaaaaagtaaaagaaagaaaataacagcacccttggaaggtacaattcaatacctaatttcgctctctgccagaataaatttctttccaacctgtgtctcctcagttgctgctaatgctattccaagtaagatggaacaagtttgaagaataagttatcaatagcccaagtgagctatctaaactgattttattggtgatgagtttttctcaaattgcaagagctgcattatcaaaggtgtgtttaagagagaataaggcctctctagagtcttttttttgtgagccctagcattgaagataaaaaagccttttatttcagcctttatagtggtgggagagatgcaggccatgctaaccccatcagttaagtgctgtctgaaaattatatgagactgagcaacaactatcatcttgtttaaatatgaaaagtgtttgttctctttgagtgaacaagaattaagggtaaaaattgaatgaagtgaactgatctattgacatttaagaagtcttttctttatgtcatgatgctaaagtgtatctctttatttcttatatttatttaattctgaggttccaatgtattcatgttttctaccctggactttgtgacacactagaaagatcattgaaaataaatacaaattatggccctgaaattgctacctaacaactaccaaactcaattcaaaaagcaaccccattaaaaagtgggcaaaggacataaacagacacttttcaaaggaagacatacatgtggcatcaagcatatgaaaaaaagttcaatatcactgatcgttagagaaatgcaaatctaaaccacaatgagataccacctcacaccagtcagaaaggttattattaaaaaatcaaaaataacatgctagcaaggttgcagagaaaaggaaacactcatacactcttggtgggagtgtatattagttcaacctttgtggaatgaagttcggcgattcctcaaagagctaaaaacagaactgccattcaacccaccaatcccattacatactctgggataacccaaaggaatataagtcattgtactgtaaggacatatgcacatgtatgttcattgcactagtcccagtagcaaagacatggaatctacctaaatgtccatcaatgctagactggataaagaaaatatggtacatatacactataaaatactaaacagcgataaaaaaaaagaatgaaaccatgtcctttgcaggaacatgaatggagctggaggccatcatccttagcaaactaacacagaaatagaaaacaaatactgcatgttctcacttataagttggagctaaataaagagaacacatggacacaaagaggggaacaacagaccctggggcctacttgaaggtaaagggtgggaggaaggagaggaacggaaaaaataactattgcgtactaggcttagtacctgggtgatgacataatctgtacaatgaacccccacggcatgagtttacctacataacaaaccagcatatgtattcctgaacctaaaatgaaagttagaaataaaaataagaagaaaaagtaaaaaagaaactttcgacaacttataaaatagaaataataccacttccatctgtgaaaaaattccagattgtggtgagaaggaaatcagatggtcaatataaaagcattttgaaactttctaatgcgggttaaagtcccagactgattgtgtttacatcttcaattcatcctccaagtacactaaaatgtcagtaaagaaggacaaagaacaacccacaaagacaacggaaataaatatggacatgagagtaaatgaaaagtttttgatgatgggaaactaatggatgactagttactcacaaaaaagaaggatgaaaactcagtttattctgaggtggtgagcaaaagaagcaggtcaatctgagccactgaaatgtacaagggctaaaaaatcagagacaccagctaacttagaaagtgggaatgaggggtgggctgaaaaaaagacaaatggttaaagtcgtgtgtaacttggatcattctccaccttatgcaaccagagaaattatatcaaagactctaatgtcaagggtgcctgcccaatagtggataaaacattatagtgatagtgaaacaaaacaaaacaaagaatattgttaaccatttcagagtggtaaaagtgagtactgcaactatgaagaaaatgcaaatgataaaaaagagttcctgcataataacaatatgcaactgcccaaataacagaacgtgcatgctatttagaaaaatggagatatgtgcagacagaaatagccacaagagttacaagaggttacttctgaggagccagaaatagtagtgggaaagcctgtattaatctttgacttttaaactatgcatgtatattactttgataaaaataaaaattcaatctaaaaataaaacaaagaaaaaattaaaatgtaagtcattattatttggcaacacagtgcaacattggatccattctcttatgcactgcattgtggtatattcaacaaatattgtacattttccatgtgccaggatttattctaggcaatagggaaaaaggcaatatctaatattccaggagtgttatgccaccatttattttcatttaattcttctacagtcggttaaatatgactctatacgttttacagatgagaaacatctccctatccctactggaacacagcatgtgggaaagttgagatataaatatgcatctgctttaaaagtccctttaatgtaaccagatccacctttccatggcttcttctcatctacaaaatgaagtctaagccccttagcccataacataatatcacaaggctcaacctcagtatcacaaatatgcagtattatgatcacatattatcagcgcaaagctcaaactctctaggttgtggtgtgccacttcctgccctatatgccttagttctactaataccaaaccatctttactggagtatcaggcctcagtgatcctgcattcccatgttattccctctccttaaaatgttctcaccatccttctttatttggcttcctcttttcattctttatcatcaagtctatctttgtgtgatcccttcaaaaaagttttcccaaactctgaaatccagttatgtttctttcttctgtgcatctgtaacaagagtgccctcatctacctcactacttacaaaccaaatgcttaatattttatctgtaagacattgtaaaattcatcattgtatcccaagagctactaggtgtaagaatgacaatgttccctaaaatgaatctaatagtagagagagcaaaattacatggaaagctataattctacgtagacattgagaaatactatgataaatgagagtctctcattctttgagagttggtagaaagaaaatattacagagagtttgttgcctaaggaaaattttgattaggttcatctcatgattaaagcagaggatacaatgcccagtaggaggacgctagaaggtcttacacgaggccatcagaaagcagaagcctccttctaaggaagactagctctgctttactcatgtgctgggtggaaagctgagttccaacacttgaaggaacttgaacatcatgaacaggactgggtatttgaagatatattttgagatgtgcatagtggatgggaatggtggaagtgatggaagtgaaacttgatgagattattgaaaagatatttatgaaagtaccatgaaagaagcagcagagaacaacagaggagaaagattatgggagacctatcaggtgataggctttacaaggtttagtggaaggcataagggcagtgacaaggagatgtcattatggattcaaggttttgaatctcagtgtaagaatatagcaccataacaagaatgttatgtctaatggccccagccttaccagtaactagaaggtgagatttggaagggttagaagggttagaggcttcatgcataacagtgaaaaagatgaaactttccctacagtttatattcatgatatgaactattaaaaaatttcaaatgcacatctagattagaaccatttggctcttatttggaaacataaatcatattgtttagcactgtatacattgtggaggttgcaataatgtttaatgtcttgtttggcatttttttgtttttgtttttgcatccaatgagcaatgtcctataaacaagtaatttgtgacattgttactatccggttctttcaatttacaaaagggaataagaatgtcaagatatgccagttaaggaaatacaatggtaaatgaaaacctaattttcaaaaaaggaaatctctctttttttcagactttacaaatccaaaccaaggcccaatgtaaatatgggcttatcttgaaccttaaacttttaagttcagtattaaacccatgtgcttttacataacttgttttcttctaagtaactttcagcataacacagaagaatttctcagtcctcaccatctcctgtccctaaagggttagctctctttggtctaactatcatttggcatagcacagtggacacagcatcttgatggtacaatacagccagcctagaattccagcttctttaatttttgtcaacactcttttcataaaagagatgatgtagctattgatttcaaaatgtctgaatttgttttttcatttgctttcccaattgcttagagttactggctactatattatttccttcaaacaattccacaatgcttattttattacagtgcatatagcaggggttcaataaatgttaactgattaacttggagcagacagcacagtgtttgcatacatgtaaaactccaattggattcagaaactcaaatagagggatagcaaaaacaaagcaaaattacctaattgaacttagtttaattagagagtgcctgccacaaacattaatttaggaagatatcaacaagtacaaatgaaatataatttataaaactctatttcgaagaggagaaatacctgaagggctaaacatgcaaaaagaagaaaatggtgagtttccttttatcagtacacatggaaagataagtgcattctacttcacatatgtggaattctctgacaatatctttctcgggtgttgatgtaatcattgtagttcttatgaatcctatacataaaacaaaactgctgcacatgctacctggatttaatacatttaaaataataaatgttctttttaaactatatttaatagtttagtcatacagaaaacaacatgggtcataaatatttgtcagtcatttagagcactttgcagttgaaattattttgcctgtttgttgtgggtgatatttgtaaaaactaagaaaaatgctgattcaaagttaacctccaaattattgaaactatttactattatgaaacttaataaataagtcaaatatagcattttaacttcaatacattgatgaagctataagtacttctacacagggttatctggaaaatgaaataatggaaagcgcttatttcttttcctgagagaaaaatcagattaaatagctttttatctaggggcaaactcaaataaaatagaattttttttctgacagaatttactcctatggaccacataatggaaggagatacttcctgcatttgtagagcaaagcataattcactatcatccaaaaatttttgcatactccacaggggcttgaacttcagtaagttttactttgagcagatacaatcaaattaaatgcacttcagcccttttcaactgctaagtcttcataagttcagactgctttgtgaacaactaaactctcagaaatgaaagatgtataaagaacaaatgtctgtgagtctcacaaatagagattggacaaagggatgcatacatgtacaactgtgcatctgtattcaacaatatgtggcaattgatcaaaatagcaagtaaatacacaggatcatactccattttatttgtaattgattaacttattttttctattcataacttgaaaaactactcaacatattttttactaaaaataataatctattcttcaaataattgtgatttaaagcattcatgaaattgttctaccagtcatagaatcagaatgctaaaggagtctcaaaactttcattaatcaaactatgaaattaataaaatgtgtctctgaaagatgttatgccattccattttaccatgtaaagctagcccccagtaaaaggagttcaagtttgtcatttcagttatctctatgctatcctttgattcattatttttctccctcattcccattttctctttactgcctcctgcccacccatagccttataatcctaacttttggctacacaatttagtcatcacctattgtgtacaattacttcaggtcctactgctcaacagaatatttattctgttaaaataacttttttttaattaaaaaaatgatttgtagatacagggtctcaccatgttgcctagactggtctcgaactcctggtatcaagtgatctcacctcggccccccaaagtgctgggattacaggtatgaaccactgtgcccggccttgaaataacttttaatgtccatttttccacttgtaaaactaacacatgtctagtatgaaaaacttaaaaattatagagaaaaacaataaaattaaaatttgtatgttatgctgactctgggattaggctacatgttttcaaattttggggcctttggcaaataatttaatctcactctcattgaatcatgtgtaaagtaaacctaacaataagtcttatctcatatagttgtagtgagaaataatttttaaaatttgtgtaaaatgaatataagaatacttggcataaagtaagactacagtaaatatcttaatattatttttcagagaaattattgatccattaatgccaatacaaatatttccagtcacaaggccagaattctaggtctgtctttacttatttttagctgtataaacttaagcatgattttactaataagaataatgatataaaataataactaatgcttataatgaaccgagcataattttaagccttttacatatattataaataaataaattctcctaacaaccataggaaataaatgctattattatccctatttttcagatgaggaacttgaggcaaaaagaagttaatcatccacgattacccagcttgtaaatggtaaagccagattttgaacccaggcaatttgtctccaggatatgggatcttatcctctacatcacactacattaatctctgtgagctttgaattcccattctatatttcaagaattaataatctcttcttcacaggcaaaatcataatcataaataaaaagcagccggaagtatagcaatgtgtgaagtgtctcatatgttaaaatttgaaataatgtaaaaatatgaagatacgctggctatttcttgaattcgctcccttctctgtatcttttaagtcaggaaaacatttccctgtaactctgtataataaaatatgttcaaatcactgtggtaagcactttatgtgtaatagttcatttaatcttcatagggttgtgatatgagaaaactggggtgtataaaggttaagcaacttgcccaagattgtaccaccgataaatccctcaattgggatttgaatgtgggaagcctcatactggggtctacataattgtatgttatattttatacagtttctaggggaaagaggaaggatatatttatgtcctaggttttctatgtaatgactttgaaaatgtatggacaaatctattaaattatatatgtacacaattttatgatttctagaaatggtaaccatagagtaatgcacagataagaagtaaaagtactttatctctttgaatccgttaagaatatcatttattttccatcagtggcttcccttcccgacatctagaaaattaggatatttaataggcttgtttattcattctctaattggtagacaaattttgcttcaccatacttggaagcacattttagttgatgaaataattttcttcaaccaccagggtttctcatatttgagaagaggataactttgctcatgagaaggaaactggaaaggagagcacttgaaatacatttaactgagaacatatttaagaaaataccgttaaaggaaaaggaaggaatatcttgagtatacatgaagtggaaaatactcatatgtatttatttgtttcccaatctcatctggaaagacatagctaattaaatttggtttcagtgtgtgaaaattctatatgtggtagagtaattgtttttatcattttataaaatatagctcagctacaaaaacatttaatcctctaaatccaggatatttatcactagcttaaaattgggcaccaggcctttaccacagctggtcattaatctaccagatatgttccacacaatagtgcattatgagactttaaaagaaacatttgtcttggctgagtgaatgtttaagttttcgtttctacttctttgaactctgcaactcagtaacactgagacgtccttctggcatgtctggtctggtcctacagactgatcttcatcctccgcttcttcccaaccccttctacaactattctgctatcccactcagtcctgctcccatctttccccttctcctctctccctttttctgccttcctccaagaatacataccatgaagggattccaaatctcagaacatgcagagggtccccatgatgttggttaatagaatcaaagtagtgtagaaatcaggttggtgtttcaaaataactttcaagcatctggtctctctgggccacccataataaggtagacctttccctgatatcctgaccagccacaggtggcttcaccggactgtgtcagatttgcagattctcagagtccattctcatgagtgtatttgctgctttctagcaattctcctgtcagagatttctcacagttcttctgtcccttttccccagtacaaaagtcttaaggcaaaaaggaaatgacaattttgcagcagggaactgtagaacctacaggtcagtataataatctacaaaagtgaaaaattgcaatatctgccttgatattggtattttgaggcagaaacagttaactcaaaaatttggtactctaaaagcagaattttgagtgttttctgagcaagagatttccagggagaaactttttttttctgtctgtggaatcacactgcttaggaagtacctaacccgtctactttttcaacagtatacctttattagccacactagaattcctaaagagttaacgtccaattccctcccagaattgcttaatcctgtatgttctataaccttcacttactgaatccagataaaagtaacaagatgtaggaatagcaagtagtgaaagaagtactcgagggtttcaatcaaggcctggtgccagcttcacatctgacacacaaaaaagagataaagagacaggcgggagatagagagaagcaacagctaccagggagaaatacaaaccactcacgtggtactgatctgtggaaggggtaggtgaagggggagacagtgcagatataagactaaataacgccgaccaaatagtacactgctgagcaaacaaagaaaggggcagaaacagaatgcagggcattgaccctctcactcactactgctggaacatgaaggcgcctagtggtcttcaatgatccaatttatttgattgcatggggttagagcatattggagaagatatcacagaagcgcattccccacagcatttcagctaccattcagcagtaggaaataaacacccccatttgtgccacaaaggggaaaattacattcatttctggccaggggaaaatctctggaataatatgatgaattgaagaaatcaaaggatttttttataaaatctgctttatcaaagccatttattttctgagtctctttttagttccttttctacacaattaactctgaaaggatgtgtgtaaaccaatcagctttgacatacggaatttgaaagaggagcccttcattcaaaaaggatgctttggggactgtttaaaaaaaatcttaagaaattattttccatttctaagtctctaatgaagaaagagtctgtttcttgttccctaagacccctcacaggccatagatgaagagcacgtacagacaggtcccctggctcttgtggccactgtgcctattaacagcaagaagaggtcacaattctgttgacactgcctgccagtgaggccatgcatcagttgtctttttggtcactaaagtaccctaaggaagatcagtcctcccctccaatcatgccaagaacagaggccagagacatccatgtaaaagggaggaagaaaaaagaaggtatcatggggatgctatgaagagtaaaggaggttgggaggccgaggcgggtggattatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccgtcctgggcgacagagcgagactccgtctcaaaaaaaaaaaaaaaaaaaaaaaagagtaaaggagagaaataagacagaaaatagaaacataaatttttcaggtgaggaaaacataaaaaaggaaggagggaaaaaaactgaagatgctaaatctaaaggggcacaaggtactcagttaaatacatgtgtaggttttacagtgggacacacagaaaacatgtctattataaagaaccacatgactagagaaatcacagagaacaaacacctgccacagtgacatatggtttaataaaacataaaatagctatggccacgcagctaaacatccattatttggaatgcaaggaaaaaccacatatccatgccatgatgtcaaggcaatgagctctatcatattggatgttaaaaaaaaaaaaaaaaaaaaaaaaaggctttctatgttctgaagtagacttagggagatacacaaaactagcaaatcaaaagaatgttattacaaagttgtttcacctcaagcatacaaaattatttttatgtttttttccactgagactaccaagtgaaagcaagagcaaaaactaaatgcctccgggttggtgctaaaagagaagggaaagtggaatgaaaagaggtgaaatgctgaagacctgttttgccatctaaacaaatttgcctaagctgatcctgcaggagtgtacacagaggtgatatgactcccaaagtacatgtaaacctaaacacttgtttaccagccttccactcccacagatgctcagtgagaacaaaataaattagatcaacattttaaaaatgcatccagtagctatttgcccagggaaagaagacaagtggctatttcaaaagctgatgtaccaggtcagaatactcaatatatgataaaaattaatgagccagtaagtgatccagctgcagatctgatcaatccagcaactgcattttgtgttgcctaagtagaacaaatgagtaatggcattttatggctagagcttacataactgcaaatgtcattaataattttaatccatctttaaaaatgacccaagtccattaaaaaaaaatccttccagcatgcttattctgtaacttttgggaaaataaagcatatgtgtgaccataaattgcaccagtaagtacattactgataccacaactaattatttctattaaattggtcagtatatttctaacctcttaaaaaaacttcttttttaaataaaatatgaaacagaataaataagacatcagagtcattttctatcacagctttcacatttgtgactctctcagtcaaaactccttgcctagattttctcatttatataccattgcagttaatgtttttttaatcactcatcatatgtaaatcccaaagtaattctaattatcctggctgttttctctaaatctttttgatctctgatacacatcttaaaatgatataatcaaacttggaccatgtacaacaaggatgcattatctgatatgaagtcattaagctattttatgattaaaggtttacttttctttctgtataaaatacttttattatcaactatgaaaatgcagctgaaatttgtcttctctgtgtatcatactgcttttctcatggaatccaaatgtgcaataatttgatctacaaagagcatgtcagctttccaaaagttgttgatcttatgtagagaagttgaatttcatctgtcacagctacctgactccccagaacgcttcaagtttgctgaagcgcctcaacaattatgaattcttcaataacattattatttaatattggtaagcaaaaatactgctcttttctattgtactatatacattatttttattcaaagacttttgtaagttttcattgaaagtgacatattttggtaccctttccaagatccaagatcacatcctctcttcccattcagctttaagaggaatcttaatatctgatgttgatataacttatgatagtctggaaaatttgttggttatagctatgaaatgcatgccaagtaatatatttttatatttgatttacataagtttggataatagtgtggtttccatcatttactcctggtaaaatgatgataattgagggaagttataaaacatctgtttcttagaatagtcctagtctaccaaagcgacagattacattagtaattctaaaaaatatattacacaaagtctctctggatacatctctaatacttcctaattttcatcaaaactttacttagtccttggctctctgttcttttcactctgcattttctttctgagaaagctcaatccgtaaacacattaataaaatgatttcttaataatgactctcccaatctatatctgtaggcatatacatatatatatatatattttttttttaatgactagaagacattcacagataccacaaattcactgtgtccaattgaacagtctttccttgtatcaatcctgcttgtttccttacattccctatctttgaataaatatcctgtagttcagaacagaaaactgagtggtattctagaagccatcattttctttattccctgctcaacttctcaaaataaaaacttctttgctcaggtggtcataaatgcttacaaggactattgcaattacttcctaattaatttattcacaactactcttttctctctgaaatctaccctctactcctctgttacagttagctctcaagttgcatattcctcctctataatcttcttaatactatgtaatagatgtcatatttttaaaatcacatattttagtatcatctggctcaatctcagctcttatgacttactctctcccctttcaaccactactccctcccaccaatagcaaatacatctattgtttacgctatagaaaacacatttacattttaaacagatcacttttcctgcttccgtattttggctaatgctgtacctggaatgctcttacctcttcttcatctgaagagcattgtgtggtccacagaggtcctaaaacttagcttcaattcctctggaaagactcgtgatctctgcactctcatacaacttataattacttctatcaaaatacacttctctatactctaactgatatctgcttacctacttaatccactaggttgcaaattaattgagatcaacaaacaagtattacccagctttacagccccaacctaacctattataggtagtcatggaatgtcagtaaatgaatgaatgagtatagtatttgtttgtttgtttgtttgtttgtttgagacagagccttgctctgtggcccaggctggagtgcagtggcacgatctcgactcactgcaacctccgcctcctgggttcaagcaattctcctgcctcagcctcccgaatagctgggactgcaggtgcatactgccacacctggctaattttttttttgtattttagtagagacgggtttcactgtgttgcccaggctggtcacgaactcctgagctcaggcaatctgccctccttggcctcccaaagtgctgggattacaggtgtgagccgctgtgcccgggcatgagtttactattaaatatataacatcatagtctactaccaatatagatgatttaagtgacatttttgaagaacagctttaatattatgagtattatttaaaaattgtgtatttcatatacatcatattcatttttagcatataaattaaattacaataatatttcagggataattaaaaataagtataaaaattaaagaagaatttatatacacattgctacaagattacaaatattgcagcactaaaaatgtcaaatatttgaaggactcagtactgtatggtattcttataatgttcataattacatatctagaatggcactacccagttgaaatagaatgtaagccacacatgtagtttgaaaatttctagtgaccaacttaaaaaatagtaaaaagataaggtgaaataaatattagtcatgtaatttatctatctcaatatatccaagctactatttaaacatgtaatcaatataaagttattgaggtattatggaaccctttttatatgcagtctttgaaatctggcgtgaattttatagttatagtacagttcaattcagaacagctacactaaaagtgttcagtagccacacacagctagtaccttctgtactgggaagttcacaaagatgggtggctcaaatccattcaataataaatcagttaaacagcagctctgaatgaaatctgagttgcagctagaaaactgagtttttaaaatctgtttgcgtgtttgttttttgaataccaaaaacaatgaccaaagtaaagtttaaattacttttaaagaattaaccttgatagacgtctccaatataaaataaggatgactaaggaaatatgggttttccctgtcctattatcatgctacatagtaaatgagtatatgtactcattgcggatttccaaacaaacgaaaagagagccatcatctgctttcagaggtttcctgaggcagttttaaaatatagtacatagtatattctatgaggcaaattgctcagcaggttgcttcatggccaaatttggagtggataactttgacaattcatattcttctcaattgaagattaatactttccacaccctagtcagggagctaagtcaagttataaaatttcagaatagtatatattcccttaatagctttctttgaatatctaaaagaactttgaaggtagcaaagtaatttttaagcaagtgaacatgatgtaatggacaaagaacagagaggagacttaagagcgccaacttttagctggagttagccaccgactggcagtgtaggtaagccatttacactctccatgtctctctctatgcataactaaacttgagaaaataatacctcatctatttagttgacaaaatttactcgttaaaataatggaaactctaaggctcaaatctctgaaaagggaaacattatgtaaaactgaattgttttattaaaattattatattatctcttcctgtaagaaaataaaagttggagaatagctgagaaataataatagtgacaatgataatagctatccaggagatgctcagggcgtgccacaaaatgtgttaaacatattatcttagttttctatgtagtcacattataaagcaggaattattgtatctattgtatagatgaataaattaaactaagaaagaataaagaattccctccaagtcatgcagttatcaagtggtagatctgaaattttaactaactccaatgtgatcatcttaaccacagtttctacttgagagagtaaccctggagatactctccaaattctaccatttcttagctcttttttatttaggcatgtccaaccagggccccaggaataactgttataatttctccactcttcttaccacctacaatgttaataagtctataagtagtacagagcctgccttcttatccccaagacctaatagaacatccagcacaactctgttgtttaaggaatgtatgaaaaaaatgaattcatgaggcctgccttttagattacttcccaaatgtcaattacttcccaaatggcagccttctgatttgctattgtggaaatgcaaccatgtcttttagaattatgagcctaaaggtgataagacattaaatatgaggtataaaactcatcacaacggcctggtgtggtggctcacgcctgtaatcccagcactttgggaggccgaggcgggtggatcatgaggtcaggcaatggaaaccatcctggctaacacggtgaaaccctgtctctactaaaattacaaaaaattagccgggcgtggtggtgggcgcctgtagtaccagctactcgggaggctgaggcaggagaatggcctgaacccgggaggcggagcttgcagtgagccgagatggcactaccgcactccagcctgggcgacagagggagactctgtctcaaaaacaaaacaaaacaaacaaaaaaaaaaaacactcatcacaaaaatttaaatcccaaatatcttatatattaaaaacccaccatgaagtagaacagtcaagtattattatacacaagtttggtgtgtcattgtttattttccgcatggttttgtctatacctcttggagggaagaaaagggagttattcagtaaagtgcccacatcatgcaaacttagactgagtatttatttcagtgttcgagacctagaaccatgatattactttgtgaacttcctgtatggcagtctaggagttccccagagacataaggcctcatgaataatttttttcactcttaccttgacttgtgtagtagcatctgcagctggcacttaacatcaaacttcctgccaggcatcagtatgccaggatgtatggcaatgcaatataagcattagggagacctaaatctccaaatttacaggaaaaaaaaaaaaaaaaaaaagctcttctactgacggaatctcctgaaagagttattttctgaaagaacactatttaagatcaaatgtctttcgtgagctcaatgtataagcaagtaccatgaatgcttttacccacacagaaaattttccgtggtaatagttaaatcacactcagatcagaggatttgagagctggcatttatccattgttggaaagagtgatcatagatgttaaaggcttcgcttggttatcttcccttgtctttagctcaactcaattaatgggagaattgacaacttaaaccccttcgtgccatgtcttcaggaaatagcccatgaaggaggtatgaaaaaacggttctatgtattttgattataccatgaataacattgctattctacacatgtatagggagccactatcagagaaagggtttttgggaaaaaaaaaatcagatacaggcacatatatcagagaaatatcaacaggctaaatagacatgtgtctgaagaatggtagagattcttatagtttcaatgtttgtccatattcatcttcactgtacttaaggattaactgaaatttgtctattccgaagtatcactacaataatttaaatacatctcaattcactttcattattttacaacatcactcaggcctcaaacattttcaagaaaatgctgaaaagataaaacttacgatttccatgtatgaataattgtagccagaaagctaaactaattttttaatgccaaaggcaatcaacattttctttctctgatcactccatcagtcaccaattacaacacaaacatgatattctagaacaattttctaaatgaaattaattgaagttttgtttttaatgatgttcatgaaattctaaaaaattacttttactcttcctagtagctagttttgttaatttttttaaatcatttggaattattttagagaacgaatattcttcagaattagggatatctatttacgtacaattgttaactctgaaattacaaaaagaggaataagcattaacttgttgaaaaaatagtaatagtacacaccacattggaaacttcctggagaaaaaagtattttctgtgtagccccttgtagatttttttgcaccactggatgtataataaatatgaaataacatttacaacattataaaaatatggatgtatgtaaaaatcaagccaatttgctcatactttttagataaaacatactttctatctctttatgtaataaacaaatatacacattcacctacttgcagccaagtatagctataagaagtcacacaattattttcattgagacaagttaggatcatatgctaccctactagaaataagcacttgctatttcttctgcctattcatttgtgcctattatttcctcacagtgatgtttcaaaccttttctaaaacccctgaggacctaatcagttccatcattttttaatatatgactttactttctatgccattgaaaagatcaaagtcattaagttggatactctcacaatctttctttctcaccatctcaaaactatttctgattttttactcaactatcccttcagggagctctcttcgctgtcaaggctacttcctcaacatatgatcttgatcccattccttcttgcctgctcccatcaatgcttacctggggaaatctgtaatctttcatgccttcaaagtttcaggcattataaaaggatcagaagacataaccataaataaaatgatctttgctttcgagaactttctttgtcgtacacacctttcactttttacctctgacctttacattctgagtaaggtgctttctaaagttaccaatgatctctcaattgaccttttcccaatgtctgttttccctgattctctttgaaacatactcctccttttggttctatatggcccgaaatttcctccagtttgctccctccacctccctactataattcactaagagagctatgctctacttctccttttttcaatctgtttctagataatataattgcacagtattaatgtcacctctatttgatgtgttcccaactaaatatcaaggctttgtttctattctcagcttcagttgtatgtatcaagctacctgttgaataacctgccattattcaaaattcaacatgactaaaatcgaagttctcattttacccataaatttctccaattctagttaggtctctataagtcaattcttaagatactattccaggctttccatgatttcacttccaatttactttcccaagtttaaattccactactatctcctcattattcttcctaaattgtagacacaacagactacttgttgtagtccaaagtgtaaacatatcatagcaccaattatactgcaatgccctttccccaaaacgtccaagtacaaatgttatttttcacttaaacgcaaatgtccaatccccatgaagcatcatctaatacacctaaaatattgttttcatttttcaaataatgcttacaactttctaccctatagtctagctctttggtgttttagtccaatattcaactctcctgtgaacttcctggcgacagaaacaacactattttttgtgtctccctgagaatctattatagtaccttgtataactaagactccaataaatatttattggatgttttctttctgaaaaaataatctgacatccaaattcatattttaataacctgtttatgtctctgttacatcttctttccatttgcataagttacttatttcttcatctaattgctaatattcaatgagctaagccagctttccagctataaaattacatttagtctaaataatctccagcatttttgccagtcataaatttccaaaatgtacatgaggtttgacaccatactaccttctacctatagtcataccaggtaaaattaacatttttaggctttgcattaacagtcattaacactaatagatttatcctttgtaaaaattaacaattttgaaacaacttcttaattttccctgactaagaagaaaattcccaggagttgtaattgtggttggtaaggctaagaggctctacgtaaaggataaacactaggatttttaagtcaacaacctgattttgcaatttacataaattccctaaatttctgtgaacccaactgttaaatgaggctaatcataatacttatctcaaaggttttgtgaagattaaaccaaataatgcatgtaaagtgatttttgtgattcctggcatatagctcaataattaatgtgtattttattaattaattgtgttcctccctatatttcaggcaggaggctttttcaataaaaacaattctattatatacttgtatcctgtatatactgctcacaaaataaattccacaatcgctggcatagacttcaagacctttcataacagaagtctaatttttcattccagcttcataatgctattgtttatctcacacacagtacactaaggccaaataaaagatacctcatgcacctttaagcctcatgtttttccttcttataatgtgttcctgactcccacctaccttctcttgctacacagattcttactcatatcacaaagcactgcttaaaggaagtcataacctccacattttcattcactacattcatacacacttgcatttacattttatatagagatataaatatattcatatatattaattcttttatacataagtatatagtaaatagtgtaatctcaactatatattggatgtattatataatatttacatacaatgttgatatataaaatgaatattatttatctacatatacacatacttgggatatgatatatagttacatatactatagatactgtatataatacacacacacttgggattataaatttaggtacataacattctcttctaagatctgtgagacatctatcttagcacgtcatctggcacatattaaacgatcaatatagttttcttaaatgtgtgaatacatgattgaatgaattggcttctactccatcatctatgaaacacacaaatgccaggctttactatggttttaggtttgcctcactgacagatgtcaatttctgaaatgtactttctgagtctcaattattttgacatcacaaaattatagggctgaaaaggaatataagaatgcccactccaggcttcaatgaggccatcattacttggaaaaatatcttctattttaaaagagttcaactttgaataggatttcataacctgccttgttgactcaaccctttcatgtttaataatgtccactattagttcccacagacagtcttgagattatttttcaaggtaattgaaacattacctttccccacccatttttttcctgtctgggaagatgacaaataccagaagttttaagaaagttaaatatatcagaataagcaagcactatgacagatggatctatgcatcagaactgaagttcttcatctatttacaagcatctattttcacttaggtttgttaattctgtcttctgaaaatttttaagatactgtacattccttctcactcccaaaattcttatgtatttgcatcttgagcaaagcaaatatatatatatatatatatatatatatatatatatatatatatatacatacatatttttgtccggtctcggagccttgactttacatggagtctcttgtagtcactaaacatacatacattttactttgtttacatactatcaatgatgctactgagattttaaggcattgcacttaaaacccagccttaggtttagtactttatttactttgtcacagaacattttgcttctattttccttcgttttaattggactgttttctctgaagacttagaatataatagtatatccatatttgagccatgcatatccatattacaatagtaatacccatatttgagcctctattttgtgtatgtcattgtactgtgaactaaatgtgcattatgttgttcggttcccagaataacactacgaaaggtatgctaaaaccaaggctcaaattagacttcaaatcctatacttttaaatctccaacttattctgaaaactggcatatcatagtgatgaatatttcagaaaagtcatcatgaatgatggttttttctataagcttcctttaatttttcttaaatttgaactttggacaaaggtagttatgggtataattagaatgaatattattaatctagcatttattgactgataagcacattacacatatgatcacatttaatactgtttccacacagtagtaaatttccaattccacacaaaatgtgttaatacacatttaatatctgtaaaatactcattttacaaatgaggaaatagagttgaggcaaaatataaaaaaaaatgtagtgcagtttaagcattaataacttcaaaaatataaatgctatactctttaccaaaaatacaatttgaaaagtgaattatttacatttttaataatatatttagctttgtgaatttaaaacacatttttctatttttagtcaatatttgttatatcagaggaaatgaatacattcactttcatcacgtcatgtttgtaaatgcagtttattaattctttttctacactcttaggttacaaagttcttccatttaaattgtttctaacagtgaaccaattggcaatttatcaaaccatctcaaagtgagagtgttttgcagcatctattgtttattttacgctatcactgtcatttattttatattctcaggatctagatagtcaaaatgaaagaggaaagaaaaaacctgacaggcaggtagttcgggtgggtccttggatgagttctttcaaacaaaaggacagcctgaaggcacagataagggaacttgcaaaggagagcttgcctgagacatgcccacagccccatagataagaaaggctatccaggagacttgctcagacatgtccacaatggaaaactccatcccccgacacatgtgtagtaaagggaacaaagcaatatggagtaactcaagctaagggcctgcatgtgcactaggaggacagggtacagttaccagaaattcgtgatttatgcaaatgagatgcccagacctcatcggcttcttataaaagcttctgtattcaactgtgaaatggcaaccattttttcaggacccctctctgcagcagagagctttctctctttctttcccttattaaacttctgctctaacatcacacttggtgtgtccatgtccttgatttcctcagccatgagagaaagaacttcaggtagcacttagacaagcaggccatttcaaaaatattaatcaccttgaggcttacttgaaatgtagaatatcaggctttattctagacccattgaatcagatctgcattttaataaactccccaaatttcatatggacattaacattcactctttagggtcaaatttgacctataatcataagatcctggcatgtgaatattttgtccttgctacaaagaaacaaaatgctaaatattaaaatagaagcattaacaatgggcactaagaaaggcagaagaaaacaaaataaatgatagatgggcaactagataccagttaagttctttgaaattaaggagggcattacgaacatcacatgcaatcttatagatagtataatagctagagtaacctaacctagtgataagttagaacttcaaggggtttgaagaaaatggaaaagtgattgccaatacaatgtgctaaaaatgtatcttcctagaggctaccctaaaataagtacatgtatactcttgattcacttaagagtgtcatatcaagaaaactatcctcttgtactacatagaccatagacatgtattttttcctgtctccctgcaaaaaatcaacctgaaaactcattataaagttttctcagtggttgacatgaatttgcagttttcttaaatcaaatttttgcttttgaaattttgggttttaataaaattctagtcatctgctgttctttttgctactacttctcagagtttaatatccgtgtttttgtctgtttgttttttgattatatgtgaaaattcttaaacggctttggaagaacattaatttgggcctggacttaaactcatttccttcctgcctttacattgtgttataatgcaataaggggagaaaataagttgagaatctggtaataaagttgtttttattaattattatcatcttaatgaatgtttcataggtgtgagaaatttgttataaaataaaaaaaattcacaataaataattttaaagtatagcaaggtgccttttctaattaatttttcattctcgcattgaatttccaatagtccctagactaaagcacaattcaacagtgttttctaagaaagtagtatgataactctaatatcaactaagcaggaacagttccatccacaattatgatagaatctatagcctatgtccagtgaagtgatagatataaccattagagaacagtaaaagagaattataattgtttggtagaattttattataaagcctatagagaaaatgttcaacaggagtttaaagaattaggtggtagagtgttaaaataacaaaaccatataacatgaggaaactatattaaaaatttactattcgtattactaatcaataatgtcacatcaattgtttactcttaaatgtaaatcaatactaactttcaaaaatgcaattcattaattattctttacaaattgcaccaaggaatttaccacatatctctcatggattccttaaatcaatgcaaaggacacatcgaatgtaaaatgttgcatgtttctatgctgactaaaaataattgccgctaatgggttacaatttagatagcatatgaataaacacatttggggaggttattaacatttggggactgttattaacatgtaaagtgactccaacatagcacttaaaactaggagatattcagatgggcactttcaaggttagcaaattaaaaccaaaaaacagtgatttaaagaaaagatggaaggaaattcaattctgtgttcagatattcacttccttagtaactttctctgattcaggaataacctaaagtatgtgtcccagtgcttgaggtttcctttaagccttgatgcttttaagccctatctgagtgttgggtcggaggttaggcttgacaatctagaggccgttctgctctggtggtacaatattgacttttacggctttgtaaatatcaacatttttgtacctaagctcaagctgaagcagcacagcacactgcagcctgccaacaaacatgcaatgccactctaaagggattttggcaggatttaattaaaaagttaaataagcaaggagaaaatattggtggaaaaggaaaacacaagacataggtgcaggatggcatagcaagtaaaattaaagacattaacaaaataaaaagctaagatttggatacttttaggtagaaagaaaatggagaacttagaaaaaaaagctctaaatggaggaatctaggaagttatcagaagataggattaaattttgtttttagaccatattaactaaacttgtttatcctaatagactttccttatcatgttgagcttatgtaaataagcatggcataaaaacgatataaaatcttacatagaaaaagcactttgataggaattgcactacagtcttttccccagagccaatgcaatgtacagaaaacctgatattacaatgaacggaactaaaatgttttactctaattcagaaacattataaataatttatttatttttgtgatagcattgtactgttaacccagtaccacagattgatagttcatttgcatgagccattttctatggagaaaaggaaagattaatggatagacaataaatgagagattaatgagtagaaaaataaagatatatatattttctcacatttattttattttgtgagatcagtatgcctcattagttgaggagaaaagaagtgtggagagaatgggggcaattgaacttcccataatcaacaactgccttaagccactattctttctttttctcttccctttgtccaattatatatttattttcataatataattaaaaggctgatatatatatatacacacacacatgcgtacatatatatatatttgttaaacatacatgcataggtatttatatatagagagaaacagtaacgtgtttcttctctggaaagcaataaataaaataattttgtttgttttgttttgagagagtttccctgtcttgtccaggctggagtgcagtggcacgatctctgctcattgcaacccctgcctcccgggttcaaacttcagcctcctgagtatctgggatttcaggcatgcgccaccactcgcagcaaatttttgtaattttagtacaccatgtttgtcaggctggtctcagactcctggcctcaagtgatctgcccacctcggcctcccaaagttcagggattataggcatgaacaactgtacctggcctagaatatcaaacttttaacagcaaagtctacataataaaattatgcattacatttttatgtagacagtggtcacagtcacacacatatataccataacatccttggtatggcaaaataaaaataaaataaaataactattatcttcgtttttaacatttagaaaaatcacaaaacaatgctttgacttagaatatgatatttagggaaccactgcataatacatttcaatatcctggagattcaggcttcattagcctgaaaactcacaatgtttgaaaagtaagaagcaaaacaaaggcaaaagaattgaaatcttacaattcaatttaaagttatctattgagcacctccaaatagattttatggtagtcatgttacacatcactatattaatctccttctactttatgggtgattaggtataacttcatgccattcagctgacttcctattgtacttgctttgacagtttgcatttttgttagagcctggttaagcactagcctggcattttgaaattaagggcatagaaacatgcataagtgaagattgaaagttgaaaataacatatttggcacctaagctctgtttattatgtttatttttggctatgatatttctactattatacactgagaactaagcggggatagggtgggggaggcaaaataagagcatagtgaatgcaaaataccccaatctaccatcaagcccaaataaaaaatagtttaacgccacgctatatataaacaaactcaagaagtcaatcactaagatgtatgtatgaatctcagccacacttacaaaccctaaagattacatactcattattagaaatgacttccatctatatattctttctcttgacaaattataatttttaaagaatacggtaaaataacaaagcttttaataattattttgaaattaagcattcatgttctataattatacatatccagatttgtatttatttgacatttgtaaaagagtatttctaaaattttggtccaaatagcttttgcgcattttagctgagttagctctccaaatcttggcaataataaatgcatgtttgtttattcataaatcaagtttccatatttcttttatttaaatagtaagatcacctgtaaaattttcctagtgtctacaatatttcaaaatatctagcataagacaatcatgtacagattcaggaaagaatatttagaaaaagaaaatcaattttggaaatcaactacagtataaaaccacctatattttcattctattaatcttttaattatcctcacatattaataatgtatacaataatgttaaatatacttttcatctggccaaccttttctaatacaattttactcatttttatataatatgtatctttttcaccaaaaagtaacaaaggcttgaattcctacgaaaaggagaattcatgatgggctaccagatttgccattgttatgtctgtcatttaatcatggcatttatttaatttaaaacctctttcagtgtaacccacatatatttgaaataaaatatgcaaataaattcagtctctggagaagggtaaattcaactgtgaagcagaatagatttctattttcctaatgcactttggcacttctgtgtgtccacttacattagcctatgaaagtatttccagctctgtcagcccccaagaatgtgttaaaatgacatggtaaatttggagttctgagagtaaataagcctaggatagaaaaggccttctggaccacgtaggtatagcagaaacattccatgcattttaaatggctataatcataattctccaccacaaaatgtaatatatgttctatcagaagaattattttcctctataagtgtcagtgccaccaaaccaactgtcctgctcacattttctcatggtcaatacacagcataatgctgcttaggatattcggaaaggaaaagaggtgccacactacagatccattatgcattttgacattaagcacccagtaattagccaagtacctaactgaattatgtgatgagggagaatattacaattacattaaaataaaagtgtttccaaaaagttccgctaaaaataagaataccagcaaactaaataatgtgaaggtaaatctctactgctaatgtattctcatgacttactgcaggaaaaactggggggggcgggaagcatcttgcaaagacaaggttagactgcccttaacaagtccctttgacccagagctgaatattctctgcagcacccttacctttctcacagagcacagtgggaataagtacattgttaaccacattttgatgagggtgtaaagtgagagatcacggtcaaaattaatagtgcatttttttggttgtttttgtatgttttaatgaggttatatttctttacacatctctttcctgttaataaggtctaataccattccttccaaaagtcaaactttttcatctaaaataaataatcacttcctttcataaaaaagtggagtacatattaacactgcagcaatttgttttttcaaaaaaaggaggtgtcatttaaatacctgggttcttcccagaagcaaacatgctaagcattcacttgcactagtaaatgtccttggccatattaataagcttgaccatttcatttttaattttcttctatctttctcctagtttgaagttcttttttgaaattaacatccaagaggaaatttaggcttaaattcttttaaaactttcttctctttttaagcacaagttctgaaaaatacatatatgaaagaattaaaaaaaaaaaaaaggaagacattttctcctttcttttttaacctgaccaattttctgggtcaagctcagtgtgagctcacttggttggcagcaggggaagccagggtgcccctgaagaaggtcatttctgacttttctccgccactgctatgccacattactcactgtcttatggccactagttaaaaaacacatgtaagcaatcaagtactggaaagagtacgaagaaaagagaaagccagaattaaaaataaatcctaaatttaaaagtgaactagttaaaaaaaatcatttactataatttcttctgctcaaatactacagaagtatgaagttgttagcctagagtaaacccaatttaatttttcacaatttactctaaagatataggccattttctgtcatttgcaaataatttcagttctttattcattaagtacattaatacaatactttgcctaaggcctacatctttttattttctttgctcctcaaagaaaatatgtcaagttagccattttatggctgggtaataatgaggcatatgaaaaaggagcggctaagttttaactatgaagaagtattagaagacatataataaaatatgaattttaaaaagttatcctgtgtgtctaaatattacattttttgtttgaataagtgtttggagatttttttttctccctgcaattttacttaacaagaacaaatatcacttttggaaatatgaggatatgatgatgcggatatacgtgttcattggtgtttttaatgggtgtcaattattactatgcacattttagagaataggaaattgagtatagcagtcatcatgtgaccaaggtcacatagttaataagtagattaatcaaagaaggttagaattttccttctagcagctctaatccagacatctaactcccatggtgctgctctttccatcattaaaaagaaaggtttttctatctaataaaatgtacttatttttctcttgtgacctactagtacacatcattacatttttctgactctacattctaagtgtgctacacataatttaaggatacatgacaagttgtttacatgaagctcaaatttttcatctgcaaacagcaatagaaacaatacctatctattgggctgctttaagaattaaatgagatagtctatgtaaagagcttgctacagggcctgacacacttaattgttcatacattttaaatattataattctgaacttctataaacacctgtgattgtaaactcactgaaagtttagccttggcctatgtaattacattggtacaacaccttgaatagtcccatgattaatgcagtgtttagtgtaacttgtcctaacaggtgactgatgataataaaaaaagataagtcaaaatataagggcattatgtcacttttagaccactttcattagaatgacccatagcatgttaattgcatactcctagattacaccactgatatttttgaaaactccttcagaaattactttagtgggaagagtgaagtcaaaaagcttccattaaaatctggttctagtccataccagttaatttaccattaaacttccctaaccaccacctctcatcagtcaaaaaaaaaaaagaaagaaaagaaagaaagaagggggagtgatcatatctcatattacacattatgatctaatatgttatggctactaatatgtaatggtgcatattaccattacagaatggtaatatggatgaaataatatatttgtcaaaatattttatatgatatcatcatgtagtagatgatgaacaaatttaatattttgttgctaaattcttctctttagcttccataacagaaataatcagagctcaaacgtgtggttcctttattgtcaactatagcaagtaggattcaccaagccatcccttttccctccacgcttcagggacagttcctcttctaagttatccctgtctttgtgagggttaacatatggaaacttacgcaatattctaattttgatttcatttaaatccaaaattagcacagtttcccccaacttgtgtttttcttcttttttaaatcattctacttttaaatgcagagggttttttttatatttataaaaagtacgatcttaagataaaaaaaaatactctttggacaaagcagtcttcaaagaccctacctactatcatctagaaatgtacaaggaacatcctaaggattagggcaggacatatgtgacagtttacgtgtaacctaaaggattatccattcaggatttacagttttgtctcttggcatctctccataggcaactgttttgtgtctagctgggtattatacactgatctattcaataacaggagccacgtgttattcatatctttggccccaacatctggcagcattggcatattatggatatttatgttcttagagaatgaatgaaatccaatgtagatatttgtaactgtggggaaatagctaaatacaggggtcagacatagccattctactgctagttaaatctgggaggtagaaaaaaaaaatgtagctattcaaaagcagagactggaatgtgcaataaaaataatcccagctgtcaaaaacatacatggaagaaatgacaggaagaggaaccactggcaaaaaggagatttaaaaataatttgactgaaaactaagtcccctctgccactgtccagccagcttgtcagtttaatttgctattggagaaaaggaagggacaagagtcaaaacaggtgtttggttttctttttttctgtttttaatggggcggggcgggggaatcaagtgaaagcatggctttaccagctgtgaagagctgctgacacctgtggttgccacatctcatgactgtgagataggtcagaggcagctcgagacagctgataaaatgaggtgaggtaggggaagaaaccagaggaaaagtagtgctggataaaaacagaaaggaaagagagaacaaatggtgcccataaaatgtccaatttcaaaatgtctatttttatctttatttttctaattagtacaaagtcatactctctctttttcctccttctgttcactaaagaaaatgtgacaaaaatggataaaaatgaaatctctgccttatgtgcagtatacaactcttcatacctgccagtctcaactaaagcattgcaatattctctcctgggtatttatattcctctccctccccccaacccctttctccactctcccaccccctccaggactgtagaaagaaaaaaaaatattcctgaatgcagaattgtgtgctactcaagggaaacttgactttggctacaaatctgagggggcacattgtataagcgtaggaagatgtgagcatttgtttgctggtagaagcctggaatatgactgggtggatggaagtgacttctttaagcacaagacgtcatcattcccatagttagatatttaaagataattacaatacacaggacaattcatgacaacacgtgacctagccttcactgttatcttcaacctgagatcccttgttataaagaggttctataaatagaattttagtgcaattaacaatgggaaattgaaaggtgatgccataagaataactgactcagattaaggaataaagtaacaagagaaaaatttagtacatattaaaaactaaatattcctttcaagttcttgtttttttctcaattatctaatatagtaccctctgcatgattttggtcatgtcaatgaagatcaatttgagcactgtgggggctgatgaacattctgagactctacccagaaagagggcttagggagaacataagaattcaaaggatattagtgggctcagcatgtctaagaagttcattaccagcaagtgcctgaataagatgcagttggtattagaataattcagaaaatcagtgggtgagctaatatcttggggaaagggaaggttaggatttgaaaggacaatctctcaatgttatataatagcattcacatagaaatactgatgtacagatcaaacactcttagatattacaagggaaacttggagggttcaaagatttttaaggttaaaccacctaatggaaatatttccaacatttagtgaggtcagtcacaagtaatcgccatagatcaagcaagataccaaagggatgccaggaattaatgagccacaatatttgccctcaaaaagctgacatttttgggaacaaaaaggcactcaaacagattattagaatgcagcatgttcacttcaagtaacagaagtaatagtgtgaaaaggaaacatcggtgaatgacactaagttcagcttctgattcagtggttaaagaaggcttctagaacaggtgatgtctaagcataatcttaaacaatgagtcggagtagctgcctagaagaacactacacaaaggcacaaaggcaaacgaataaaatagcctaaagtgtgcagggatctatcaaatcctaagtgatgacagagcattaagtgatgaagtacatggaagctttgaaggtggagatggagagtgggcgtttgcaaggctgtgaagagtcttacgttttgttaaagagccaggagttacaccgaagacaaagggaagttagctttgtatggattcctctggtacaatgtggaaggcgtattttccaaaactgtggacaggtagaacaattataataagtatatgaaattattgatatattatattagtatgttagaataaatataacacaaggtgaagacagtatttgagattccaaggcttaaatttcaagtttatacacaatatctaatgatctttgtcaacagtctgcttttataatgactatattagtgtcaaagcacgccccagaccaacagacaaaatggactcccccatggctaactaaagggctcaaggttaaagcaaaaccaggcagccatagctgggtgaggcagggttaacacactctgtgttctcagaaagatattataaaagtgtcacaggacctcccttgctacggtcgagccaaatcagtttctgttattggtgccaaagtgaattgtggctggatcttccctatccccactaccagccatttgaaagaaacatctgacggagactttggtttggggcttggacatcatccaatcaagtcctgactattttgagcaatgagaacagaaaaagtttgaattttttatatgcataaatggacctggttaagaacctgggcaagaacttcccctgtttaagccagaccctcttttttttcttcaaagagcacacgttcacttgtactaaagactgtgcgtccccaatctgcatatattttttccagaaaataaagttctccttttgcctccacagatctcattgatattttgttaacattagtaatgtgtgtgtgtatatatatatatacacacacacacacatatatacatacatatatatatatatacacacacacatatatatatatttttttttttgtagagcaagatactagttgtaggggctagaaaaaactttccctttagcttctgaaggtttgctgaaaaaccaactggaaaaaaaaacagattaataggagatatggcatataacatttattttaatatgaatagcatgatggaataacaggagaatgattatttaatgtatagaagcttataaacccttcaggggagggaggagatggggaatatagacaattctttttaggggtaataaattataataagggagcatgaatggaccccagagacaaaaattaacttgtaaataattctctttggaatttgaatgagccccagaggcagcattattttgtgggaaaaaatccatccagatgtggttacattcctcactcttctgttctgtgatagataatgacatttcagggagggaaaacaatgacatttgtgttcttccttgcatgtctgctttctaggtagataagggaacctcggagaacagtctcatccagtgctctgggagagaccaagggttctgggagagatcagagagaacttgaggctgcttctaacttcaaacatattagggggtaaaatattctggttttcttcatagccatcttgccacttttcagtttgtataattcttttattacaaacatacacacaattaaaatctaaatataattatgacagtaaataagcataagcactataatttgtaatataaatcaactgtaaataaataaacctctattattaacaaataattactaatattggaaagtattaattgaatattatgctctgatgcttatgagcacttctagaatggaaataccaattttgatgtagttaaaaaactttattctggttagctagctgactgtcatgttcgtgaacaaagtttttcaaacattcgctaccctgacatttgacatttagtacttaattaaaaaaaaaaaagttgaaaacctaagcaatatgaattttgcatgcagtatgattaataggtaggtgtttacctaagaaatcatttaagaaagtgtgtgggaagaatacaagtcccaagagatgctctgtgaaaaataaaaaaaaaaaaaaaaaaaaaaaaaggaggttgggggagaactagttaattaatctagaaattgtagaatttcaaaagattcataatgcatattagcatttaaaaagctctggggaaggttaaagaaaaaaaaagctgttcaactttttttgtatgcagatttccaaaattctttatcatataagttctcacgttttaaagttatacttattaacattattagctagtgttgtttattgagtgcttattctttgcctaggatattgcagtacaaacattatcttgattaataatcttattatttagaaattatcatactcttctcatttgagaaattctcagcttacataaggaactgcctgaagtcacataagtggtaagtgatattgaatctaggactgttgaattcaacagctgtatttttagacattaagtgataacatgtacaaggaatttctgtttttaactcacttgaaaaatgctttcttagatacttaatgtaaaatttcccagtcattttattattatttttactactaatttcactttacaattcaggtttttgaatggtttgctaagttatattagtcaaccaatattcatgtacatagcataacatgtaaaagttatttaaatatgcacaaaacctttaaaaatgaatttccataaaataacaatattatattcatataccaagattttgttaaataacacattcaaataattatttccagcctagaaaggcaatattaacatatattatcattaaaccaatgtggacattgagtttttaaaggtggttcttcatttaactaatatctcctcattaaaccagaaatacctactatttatttatccacaaacaaagatggtcttcaatgtaacaataattatcaaatcttagttgaggataaatatgacaattaagaggtccctgaaatatgccacaagaaagtattctttcataaagtaatgcaccaaggttcaggcatttggttgtcattgaaattgtattacagagttttttctaaggatcaattattttgggtaactcaagtaaataagactgtgttcaatataatactacagctaacaccttatttcttccaattattactgatattcagaaaaaaatcttttgacagtcacactaatgagttaaactagaaaatacaatttttaaaaatatgtaatttaatatgttaagaaaaagtgtccctgaatttgtcatataagcatatttcttagaagaaacatactgaatgaaaggccttattgctggtgtgatgtttttataagcataaatgaaattggttattcagctttgtctttttaaaaaagtttaaagtattagcgtggcacttcttctaaaaaaaaaacagatgtatacaattttgtggtcacaaaaatgcatctttcattgttctttaggcctgagtatccataactatgctattcaactaaaattattgtggagactaacagtgaatctttaagttatgtacaactttcctctttaggtttttaccgtaaataaaatgaccattattattcttcaaggccaggcaccatggctaagacctataatcccagcactttgggaggccaaggcaggaggattgcttcagcccaggaagttgaggctgtactgagctgtgttttcactactgaactccagcatgggtagcaaagtgagaccgtgtctcaaaataaataaataaaaataaataaatacataaattaggtattttgctagttgttgggaaaagctgaggcagggcttgcatgtctgccataatgtaaaagagtcttggaacatgttctgggtccagggtctaaaacccctcatggcctggttttgggtctggccaccccaacactagtagctcttaagtccatgaccaaaataatctcaaagtatatcagaataaaaacaggccactaaagatacctaatcagtcctaaacatgaacgcaaatctaggctaacattttgtctgatccaaagagaaatgagaagagcaaaaatagtgtagtgacttctattttaagttaattttttcaatataagaaattatccttcattctgagatcatgtcagtctcacatttttgcatttaaacaccctttttaacttaatttttttttgttgttcagtcactgataggtttgaatcccaatttagagaagcaataacctaaactgaccaaaggagaacaggagattaaatacaaaataattgatgaaatgtgttaaaaaaatataagtgtaagaggaacctgacatttttatacctatcatcctttacaaggaatttctaatgtaatcattaaaaaagccacataagatacagagtgtgtccctatttcacagacagagaagctaaggattagtgacgttaactcttttaaggtggtacaattgtgagtgggagaaccaggtttcaaactgaggcatgtgtgcctttggaatccacactctagctcctacactcatctgcctcacaacattaaaaggaccagacaaccacccaagagtcataaagatgggaaatagactggaaagtttttaaagtttctggaatttcccctaaacttgcatgattaaggtaaccaggccaaactgaaggtgtttgacccttaaatgctgagatcttgctttcacgtatgggaaaaacacaaacttggaagactaaaagatgcacagcaacttatgaaaacctacattccaaaaactgaggtgtttaggttcactctaaaaacccctgcactgctcttatctcagagggaagttacagggtttaccagacgtaatgagcagtcactacttgccccagacagtttggcctttctagagatttcagtgtcgaatccagttaattacaatttctggatcattttgtattatacctgaattataaacagagttattcatctgaatttatttagcttctttggcaacctttgagcatgattttatacatttgaatttattgcatttggttttagatatttataagaatgactataacccttcacagtcattttaatttttactgtataatttgataaaatatatgtattggagtgaatgtggtaggtaatgtaatgtgcatacatatacaaataatatacaaataatacacacatatatatacacatatatgtgtgtgtgtgtgtgtgtgtgtgtgtgtgtaaaccaaagggagcttaaaggaatatataacatgagtagataagtaactagaataaaggcagactgtgtcagttgacaaaaaacaagatgaatgttacagaatgtcaaaagagggagaaattttggcagtttaagagtaggcgctagattcaatatcatatgcttctttgcagtaggtgtcttatattacttttgacatatttgacattatttctttacaaaattaggcctctattataaagtaaacttcttaagagcaaagaacaagtattctaaccttagaacttggcaaaatacctggtaatttattgcacccgcagatatttgttgagtgaatggataaaaaaataaaaaattgagtgtttgtacaaaactcaaatgaacctttaaatgatcaaacatgattgcccaggatatcccagagctatcagtccaactggcattatactgcagaatcagagcttttcttaagacagatgtagttggtctttcttgtaaatctgttacaatccaattatttttttttttcagaaaactggttttcttttaattagtcacagtttaagaaaaaaaaaactttctgaaactactttggaaagttgttttatacatcagcacaaaaataacagtttcagttaaactgaattaaaggagaaggattctttaaaaataattttaagattggtctcaataagtttaagtggctattcttgaagatgatataccatacatacaaaattatttaaagaacttacattttctaatttccaaaattatactcatctagagaaatttaccaccaggattattagaatataagctccatgagggcagatatttatatatttatttcaatcttgatttccaagagtctaggattttatctggctcattgaaggcactgaaaaaatattttttaaatgagtgaacaggttgatgaatgaattagaggtatagggattacagaattacatacggtcaatatcgatggttcatatttgtttatatattctacaagagaaagactaaggaattttaaaaattatgaatgaatatttattgaaagactactatgagccagatattttcctaaggactagaaatacagcagtgagcaaaataaataatgcccttgcctttaataaactcatagcctattgagtggagaaagaaacaaagcaaacattgcttttcaggtatttttaacttggactaaagatcttttaagaactaccagtgcctaggattcccctatccctactgtacctagagattcttactgaatttgtcgaaaaatatatacaaaaacagggtcttggaacataaatattatgtacgttttatgacatctcaggtgattctaatgtgtataatttttaataacttctcaggtaattctgccgggacaccagggtaaaaaacatccaaactgaacaaacagacataaaattatgaaatataatgtcatgtaataagtgccacaaagcaaaatgaagcaagcctagggaaaagaaactggcagcggctgaaagaaagaagtgcatattctaggggcaagcattccagcagcagccacaaggccagtatggctgcagtgagctcagggcaggaggggaggagaaggaggacttttttcagttgcacagtcaggggccactgcaaggattctgtgctttcattgcagtgtgataggaggacattggggaaatgttggcatagggcaacatgatctagcaccggtttcaaatacatccctcaggctgctcttcagagaatatgctatggaagagcaggagtgaaagcagcaagacctaccaagaaatgtggaggaacatgagggctttggggggatggtcacattggaaatcaagacatatgattcgatatgtattttggtgttaagagaatatgtcttcatgggctggacatgatgtaaggaacaaggggagaagtcaaggatgattctaggattattaggcttaagcaatggagtgaatggcggccctgtgctcataaataggagttacatgcttatgtatttttatctaactgaagagacagaagatagatcttactgacttaaaatagtatggtaaaatagtctattcagagttctgtttctcattcacatgtatatatagtgttaatcatatggacacagcatacaagcatatttgcataatcactgcacaattataaaatgctctgaagtctaaagagtcttttcttggtttacactagaaaatagtgacagaaaaaaacagaagacaatgctgtattataatgcagctgtaccatatgcctggtttcatcagtatgaacctgaagattctttaagagtaataaaagctatgaagaactaaagaatgaaagtaccactaaagacaggaatgaacccttgatcagatcaatgaattgatttcaaccaagtagaaactttgagatagtaaaggcatttcaaaattggctttgtcttaattttaaagttgccacttctctttttataaaagctgaataatggttgagcttcattactgtgcctaatttgccatacaatatcacatttcttcattttgttcaatgcatcactgtaaatttcaaactatgcattttaacctaaaatcattcccagtgtcattaacagtttgtttcatcatctgtacttcctttttaaaggcattcttcacttaaatactcaatataaataaaaccttatgactattaatttgcatttatggagcgcttatgtggctaactatgagccaagggtttcacatattctagttatagtgaaaaacctaatgctgcaaagcagattttaaaattcctgtttttcagatgaggaaactgagggcctacgtaaattaaaaggtgggtgggttacttctaaaattacttctgagtataagatttaaacactgcatactttattattattccctttggcttctggcaatgaagcatcatcgattttgagaaagatagttccagtatagatcacctaaaaatatttgatatatgggttagcgagcaggaaattaagggtaacaaaatcctcagaggccaatattacaagaatgcctgaaccacgagaggtaaatcctgaacacttgcttatctggagcacactagtttgaatcctcaagccaatcttgaaggcaacagacaagatctgggacccaggaaaggggaaagatccaaagacttatcttccataacgtcaggattctaaaaagtagcacctttggtaaggaaatcaggaaaaattattttccctgaaaaaggagtagtgggaatgcttgctaggttgggtcttgtgaagagaccaaacaaaaattgtcaagactagataaaacaaaacacagatcagccttatgctatttacaagaaaaaaaacctgaaatacaagaacgaacactggaagttaaaagtcaaacaacagaaaaagatatgtcaggcaaattctaaacaaaatccatctgatatagaaataacaaggtaaattaccaggtaacataccaaaacagacgactacaacaaccaccaccaccaaagtagagataagcactagatattcatataagattcaattctgcagaaaagatataaaatgcttaattttggagggatttttatacagcttcaatatatttaaatgatgtagctattatactagcatacaaatatataattatagtggaagatgtcaacacaacacttttggtaattgttagattaagcagatttaaagaaaaaagtcaagaaagcaggacataaacaaaataggctattaatgagattaactcaatggtcataattgagctgtgttactgatagttggaaataacacattttttccaagaaccactgaaacatttacaaaaacctaacacatactaaaagtcctgacaaatttcataatgaccacattctgactacgaatccatttgaaatcaaaaataaaatattacattttgaaaacctcatttgcttggaaatttaataacatacatctaaataccatgtgggactaaaaagaaatcacaacagttaagagaaaaaagaactgaacactattgacaattagatatactaccctatcaaagtttgaagaatttatatatttaacttaggaaaaattataatcatattatatcataacagagactgaatattcacgcactaagtatccaaatttataagttaaaatgatgaaagaataaatgcaaaggatgtaaaatgagtacttttgaaaagcagaaattaatgcatttgaaattcaggtataacagaggatcataacataccaaacctcaagaaaattaatattagcaaatagctggcaaagttaataaatcggagataagtcataaaaaccatattgtgaatgaaaaaagaaacataattagagatgtgatagaaattaaaagaaaagtaaaatgatattttgaaaaactttataacaacatattttaggacctaggcaaaatgctcaatgtcagaaaaatttactcaaaaaacttactcaaaaagtggaaggagaacattgaaaatttctatgtaactattaaataaataattattaaaacatcatgctttaaaaaacaacatgtctggttttgacaggcaaattctataagtcacttggcgaattgataatccaaagttaaaactttttcaaagcgtagaaacaagaggctgggcacggtggctcacgcctgtaatcccagcactttgggaggccgaggcgggcggatcatgaggtcaggagattgagaccatcctggctaacatggtgaaatcccgtctctactaaaaatacaaaaaattagctgggcgtggtggcaggcgcctgtagtcccagctacttgggaggctgaggcaggagaatggcgtgaacccgggaggcggagcttgcagtgagccgagatggcgccactgcactccagcctgggtgacagagggagaccccatctcagaaaaataaaaataaaaaagaatagaaataagagaaagactctgtactgattttttgggggaattgtaagttggatatcaaaaccagaccaggaagctgacaatagaaaattataaacaattttcatatatatatatatatatatatatatatatatatatatatacacgaatatcctaaagcaaacaatccagaagtttataaagagaataataccatttaaacacattgtttctatttagtgatatggtactttagtaatggattaaataagaagtatataatcatctcaatgaatgcagaaaatacatccaataaaatttatatctatttataaaaagcatagtaaaccaataaacagatagatataatacacatctacacacatatatataattcatatatataaacacacacatatatatataatacatgtatatataaattatagattaaggacataaactaaaaggctacaatagatattgtcaatagtaaaagctaaatgtattttcttctgaacatgacccggtatttgctaccaacgcttattttaaaagtttacaagaattttagctagtataatctgacaagaaaaataaattagagatctatagacttgtaagtatccaagttgccactattcacagacgatatgattgtctacatgtaggcaccaaaagaatctacaaattcataattaaattcaataattgtttggcaaggttgctgtatataaaatcctataattttcctgtaatttttaaaaggtgacaaggactcatatagcaaaagaaacaaccaaagtagtaagaataaaatatcacatgtccttctccattcattaaatattatttcatttctacaaatcactgcatttcagtgaattgaaatgccatgaaataatataaagacttgatgaagtatgaataaaatctgcatgtatccaactcatctcattaaacagtatttcctttcctcaattcactgtactccggtgttctcctcattgtcatttttgtggcagaagttattaaagaaagcagacataactcctaactactttcctgtctttgcccttgaagaagtgattgtgttattgttgtggcagtggtgattgtggtggtatcgtaccccgagcacagccctccacagttctctgattcaaattaagcccaaatcctttacacaaataaaattaccttatttttaattgctcaagtatctgtaaccacttagctaagtgtttacagtttctccccacacctatttgctggatgaatcctaaaagctgatttatcaggggaattttaaaaaggcttagtgctttaaaattcagatgcaaattctcccacatagaaagcccaaccagcctgtttttgtgtaaatgagagttgtgctgctaaatcccccttaatgagattagaaaatatcttgtaaattaaagcaatggatttttaaagttaatataattcttccatactagattacaatccatgtttaaaacattttagtaaaaaaaaaacttaacaaataacacaagaacaataattactgaaataacaaattaaagagttgagctatgtaaaggctttcatatacactggggatcaatgaacattaaagtgaaagagaaaaccgtttaatgaactaacaaaataacatggtaggagtataagggactagtaaatgtcattatattttattatattctcctatcaaattatgctatgctctcctgccttgacacactgtactgtttaaacaaaagaataatcacagttatagacagaggcatagtgaactatttgatagcttacaactggagtgtatatcttttaccatcattatattaagaataacctttagaagcattatataagctatcatatttccaaagaaaatcaccatttataacttagctctaatataaaatttactaattttctttaactcaaggcaacacccttgttcaaacttagattagaatgtttgatttccacagtgatttctcacacatagccagctggctacctgatttatcactgattaacataccagaaattatttgagaaaaattctatgtattaaggtttttccaccaaataatttatttatttctccatctaaaattaaaattgaaaagtctataatatatatgttttcatggtttttttttcttagtttgagcaagagatgttttgagcatcctagggtttataaggcacctatataagacaggatcattaacagcatttattgttgtttactcaattttaaagaaaattcttcatattaaattatatgatgagctataaaataaaataaatcaaataaaaatccttgataaatggtgtcacaaaagcaccacaaccttttagaccataaactacatgccctagaaaaattacatatccactagtttattttcattttattaggcaatgcaaacaaaatgcttttctgctaagctcttaatgagaaaatttccaaatgattttcctcaggttgttatgaacttcacataaagatacaaaaagccttttccagaatgtttccacagccacgtaatacttaatcaaggttatcactgcagtcagctttgtatttactgtcaaaggaaagattcagtcattattgtgaaacgtgagaatgcttcaagctccctaaacctgacgattacaaatctttaaaacctctttatgcagaacttgacagctataagcttacctctttaaaaagacaatatacattgaggtactagaatggtaaattcagatttctgagcataatatgcacattagcataatataattggttctgccttttgggtagccaatcagattgtgcaaatgtacctattcatagacctcctgaaatgattttccacttgggagttatagtgaaacaattcaatttcaattttctacaaatgaattatagtccaaaaaccaaagaagtctattaaacttttaaggaatacttttcagtctagactccaaaacatatagatatagctaagtttttacgtcttatatagtataacgtttacattgactccatcaaaaaaagccagaagctgctcaaattcaatctattcacaacatttaaaaaataatatttccgagaaaaggcctacatagacactgagtgagttttattctgaagccaaatgaccttatataacattcctaccatattagagcataggtgtttccaaaatacctgttggccatgcaaaacttgtttataaaaatgggcaattttaagtacttcagtactaatctcttatagtctaaaagtatttattaattaataaaataattcattgattcaataactatctaaggaacaacttccgtgttttcaggcacatagtgcctggaaatcaagggttaccaaaatactctttaaactgagcttaaaatcaatcctagcccaggcagtagcatcaacatagaaaaagttactgaagaagttaaacaagcacatgatggaatagggaaaataaagcagagttttaatttctgtggtctacctgaaagcatctgttgaattcagattttcatttagcagtatttaaatatattgctgatgagagacagagtaatttttgtctgtctttatactttctgccaaaaactacgttgcagttctggagaaagcagccttacttttaagaaatgacataattggccgggagcggtggctcacgcctgtaatcccagcactttgggaggccgaggcgggcggatcacgaggtcaggagatcgagatcatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaatgacataattaaagcagatggctcattggatcaaataaagtattatccctgctctacctgtgaagtggttctcatctcaactgatttactgttaaaaatggaaagatagggaagaaatggaaatacaaaatttagactgggtgactttagcagtcattttctagttcgattaaatggattattaatggcaaatcaaaaactaaaacccttgtctctacttccaagctacctttttttttttttctccaaaggagttggagtctcccacacctcacaaaagagttaaactagctgacgtcaaagttgaatatattgaaattaaaatataattcttaaaattagactttgtgaactgatccttttgctgttgcacggttcacaatgacattctttaaaacaacaacaacaaaaaaaaccctcattccttctaattccttatctccaatatagtcttcaagccacagtgatttggcttcttctgaccctctctctctcctgaaatagccctggaaatggccaccaactgcataactacaaaactgctaagtgcaatgattttggacccatcttactttcattgacttggtttatgctgtttacaaactcctccctgaaaccctcttttccttttttttcaataacttggtgaattccatacattatttctaccctctccatcaatccttaacttgcatagctagcctggctttttatcctagcctctcaaatgtcctcactccaaagataatagtcttaagactcatgttttttttgttttgttttgttttttggttttttttgagacggagtcttgctctgtcgcccaggctggagtgcagtggcgcgatctgggctcactgcaagctccacctgccagattcatgccattctcccgcctcaacgtccagagcaggtgggactacaggtgccggtcaccacgcctggccaatgttttgcattttttagtagagacagggtttcactgtgttagccaggatggtctcgatctcctgacctcgtgatccacccgcttcggcctcccaaagtgctggaattacaggcttgagccaccgcacccggcccaagactcatgttttatgttctcatttcatgttcttttcatgggttaaagtactaccggcctgaatgtttggtctccctcacttgccaatctgtttttagcacattttgagaaaggtttcatctaattggtaaaagaatgagatttttcttacttacaaaggatttagccttcactggtttcatatgatagatctattagctcactagattccatgtaaaatacaagtttctctcaaaaaaacaaaaaaacaaaaaacagaaaacctgcaaataagagtgtttctggttgataggataaatgagaaccaggtataaataataattaaaaaataatatataaaaaatattaaatctgccagaacgacataatttgcaactttttattagtctttcaaattttggctttataggaaataaatttgtttttaatgttaaagctatataaataatcattagtctggcttcagctgccacaaatatgctgagaacttgtgaatgtatatctccagctcttatctttctgctgagcattaaatctgactatctctaaatccttgctactcaaagggtgatccctggacagatagcatggccatatcccaagggtgcctgtcataattgcagaaactcaggtcaacctcatatttagtgtacaaaaatgtgcatgtgaagaggatccccaggtgatctgtatgcacattaagctttgagaaacactgtactagatttttccacctggattttccatcaacacctgtacttacaataccctacctcccgcagattcaacattttagcactggtcctgtctccaacctattcttatctcgtgaaatttctatcctaaaaattgacttcccaaatccgcccagttagcctaaccaattatcttgaagtcttcctcattttacacttccagtcactgaatcttattgaatcaatggcttaaatagtcctcagcctgtttcttcctcttcttactccagcatagcagtaatccatgcctcatcatctttcatagtggccattacaacagctttcaagtggactctgtgtcatccttgctttaatctttcacctctatacgtaccttatttttcaaaagtatgaattatacttatactctactgatgaaaggctttcacacaaaacatctatttttagataggcatacatagaacacacataaaagtatgttactaacataccaggaggtctgctatatgagtgtaattaatgtatgcaattattatttctctctgcctacagaataaagataaaacaaccctctatcttctcacccctacctacctctgctcacttcacccacaaattgtagttgcctcagcacatcacactgagttcaaagcactaagtgatttcatgtcactgtccttgtacacactgatacctttacctagtataacttcccacatccttttaaatctggaatatgtctacttaaccttcaagattctgctgaaatattctgcctttgtcaactattctgaccttcttcaaataaactttaccactttgtttcatattcccaccatatcctacacatatttttattatagcaatttgagaactgcaagagtttcaatgtttatttcccttattagaccaagagctcttcgaaggtaagaaccatgtcttatatccctaactcagggcttgatgctcaatatactgtttagtgaatgaacgacacaaaatacgcaaaagaattgagcacttgtaaaaatgaaaatttaagaatgatagtgcgaatatatctaaaacgctaaaggaaaaagcataatgggtcaaatgactggttaaacaagataccagatcaaccaattatttagattaatatataaagattgattcttagagtacaaaaatataatttgaaaatatggagactaaactagtgcaaagaagaagggaacaaaataacaaaggcatttattcagaggtagaagaaggctggacatggtggcttgcgcttgtaatcctgcactttgtgaggctaaggtgggaggatcacttgagcccaggagttcaagatcagcctgggcaacatagtgagacctgcatctctaaaaaatataaaaatggaaatagaagaaagaaaagggaagaaacaaagacaacctcagtattgtttttataatgatcaaggtataagaaaaagcaagcaaggggcttgtctagtcagcagctgaaatagctatgtgaactgtccactctggatcattaagtatgacactcatagaatggatcattaacgatctatccagtattgtgtgcctgtaacggagtcattttgacgtgtttattgacaagtaatgctgtctcctacagaatgtaagcatatttcattgaaaatcatggacttttaaacagaaaacaatgtgctgaattgaagaattattcgaacttttacattgtgctccaaaagttatatgcgacaaaatgaaaaaagaaaacaaagcatttgaatgtcatagagtaattctaagggtaaattatatttcaagagttcttcgacaacctgcagaaaatcatgtttatgtataatctgattaagggaataaaaatctctaaaaaagaaatgtcagaaagccaacatataataatactattcagtttttatgccccatctaatttgggaattgaggtaggtttatgaattaaaattatgtgaataaaatataaatactgaaaaatgtaaacatgctctaaaaattgttactaatttctttctttctcacaagaattgaagtgttaagaaatgtttaaaaggagtgaaatatgaaaaaaaaaatcttacagctttgcaaacaggtagtaaaaaatataaagccagccctcatgtagttgcagaatatgtcaaaccaatgttctctggtgctcacttgacacaagtgacaatgtagaatgtaaaattatcacatgtaaggtcacagctagggatactttttttttttttctttttgagatggagtcttgctctgtcacccaagctgcagtgccgtggtgcaatcttggctcactacaacctctgcctcccaggatccctccagggtttaaatgattctcgtgcctcagcctctggagtagctgggattacaggtgcccaccaccatgcccggctaataactacagatactactgaagtactattaactgggtgaagcttaagaaatattgacagtagtctatgggtaggcatatttaaaatcaaataccatacatgggtacctggtatgtaagagcctcattagaagaaacacaattttatcacttaaaattataataatatatgtgtgattatttttattcataaagtaatcctatcaactgtataagtaagacaaagcaagcaggcctttctgaaatgtagtcatcacattgatcaacactaaaaagaacttcatttcaaagcagaaagataaaaaaaagtacactacatataattgaacttacatgagaacattagataaagcaaatgtagttacagtcattgaaattttcaagtcattaggattaatgccggatacccttggaaaagatgacagaaatatttgattgtttacaaggatcatacaaaaatattggctgagaattctacacactttcttaggaaaaaagaaattgaacttacacatggaaaaaaaaacaactgaaggaaagatgctcttcacgtagcattcttaaaacaatcatgttttgtgcatagtttcttaaaattaagtcgtaagagtttatcttacatgttgtgtttcctttgttgcttccatggggcaactggagttagactgtcctggaaggctttcacattaactaacaggacaccctgttcattgagaagaaaaagagagaaaaatatagcagcctgcagctggtttgaaattggacctttcctgaatcttatgcagccgcagaagaggtggcttacatcagcttgctggagagatgggaaggctcaccataagagacactacttggattaaagcagtgattttagaattgtttcatgaaattcagtttctgtggaactacttcaagagcactggagatagggaggaagtggatgtaagatggatctgaggaggccaagcaggcaggactcctctatatccagccccactttactcaggtgccattccacttttacttattttggatattaaaattttgctggacattttgtttgaaaattaagcacatttcctatcttaaacatcatcatcgtaattatcttcttaaaattgacccctttcaattgacaagccagggagagaaaaaatacatgcttgctattattagcttcacagttactgagtagcaaaataggagatacttaaatctgagagcatcacaaagcattaccgaattttatagatgggaagaggttgaaaaatatctcatgtgaaatccttttatttactggtgagaatactgaacactgaggtccagagagattctagtacttgcatggggttacatgagttataggcccagatgtacacagaggggaaccaggaaatggcagaaagggtctgaagggaggaaggtttgagcctaaaataaggggcattctgtggaatgaactgactcatgatgtgatacattctgtaccactgggaatattcaagaagaggaaggggtgctttatttgtggaatatccaagatgtgccaaatactttacatgcattttgaaaaaataatctccacagcctagtgaggcaaatattattttctccagatttaatgacaaaaacagactagaattgaggaagtcgcttacccaaactcacagagctaaaaattagaagagctagaaaataaactcaggttggtctgactcaaaaacacttgtttgtctacattaacaataatcattctgcatatggaagatgacttacttctcatgtgtttataagtgattcaagcattgtaaggtagctgggtatgatcactctaaaacctgtaacacctagattctgtgagggataatttgggatggcccatcataagcatcctaaataactgacgtgcaaatggagaagacaggaagtttcggaacagaggggcaggaaccaagaagaacgtagtgcacagaataatgggcagagtaggaaggtaataggaacacctgaggattttaaaattacacttgagctgtccctgcttataatctaatcttgcaatggtatacagaaagctagagttaaaggacttcacgcaaattcttcagcttttcttactcttctcagtattaattagtcatttttagactataatgttctaaaatgggatatcaggacccaagttaatagttgagtttcatcagtttccttcagtttattcacactcaaaataaagaagccatttcacacacataaaatctttttacagaatgttatttgcacagttcttacattcatacatatatatattctcctttttaaaaaatcatcttgcttctctaacatacatcttcatcaaatacattttagcatatagcagcagagactgagaaacctgaccatattgattagaatcttggtgaggtcacttcctaggtgagtagactccagcaatttagttaaatactttgagacccagtttcctcatttaaaaaatgggaataatgatagagcctatcttataggcttattacaaagattaaaggattcactctttcaaagtacttggaacagagcctagcacagaataattgccatataagtgttagctattattactatttatgaagcaattcttaaaaattgtatcagtttctagaaattaaaaaaactgtacaaagtttcagtaattaaattgttactcacagaatcaaaattttctactagaaaagtccaaatataatagcaagaacacttctaaaagcacaaaattaaactttaggctttgccactattataaattaatacatttacttaagcaactataaaatcttttaatatatgtataggatatgcctggcatgataaaaggaacagcagtattttggtaatcatatgttttattgaagaacctttgggctattttaatattcaaatcggctgaatatttagcagtaataatgtaagattaatatttgtacaggcacttgctcctttaacagcagacattacagtcaagctattaccctgcaataatggaaagattttttaaagcactgtcaaaaaggaggcttttatacaggttagaattttattccaatactatgtatttccataaacgatgctgtttcttaaagtatgaaacattaatcattggctttcacactatttcactttcaagtaaattcatgcacattttaaacatattaacatatgcaaccatcttatgatagactgtttaattttaagcacttaattaatttaaagaaatacaccaaactttagtgacatcaatgtatgagacatctaactgggtttatgaacaaaacagcttttaaggacctgcatgtttagactgttatttttttccatggtgtatattgcctagtaaaagcatggatctacatgatttcctttgtatttatgaatttcattttataatattaatacaacactccaggcaatgcatttcagggggattatttcatgtccctgaagtggataaagccactcggactcaaactgtaaaacaccccctacggtgtgctatcattacccagaaacattggcctgccatgggttattgcttaatattaatatttctactttatataagaaaaccaacaaaattctgtcctctttttaaagaattcatatctcagttactgcaggtatttcaggaaggtgaaacaggatctgactgttttcttgtattcttatttgttagtacagcagccatgtagcacaatcaacttgagttaaatgtgtagaattttttttggttgctttttatataaaattatcttcagaatcctcttatttgtaaatatttggccagttacaatacatagtggtcctcgccaaaaccacacaggtgtgttacttccctgtagtactgttttatttctttagcccttggaaaacaccagaaggggttccattgtgcatgcaggtgtgatcacccactgtggaatataaattgtatatctttttagatgagcaggaaagggaagggaagaatgttgagtatttacttctttgcttgctactaattaatttggtgtctaactcggggaaaatcacaagctttacatgccttggtttctctcttctgataaaggtattccatttattttacatccacaggaccttattttgtgataatatagtaaacagaatgccaaatagataaagcaggtaaaaaaatatcttttgtccataagaaattgaaatattagtggacaattgctgccacttccctgactcaaaaggctcattaataggtcacaaaaggcctttgcattctctgaaccttattgcagagtgaacagtaagaaatcagagtaggtgatgatagtttacgaatgattttcacaacatgaccataatacaggagttattaagaaattatttttagtcagcttgaaagggtaaaagttattggtggaattttcctttaataaaacgcagccccaaaccattttttcgctaacaggaagcagcctgatagatatgcaaactaggagcttttatatgtaaatgccagcagctgtacctggaagccaggtacattcaatatggcagttctcactctcttccttgtcaccacgtttatggtgtcatggcagcctccagggaaaaccacatgtacaggcattatggccacgcctggtagaggccacatttgcataataaaagactagggtgggagggccagtcttttctcggctatataaatggcatacctggtcaaacccatcccctaggacctatgtaaatcaatcactgcctcctcaaacctctgtaggaaatcgattgcattctgccgcaaaccggagaccctctctcgggctaccagctttctctgcatgcggaagccttttctctgtcttctttttgtctattaaactttctgctcctaaacccactcttcctgtgtgtccgtgtcctgaattctttctcaactatgacaaagaaccagggcatatacctgagacaatggagccgtttcaaccggattgggattacatcctccattatttcactgacttaagtatcacttccctttgtttaaacataaagacagagggctcagaaagcttgaatgtttgtttaaattcaaacagctactaaacatggcattcagactcaaaagcttaagttttagactttgtgtctagagttatttctacagaatatgacatagaagtgagtatgaatgtataatcacacatggttaagtggagaggcagggatctcagtggtacctttgggtgaagcatactcagaaagaaaatgtttaaatggcataaagccttccataaaaatgaaaatccctatcatgaattgatgatgtctatgcagcagatcttgtgcttggcagcttattatttcattaaatctgcacaaaaactcaatgagtttaggtctttttacagccccaattttacatatgagtaaatagaagctcagaagttaaaatgctctggaaaagctcacatggctcttgagaaggtagaattaagatcatttcatatttcccctttcagttaggagagttcttcccatatctcactcgttgtattgtaatagtttcacaaatcacagatagagacatttagaaataactttgaacataaataattgcattatagttgaaatgtgtacaggcacgtgattcaaaatttgtttactcagataccagaactatttgattctttcaaataccatgcctacaattcacagtttttagaattacactgtgatttagcataagtacatttcagtgaatactgaggcaatgcctttggaagagaattgtttacagcaatctattttcctagactgattgcctagatatttcatatagcttatttatttatatagatgtgaatttagctttgaaatataaaaccccatggggctttacatgtgtgtaaagccctcctaggctatagtaggaaaaaatgtgcacactacaaaggtacaattaaaagccatattggctgggcacgttggctcacacccataatcccagcactttgggaggctgaggcgggcagatcacctaaggtcaggagttcgagaccagccaggccaacatggtgaaaccctgtctctactaaaaatacaaaaattagctgggcatggtggtgcgcgcctgtaatcccagctactagggagactgaggcagaagaatctcttgaacctgggaggcggaggttgcagtgagccgagattgcgctattgtactccagcctgggagacagagcgagactccatctcaaaaaaaaaaaaaaaagcaatattaaattacacaaatggaaaattaaagatgtatattcatttgaaaaacatctattatatattaagaagtttttactgatctttaactttacatatatatatgaattacatatagaaaaaaaggacactgtaaataggccaaaataactgcaaataatcaatatggttaatttctttttgtttttgcaacaaggtgagatataaatatatatatcagtgtaaaatgtgtggcacaaggtagagaaaaacagtaaaataagagcttttaaaaatggatgatgtaaatcctatattttttagtagcctagaaaatcataagtatcttagacacttgtcagatctatttgatggaacaaagttaataattgtacttgggatgttgctcttacctatgagaacatcctatgacttctacatttatcactgttgtaaataaatttgtatctggattttcaccttaaatattttcttcttcctttgatttttaagtataaaatttaggaaacagtgagactgactctgtactatagatttcaaagagatgttggaatagatatttagtagaaaaattaaaaataaagcttaagaccatgttacaaaagataattgctacatcgcctactaatatattgagtgcctactatattcctggtactgctaacaattcatagtcatctcatttaatctttacaacattatgaagtcaatattattgttattcctacttcacaaatgaagaaatctggcacttaagccacataattaataactgatagagccaggaaataaacgtgggcaattagaaattagagacagagttctttttatccatcattaaccaattgtgctgtagaaattctttgggaagcactctgcctttccaagttaaactataactgccttcgttgtcattttttgtcatgctttccttcatcattaacatgtagagagcaaataacagaattaaataattttatattcagaattaagccataaactatttcatgaatatctgtttacaagttttgacttaatctggatcattgcaaacatctgaatctatttccattaggtgtgacaaatatttcatttttatttaatattatgcaacatgtaaaaatgtaatgcaactctaatagtagaagtacttccaggatatactattagccaggtcgcttatttttatttgcaccatgaaccacctgtaattaacagagcaccattcttggtgtttatgaccatcactcaaagttgctgccacctgctggtggtattctttacactcataaaagagctaaagtttctgttgctaagcatattttctagcattaatgattcttaaccattttctaaatactatggtctcatatatcaggacttagtaaaagtgtcacataatttggaagtgatgtagcaaggcttaaaaggtttaaagcctaaatctaaccaaagatgttagccactacgttatagtggcttcctccttagaaaaatctttaaataagtctgttatatccatgcttttgaatgttctgcagttgcacatacgattaggtcattttacatgcattggtaaggataaatatctacaatgtagtatttaaaacccagtggcaagacatatgcctaaatatgattatatttgttaaaacaagttaaagtttaacatgtttaagctgagattggggctggatatattctcataagaagttcatatttcttccaccatgccatgatgtttcaataaaaagtagttttcaaggtcaaggaagttactcagtaagaaaggttacttagctgagatacttactgtgttctgtcagtgagtatgcaagctcaagcatattattttttaaatctcttctgcataataactccatttgcaaatgatttctgttctaaaaacatcagcgtacaaagataaaagagatcatttctgtcttcaaaaagcttataatcttttaaaataatcacttcattagttcacagtgatggtagttgaagctaagcacacaaagacctttgtgttccaagaaacaacattagaaagagatagaaaagatgttaatatggatgctccatgaatcaccatattttaataaaataaatgaattccagtgcaacactgagtacaaggtactgagtataagacactgataggttcttaaggtatcaccattcaggtaatcaaagagctcactactgagcaaaggagaaccctcacatctaacaatgatatgagtcagattgtgataaattatctaatatgaatataaacaaaataaaatgtgagtacatgaaaaagaaaatttcgcagaaggaaagaatgagggcagtagaagctgacttggattttgaagaattactaggatctctttaggtagccaggtaggaaatggccattttaaacctacagaacagaatgagtcaaggcatggaggtagaagagattgtgaaaagttcagagaaacagcagattatgcaatgtaattatagttcaacgtgtattaagagggcaatataataaaataatgtctatttgatgctgaaggaatgtgaatattgtgctaaggacattagcttcttcctgtaagcactgggaagccattgaaatttctgatcaggtacatgatgtgggcatataagtgtttcaaaattaccaggtaagcacaataaggaatagattcgtaggtgtggagatgccactaaagaagtccagagaaaagaccctgctagtaacaatagacaagtaagcaggagaacatgtatttcagtagtctcttggtaaagtaataaaatgaataattacatttcttcaggtttctaatattccagcattacccattttgcatttaacagtaagaaccctccaagtgttggagagaaaaaaacaacaaaattatttgtatttcccgataccaactcaatattgggatcaagaagatgttggagtttttactatgcagaatccctgatgaacataaaggataaaagagaaaccttcaggaacttgataagaggaatgaatatgaggtcaaataataaatactcaaggactagtttcttgtattaagtgcaaataccaatagcatgccaagaatgtggcgagaagggctgcagaaatctggaatttttcatgatcagaggggtctaaagatttattcagtttaacttacactgataatcattgaccattttggcaatctatttgagaagtgtttctgatgatatagaaagctggatgtaggcacttaactcaaaaacgtattttctatatattctgaagtgaaggaaaagtgtagtataaaatgtacacagctgtgataaaaaatacgtgtctaatgtgaggctgagaataaacaatatactgacatatacaaaaccttcaataattatccttcctgaaaaattaaatacttataccacatatcattacatttagccatgtgttatgtacatgattctctagtatgtattacaattctcaagccccaaatatatttggagtttcttgatggcaaagctttgtcatagtcttcccccgaatcccgcatcgtaacttaaaggtgctagagaacaatacaagccagataaacaattgttacattagaggaaagaaaattctgtgttgaatctgcaatagaaatagacaagagcatcacagtagcttggagtcacatagaatgaaccattctacagtattattccctatgaggactgcattcacagagcacagaagccagcacttaagcacctcttaaataaaaacaccttcttgaatgaattggcaacaatagaccttgagtataaaatggaaatggaatagatgctgattattacgaagttgtcagcctgctaaccctcggcagttaaattggcaagcacagtaagagcactgaccaaaaaaaaaaaaaaaaaaaaaaaaaaaaaaaaaatcagagaataagtccatcaactgggaaccttactgaaagaaaaggaattgggtttgtgtgtgtatgtgtatgcaggaaagaagtaagacctaatgactatttcaaggttcttgaaatgaaatatgtgactaaggatgtgcagattatgataaacataaaagaaaacaacaattgaagttgtaaaaaatagcactttaaatttggttaaaaattaaatccaattcaaatattgtcttgcaaccatttccaggacatcaattttataatcttcaacattcctctgtccaccaaaaactatgagttaaggtagacccaatcagaagcactctatccctctccagacatcaacctaataacctgttttctgtttaggttcatccatatgtcattgtaagtaaccaatgtcaatagttcttaattggaattgtaacaaaagacaaatttgtttgagaatatcaatttccctatagacaaagtaccactaattcaatctaaaagttaaattaagcataaaacatttaaaaatatgctatatgtatgccaatttagggttggccatcaattctttgtatacctgttatttgtaataaattgattcccagtcctattgtcctaatcatttgtcctttgtttccctcttccatttcttcaggtcctcttccaatagattttacagggatttacaaatttcctttacaggggtttaatgctcggttaatatatagctttggtattttggtgtctttattataaatattcaggattttacacttttaaaaatattattcctaattcattccttctcttttcttctgtaggctttttttttttttttgtctcctaaagttgcacgttccattaaagtgggagttttctgtcttgaattgtttgtgtactcaaggacttaggactaaacagtgggttaacaactgcacccccacaaagagacagggtaagtcacctatgtggtagtactttcaagagaacagtcaaatatggttttgtgaccctccgtacctcaaatcccacttgtgggtataaaatgatttttgttgaaatgatttatgttatgttaaaatgatttatgttgaaaagactagatggatatatatatacacacacatatatatatatatacccatgacatgaggtagagatgcaccccataggcttacaagtatttcttaaatatatatgtaatatttaaaatatacattatatatattttatatatattatatattttataaaatataattttatatatttacatataaatatatatttgagtttcaaatatatattacatgtttatatataatatatatttgagagtctcaaatatatattatatataaatatataatacatatttgagactctcaaatatataatatacatttgattaaatacagaaatatatatatatatctatttgagaaatacttgcaagcctatggggtgaatctccacctcaagacaaataaaagaaccttcaacattaacaacatgtggggtccttcagccagagaaagaaagaagagagatggtatctattttcttcttcaaacagcaggtggaggcaaggtggtcatgttggaattttcctgcacttccttcggttgtcagagcaaggggtcttaagtgtttcacttggaccactgatgggccataatggatagaaagccagcctgggatgactcagaggcactgcaccttacaaaactaccggttgggtcatggagaacccacagaaactataggatgagggaaagtcagaagaatttagccagagagtgcatttcctgcatacaaggaaacacaactgattactcttcaagcagaattgtacaacaaaaacaatcaagaaagtattagttttgaacatctgccaagcacagagagcaccaatgtcagatcacgatagcacaaataaaagaatactctttgctttttatctcccttcaacctaccctcttccccatcaactctggaaagttcagaaaccacataagcactagacaaggaaatagagaaacgcaagtcacttgccaatcctcaccatgcctcacacagactacaagtttgaaagagcccaaagctaggggaatgtaatttggaattttgtatattacacatgcctagatgtagtaggacacattagccgtgaacatatagatgatttctgactaaatattaccaggatgcttttattaccttagaccatttagaaaatgtaaaggatctaaactagctataacccaatatttctgctccctgttgcagttttaaacagatatggggctagagatggggctaaaactgttttgtgctacactctacagagttgcatgttttcaaagtatgcttagtgatatacacattaatctgcatgcattgcatttgtctttattgctagggggtgggagtggcatagcataccaggccacatacccttaaaagcaaatatctgctgtacagtccacaaattacctgtatagcccatgaattacctaacctggcctagtccatgaagcctcctcctccaaagtccccaagtaggcccagctttcctgagttcacacctgaactgtctttaaggttttcttcttctcacggaattagtaatctctacattttctctacttgcctttttcctcttctagatttctaatacttttgtaaatcatttcctttatcaagtcttttctgtttgaaataaccagcattgcctttgttttcccacctgggtcctgactgatatactcacccactctgcagtacataccatataagaatatattaatataaatataaatatttgaagatacagttgaggtaaatgcttatgtataacattttcttatacctatatattattcacaaataattttaaaatgactttagaatgaatatcaaaaatttaactccacttaaaaaagtaaaatcacattggattaaaagtaaaagaacactgcattctctaaaatgaactgtatattccataatgaaaagctagcataactgtgttgacattgctcagaatcatattgtcatatgtctgaaatcacatgctatttgaagattttgagttttccatcatgatcgaaattggtctgaatgactttggactaaaggtgtcacatattgaattcgcggggaaaagcacttgtaacagtactgtggaattcaccctattctgtaacccattttgtattagtacatgcaaggacaatacaatactcctggatattttggttggacttccaggactgctatttaacaatatccaacagaaaaacatgtcagaataaatgctttttatttctcaatgatacagaaaacataaaatggaaataaaaaaattaaaaaggcaatattcaaaacactatcttaaaacaatgttttaaacaagtaaaagcctttatcatcatgtgttgtaaagacccccccataccaatctgtatgcagatgctgtttctatcattgaagcctcaaaaatatttaattcttggagtttcagttaatatttataaagtgctgaacacagtgcttgacatataataactactcaaaatataatgtttaatatcattaagacttgattactggtaagtaatttgataaagttgagaaattcctaccaaagaaaaagcctcaatattctgtaagttcaatgataaatgcaataaaacaaagttagcacaaaggtctaagttaaaaaaaaaaaaaaagaagagaaaatgaaaaactaatatcctcagacaataaagaagaaactatttttttctgggatattggcctttgcacaattctattattattatttgaataaatagaaaatttgaatgccatgtgaatggcaaattggcacacactatctttgcaactatatcctaaatgcagagtttcatatatatccagattttattcaagcagcttataatgctaagcacaattagattggactgaatcattaaaagtatcgcactgacaaaccaaaaatagagtatcataaaatcatactttcattcagtgaaaaaacataaactctgatatgataaattgtcctataagcaaatgcctaacattcccttgggaagtgttcaccttactttggtgctaaggattaatcataaataaagaatagcattgtttggtggcaaaggaaaattatcagatgtatttttcttttactactttgataaatggcttatgaatagagttaatacttacttacctctgggttttcttatttcccaccagaaagaatagaggaaattcagcattacttcataataatacatatccgaggtcatgcttgtggtacttaagaacagggatcagaaacagattttgtagaattatagggctttttccctctgacataaaagatggtgctcaagaactaacttaatttttatgtctccataatccttcatactcacaaggaattcctagccctatcttgtctatataattttgacctcacccacataacatagctgcattagaattttgcaagattaaaatctctgattcttttcataattggagcaagaaagctactcgaagtttcttcagtgtttgaaagtaaaatattctaatgagaattggaaagtgcatactaggaccataaagtattatgagacaatctttagcattatatcaaatcatcaattggaaactagaaacaaacaagttagataggtcagcatctgattctcatgcactttttagggcatccaaatatccatagatatggttgggctctgtgtccccacccaaacttcatcttgtagcttccatcattcccatgtgttgtgggaaagaccaaatggaagatgattgaaatatgggggtgggtgtttcctgtgctgttctcctgatagtgaatgggtctcatgagatctgacagttttaaaaatgagagtttccctgcacaagctctctttttgcctggtgccatccatataagatgtgacttgctcctccttgccttctgccatgattgtgagacctcctcagccatgtggaactgtaaattcaataaacttctttcttttgtaaattgcccagtcttgggtatgtcttttcagcagtgtgaaaacaaactaatacatccacatttcatgtttctttattggtaacaatatatcaaattcaatatgaaaaatgaaagatcctgaagagactaccataggaaaaattagaaaaaaatatgtagtttcatatggagttatctacagaaatttcgaaagaatatcttaaaatgacatgagtccaggtggattttgtaaaactgttaggaaatacagttttgtcagatgttgtgaattcctttgctaaatgaatgaaatctgttcaaatctgaaaaaagacccttgagtagaaagaaagtaattaatggaaaatataatcatctaacagggcaatagagagagaaaaattcaaaatatcccaaaaaaggaagactaatgaggaaaaactgtatttctgtttgtaaaacaagtcattcaacctcaaagttcatttgtacatagtcttagtcctaacaaatatgaatgtcctataatagagcaaaaatgcaaaaaaaggtaaagtttgagagagagtaaatattgaaaccttagaaaaggggatttgacacttataggatgaaatgataaaaattaaatatttttgaaggagcatgaagaaaaacaaagccaagtaaagaaagaacacattgagaataatagatgtttataattttaaaatattttttgaggaaaagtatacaaagaaaaataaaattggctccagagagatgagacctctattcaattcaaagacatttagtttagggcactgcaacccttcaaaatgataaataaattatagcttcatgattatagccagataaatgacctgaagcaacagatctatgttagaatacataaaagcaggtacaagattcaacttggcagcaaatgaaataatctttagttatttaaatctttagttattttgaccattaaagacaaacaaatctaaggacactaaaaagtaaacctatttccaatggtaatgaaaggtacttttacagaattttcactgagttctagatatagtttgttttactacaacagaataaaaatagctcaaatatgcaagatataagacaaagaaaacactaattcaaagtacgtaaatttgtcagaagaaacttaatgtataaaaaattaacacagataagatgatcaaaaggtctacaacaagaaacaaataaaaatattgcaagcaaacatattagaatgctatttcacaggctgttggggaagtaatctgtgtgacctataaacatccatcttcttccaacgtccttaattttcaaatacgcagaatggtaaacagattaaaagaaaagattaaccaccctttccatacttagtatcaaaaaacctttagattcttacattgagcattcttgtcttcctggcttcttcccaagttcatttaaaagattagttttgctgttttgttttgttttttttttgtgccagcaatctgttcttagccttttaaatatctgctcatccatttcagtaagcatttcaagcatacaaggaaaagatgagatttaatattaataagtgatccaaagttaaatccctagaaaaccatttcaatatttatttctgagagtctcctgtcatgcagcatgtaagaaaatgaaaaagcagagcagaaatagagttaaaatccaaagaaacgtcattcaattttaatgagtaactatgctagacgatcctatttcctaaaattgtacttaatacagggtatttaaataatataagctaatttttaaaatatgcaaattttaatataaaaattaatgtaagcttaatatgcatcagatactagtaaacatgattttcataaattataagtaatccactaaaatttttaaaagatttagaatcttttataataatatatgattcaaaaatagatttcagagttttttttgaaaggttgagtttgatcagtatgtattttcaattcacaagaaatactcctattataagtaatcactctactcttacgcactgaagccatgaaaaatccagaaattcaatttttaaacttaagaaattatagttattaacaaagattactagtactagtaacatcctaataagcatttggtttattaattaacactcaagacttttaatttttactacacattggtagacattaagtctttcctcaagcagatgaaatattctgtatagaagcatatagcaccaagtatacaaatattcttcacttgcacagaaagaaagtaaaaactgctcatccaggcagacaaggccttccagaatctagctttatgtaaaacaggagccagccaaaatggaccaactactcttttgactcatttctgcttttcctctctgggcactttcatctatctccaatagcctttctatttcacaacttccacttttacctctaattgtgcaaaatctagccatcctatgcatccccgaagactctacccaaactcaaattttcttttttgcagcttttccttattatcctctactagaagtgataacgacagcacttaattcccatggaactctttcttcgttaaactaacattaccttacagaatgttagaattggaagcaactttagagtttgtttcaatcacaactcctttttaatttttgtacctcagaaagctgaagtctctactaaataaattgcttaacagtacatcattagaaacaaatcgtatcccttcttgcttgccccttttctatcttgttctttaaacaggtttgcaagtggtttataacccctttaaatgtgtaagcgccttcaagtttcataaattcttaatacatatttacccagcattttttccccaaaagggaaccactaaataattgataaatcgggtggaatagtgagggtgaggtgagtgggtggggacaggaacaagccttacatctactagcaaatagaaactaaaaatttctctagggatctaataaggaataatactacttttaaaatgctcttctagtcttctcaacctgtggtgattaatcctatatcatcttcaaagaaaagaaacacacattaaggatcttagttcttttctgcctttaacatatttttgacacattctgaataattaagtcaattaactggacatttttttttgttctgaaacaaaaaaggatatcctagagatattctcctattacaatccttataccactggcccaaaatcatatggactgattttctattctaatgaaggatccagataagtaatcagaaatatacaaaaagttatgcatagttgtattaaggaaatatatagtataatgaaataggaaatttgggtgtccactttagagtggctaccaaaatttctctgaggaagtgacatttaaacagaaactagaagggctgagtcaagaggatagcttgaggccaggagttcaagacaccagcctaggcaacacagcaagacgtctctaaagaaataaaaataaataataataatgcaaaaaattagccaggtgtagtgacatacgcctgtggtcccagctcttcaggaggctgaggcaggagtattcattgagcctaggagtccaagctttcagtgagctattcactactgcattctagcctgggcaaaagagtgagtccctgtctctaaaaatacttaataaataagcataaaactgaagataaaaatgaagcaccttagaaagaatctgaggatgtttatccaaggcagagaaaatagtaagtacaaagagatatttcaatgaccacaagtggtagcatggcttattgatcagaaactgaattttcccatggcttaaaatgaaacaaattaagcatataaaattgtagcaccaaaagttgtttgcacaaatttttatttggatacacagctctatagcacagagaatttagcctcaagctcattcctctgtgtttcccattgtcattgtacacattgtcaacgcatataaccttaagccaggaagcaagctgaacagaaacatgtcaatctttcctactaaaaggtgagcgttttgtgaataagcaccattttttactcatctttgtatcccaatttttggcatactgtagggcattaataaaagctaaattgttggtgttattatttcgctctataaatcaggctaaacagcaaaatgctggaaactttcaaagcagctattttgaatggctaaggtaatgcatatcaggctctgggtaatgtgaagtaaagtacctgtatttttgtgctgctacatctggtgcagattttgctatgacatcttttgttgatttgtagttgaagtatttcacattgtggtgtagaaaaatggctgcttatatgggattttaaaaagtcaatgatgttacaatgtttgattctgttaaagtccactgcttttctagataaagaaatctttatattgtaaaaaaggtcaaaaagtttaagaaaatcataatttaaaaattaattacatatagtatataaagttaaatttaatgatgattaatgttaaaaatatgttgggaaagtgaattaaaatctttaacaaataaatatttgtaaacaatagttatatgctcactgttattgaaaggcatttatataatgcagttaaataataaatttcatttaaatgtatttttaaatcacaaattgggaacagcaattataaaattgtgtaacctgcacaattttaaacgaagatttgaataattatttttagtgtgactatgcaaatttcactgaaagtacattgctgggcctattagccgacttattaaaataccttaaagaattgctttattctctaaagtgtttgtctacttcaattctaactaatatgcaaaaggtaatcattattttttattcctatccatggttgacccttctatatattttacttgtgtgatgacagcagttgtttattattggatgtggtagccagccttcaaaatagttctcaatagtctttgacttctggcattcacaaccttgtatagttccccatctcactgaataaacttgactgtgtttataataggatattaaggaaatgactacatgtgacttctgaggttaggccataaagacattgaggctcctatcttgctctactggattgcttactctgggagaagctaatgtcatgaggatacactagcaattgtataaagaagcccacttagagtagaacagaagttttcttaatagtgccaatttgcctgccaaataggtaagccatcttggaatcatattccccagtccaatcaagccttcagatttgaacctaagtaattctttttttcctattcccccaataagctaaacttcgaccccactaaactttccaccatctttaaaatcctacatgcacttaccacattttgcctttgcttgttatgttcccgatgcattgtaagcccagcccttctctaaatggctgatgtttatccatttatatgtaaatttcagagacatataattagtgtgtaatgcacaccaagattatgctgaaaggtcacaatttttgataaggtaccttacatttgttcattactaaaatacatattacaatcaagattaccatcatgagatgacgacttgataatggtaatctagtacctgaatctggatttctccaatataaatatatttgttttaagcatacattgtgaagcaaaaagaagaaacacttcttttggcacgatcatcgtgatggcatgaaccctggaatgaatccagctcacttatggtttggagcagaataaaatattgtcagtgactatatctacaaaattgttgtcatttctattatgcgatattattttgttgcatcgaaaaaaatttcttatttcctgggaccagtttgaaaactacaatggacagtgacatccttgaaagtgtgaaaagtttatttgccaagaaaaacttagcttggaagggaagggttggtaaatttgtccacagacggagcacctgtgaggattggcagcatagttttgctgctttggtgaagaaaggagctccccacaagactgtgactcactattttctaagctgtcatataatggcaataaagacactgccagtaatcctgagagaatttttgtctactgtcccgaaagttgtcaactttatcagagccagggtcttgaatcactgcctttttaagaagtatgccaagagaatagaaagagaatatgaagtttgtttgtcctatgtagaagtttgtcaactttccagagcactagttccaaagatcttgattgaactttcagtaaaaaagttcaagagatagaaaactcatcctcaaaacaagctgacagagtttcctggtggcttgactaacttggtgggtatttctctatttcagatagaaccctgtgacactgttcttgagaatgatgataaactaagaactattttatccaagttgctattaataattggggagagaaattagcaggtggacaactatatgaactttcaaatgctatagaaagtgcttcgtcagggttgatagtgacaaagccttgtcaaattattccagaaaaatgcctttgggccctggaatccaacagaactcttgattattgcttttgctgatttggctttaaaattgaacacaggctgcataattctgatattgacatagaaaacactagtgaagcagtcctggccaaatctgactgcaaaaattgctcacatgaatttaaatgaagaatcttggagaattctggtgttttagaaaatagttaacctctcatggacagagctgacaaaagaagccctaattccacttcgtattattgtcaagatttgcatatttccaatcaaaaacaggacaacttcaattgatgtcacaggtgatgtatacataaccacatttcacaaaaatgcacaaatttaaattcatattcaagcaggtgtcttatcaaataaattaattttgaacaaagtcaaagtttcacttactttaatttgtacaaatttgattcttgctctttttacttgttttttgaattgagctattaacttttgcataaaaatagtgaaacattttataaaagtttaactcagcatatgaataaaatgcatgctaatttattacatagactttatgaacaatttttcatttctgtttatatttgcatttgtccagtgcagggacctcccttgattccattagattctcaatggatttggtgactgtactaattaagaaccaggcatctcacctcttaggaaagcttgctttgattttccaagcctgagtcaacactgcttcactttgcattcctactactctctgtttctattactatattaatgcttatcaagttttattacagttttcttttttcatgtcactagattatcatattattcaggacaggaatcatatattcaaatttgtagtcaggacacatattaattagtacagtgtcatgcaaacagtaggtgctcacaaaagtttcaggaatgaataaatgcaaataaacatacccttttctttgttttgatttttttttaggagcctgtgtttgtagggctcccagcaatgtggaaagacattgtcatcttattcattgcttagtaaaagaaaactggtaactgggtaaggtaaaagatatatcaacaaattatatgtaataatttaggatttttttttttcacctaacaacaagtaatctgtcacctttaaattacaaaaatatactttatacaatatttccatgagaatcttagcctatatataggaaaaatcataattatactcttgccagttaaattaagaatctatatagcataaagatgcttttgaaaatgaccttttatttttttcacatcacgttagtcatgcttggctctagatacaattcacttgatccattctttaaaattaattgcaaggaaccatagtaaggtaattaacattaaactcaaaggccacatatcctcagccaaattatatctataattagctaacttatacagataaattaaagaaaaatgagaaatgcttaattatttagacactgaacttgttttccacccctttttgccctttagagacttacctaatagtacactagtttcatgttttgaatttgcaacagaatatcaattgcagaagattaagtatctcaaaaacgaacacttttttgtattttaattttaagattaaaaaaaaaaactcacacatatcagaacctcaactagatgtttgttgaacttaatactccaaatattcagaatgaagccgtctcttgtgacagaaagcattgttcaagcaattagaagagaataaagccataaggtgagacgataggatctaaacctgctagacttaattagctctggggaataattttaaaataataggtacattagctagagaaaattacagcaaaatatctcctgcataaaaatagagcatgtggcaaaaataaaattctaaaggaaatgtcttttccaccctagtgaaaagtaaatcatcagagctttttcaccttaaaccagaaatccttcagcatgcagggacgccccttaggaagttctctgttgctgagcaaatgactgctgcatttgactctgtgcatttttacatctatagctgtatcttagcattttccatctgtctttgtcttctatctctctttcctttgactttttagaactattttctgagccttcagtgttagactgtagattctttggaactgattattattctacttccctatctcaagtctataagctacagtgcatagtttcaaaaaactaacatttgaaataaattttattttaaaatattgcaccaaacacattcaatttatatctacaaatactatggtactctggttagcaatagatatgtatttaattgttttgatgacagacttattttgtaaaatcagtcttctaatctttgccatctcaggatagtgtccaccaaaagcacatggtatctcattacaaatttgctgttgacttaatccagtatctgactttccatttatcttatctatacaattaaaataccacattttttatacataaaatttttcttccaaatattcatatatccacatatatatggatattggggagaaataaatatatctatttctttctctgcattagtagtctgtgattctaatataacctttgagaagttatgatttataattttagaagaaggcagaaactgctaattatcctgggggatcaaagggatgatatttcatgtgcaagcgcattcaatttatggagactatagtactcgaataataatattaacacttatagcacgtctcatcttcaaagctttttccaaatattaagtaattagcaagttaacacattcaataggtgacgtagaccacatgtttttccttaaaaaataattcatttataataaagtttttatgtattttttcaatactgatgccaaatactatatatttttatctctactactattatgaatatcttttgaggcttcactaatgtataagaatatttaacaaagtttgaaagtttacattaaagactaagtttacatcatctttgtccttaatgccataggcctgtccttttgaacaaggcatttacagttagttttaataacctgaacctaatttcaataaaattactcccttatattgaacaaagaatcttcttttaatttagtatctatctgcactgtgatttacaatgctgcttaacttgatctagaatttactgtcatttaaatgtgttctttcctttgaccttttggagataaagtgtaattgttttaacttcattaacaagataatgggaaatgaaatatgcctgaacacgcaggtacatagattattccttgattttaacatttagaagcatctgaaagtatttgttgacaaaattttatttggaaaacgagtgctatcctattcacaaatacattaaatgcttatgtcaaaaatataacaatttggaaaaatgaagagcaattcagatgtatttggaaaaatataaaacacagtttggtcaaaatccttttgcaaaataacagtcatactatactgtatgtaatctataatatattatatatattatatatatatataatctgtacaactcatttatttagctctttcaagataaaaagcacaaggaaacaaacaaaaattaggcacctggaaatctggcttctagatactagttcttaaaataattacctgtgttaccttaagtaaactactcaatctctctggtttccactttattattcctaaaattctggtattaattctataatttaatattttgaatgtgtatatttctcttctcaatttcttattattcttgccaaattggtaaatcagttagctctctgagagatctaagtactacatatgatgtggaatttgaatcactcacagttccagaaagtgtaattacgtataagaaattcaataatacttgatgttcttgttttagctaataacttactactcttaagaagttaaccaaaattttctttttatcttggtgtgtctcacccagttcaggagagaggctttgtgaatagagagaccttaattttgtacatcacaaatgaggaatgaaaaatttatttttcattatttattgcatttttttctggcaatacaaggagggttactttgctaatgatcgcatagagaatcaaagagagattcctggctggatttggttaggattataagagaatagctttttcttctaaacttctcagagttagtgctgttagtgtatttccagattctgtaatgagaattgaaattagaataatctatctagtaagtaaagttcttgctgaaattatagtgatttactttagaagctcatcaaagggatatgaatatcaacagattcgcactaagttactattttaagaaacaaatgtctccttatgcccatttataatattattttcactaatctgtcctctaattacatttaaaatgtagtacagtagccagtaattcatttttattgaattagttccttttcattacacacaacagtgttctaagtaataactaatagaacatgaaagttttgttttgaagtctattcatatcatagtttctctgcttgcccactgaagcatccgattaatcactgatatctactaactctgcctctgaactgtttgtgtaattccacatagttatattacacatggatccttccatccccattacttgttggtcatgaggtacagtctttcccaaactttcctgcactgatgcaaagccatttctctgtcctttgtgtccccaaagtacttgatgaatttcagctgttttctctgttttagaagctctttctttcccacaactgctgagagttcttgaaagcggtggcagtgcctcattagttctccaagtgcctggcattattgatggttcacaatgttattattgattgaatggaagaataaatagatggataaaataattaattacacaaattacttacaacagtccaaacttgaggaaggaaactccttgttaaattttttggttacaaaatttggattgtgcattattggagtgcatttaaatccaaacttaatttttttttgcaattatttagttttctataccttagattggcatgtataatagtctgtacaagtccatgtagctggattctcatacatttaaatgctcctatcgtcatagttgcagtttttttaggtcatggtgacaactatggaatagccctatgattcaattaatttatagtttgccagaaaataaaagaaaagagactttctattctcaacttcctacccaccaggtatggctgacagctggcaggacataaggagcatgagacatctttctcagttctacacaactctagacgaggggcccctccagcccctcaacacacactgtattagtctgcttggactgtcataataaaataccatgaattgaatggtttacatatataactttattttctcacagttctggagactggaaattcaagataaatgtgccagcatggttggtgtctggtaaggcctctccttggattgcagatggatgccttcttcctgtgttctcacatggcagagacagaaagctctggtgtctgttttctcttcttataatggcaccagcctatgggattaggacctcatctttatgacctcatttaactttaattacttcctaaaagccctatccgcaaacatagtcacattggggtttggcgcttcaagatatgagctttgagggatcacagttaggtccctggcgcaccctctgattttttcctacatttttttcctgattatttactgacttagttgggaaacatctgaagaacactgacctaacaggacccatattcaagttctgcaaattacagtgcctttgaggctcagggtctgggctttcccttcacatgaaacttcaccatgaccaatatgagatggaactttgcatatgatataactcagtcaagtaagttggaaagaaatgaaataaatattctaaatgtatctaataagttttttttttgtatttgaaatctcaaaggtagagaaaattggcagagtatcaaaagaaagactgacttaataatctctaatattagaactgaaagcatgttcccattagttattatgatatctggcatgttatccagttagcagcaagtcaaagggttctatgaggttgttgatattctgttagaggtttctaagaatttaagtgttctctaaataaacatagcagtacattttgaaaatggtgaagaggaagaaggaaaatttaagccacagttttggctgtgtctagtttgtttcatgtgtacttttcaaataacaattaccagggtaatgccattataccaatattatcttgatgagctaggcatctgctacagctgtctttaaagttttgtgttattaggtaggcaaatgtttcatttatgcaaggtaagctttacactgtactgccattgcctatttatcgctgtgaaaaaaatcaatatgcattttaaattacacatataattgttttgtgttttggtgcctaattcctccccttgaaatatatgaaaagaattaaaatgttcaaattgtttcctttaattcctttcatgcacttttgtgagcggaattaacctccacactgtaaaatgattgtatgtgtaatattaaaaatggaacatctcatttcctctttatttctattgtggggattgtaaacatcagaggtatctaatgaagactttacttttacaacatcacaaaatggaaaatgcgcattggaaatacaactagaaccttgtctttcagattggtccccagatccactgcaacacattgatttctttttgtttccatttttcttgttgcttttctcttactttcaacttctactgaatttaatgtgacaaggtgtcaacaaagcagctgcatagagtacagcatctagttaaaacttgagccttatatattagtgtccttgattttctagttttaagccccaggattaaggattatgtgcatccaacgccacaaagttctgtgtgtaatccaagtccacaatcaatggtctgatcacccctcatgctgcagaccctccttctttttaaaaaatatcttctgtagatacatagaccatttattctttctggggggtgtggggagtgcaaagttcctttgccttgacgtgtcaagttgtgacttgccagatctagacaccctttcaagtgaaatcctatttactcattctgccttatgattaataattgtttgaagtttaaaactgtttgttttttgcactgttgattttaactagctatccaatatacaattataaacacatggataaccctgacaacaagttttgaaatagtaaagagattttaatagtttaatgatcatatttacaagtaacaaaataaaacagtaatttcctctattttggttggtgttgctcttatattaggcataattctcagctttagtctcctgcatattaatattatccatgaatcttcattcaataaacatgatttaataattataaaatcaattacttttaataaatgtatacattatgcatgttaaatcttaaatcatattttcactagtaactattacaaacataaaacaggcagcaaaagtaacatttggaaaacaaaggaaacatccctgcttgatttgtaatccttgtttcacacacagaccaaatgcccctccatgacagtgcctgaagcctttcagtttaacatgatttagatggaaactcaggttttaaagaatccatcttgcagtcctctgacaaagtaattggctggaaaaattataataaaattttcataaagttcatattcatgaagtggcaaaattgcttttaggaaattacgatattaataatttacacccatgtcaatagcatttccaaaataactcaagctttctacctccaagattatgaacctatcttgatttttttccctcacacacagacagttaaatatgctgagatacactgagatctagatacagattattcatttaagaagatagctccttgtttaattagagatttatcatcttaactagccgtactattgctctgaattagtttttcaaggttttcagaattaaagatggtaaaaattgatgaaccttagctgtatttccccccgaagggtacaaacttttattacatttcagatgcaaaacacaattagcctctaacctaaccatgttaatctccttgagttaagcttatgtgtttctgcttgtctagaaatttttaatgaaagatctatgtcttttaaggccaattttaataacctctttatttgcatctctgcccttgtttagaggaagagttaatacgataagctctggattacagaatgctcttttaaaattggggatgaataaaattctgtgacattcaatttgagtagtactcagcaggagacagacaccaacaataaacattactcaagttccaaaagtttccatgtaattaactaagatggatacattagtgtcatccattatgttccattctgtaaactccagacttctggtcattaagcagggctattttgacaagactggatttaaaaaattgatttactttctggataggtagtttttttagaggtagatttttttttccctcagcaacagagcaggtgcaagttaccataacgttttccataacatattctgaaatattcgaactactccaaaactgtattttttgctgagcacaagttttagttgtgtgaatatatcctgtctcaaaatgggaaataaagggagacttgtggatttcctcactcagggctagaatctatgacataactacttcctcatcctcagtgaaatgtttaatacctagagacagaattctagttttatgtcttagaaaagattaacataaaaaagaaaaagataataacctctgttttcaaactgaactatagatgtaaaaactgtcttctctggtccaaattagcaaaaacaaaggagcacagtgacctaattaacatctgactgtattgatggtctaacacaatatcatctgtttcattaccagcagtgtgcaattatctcacccaatatatagggaatgcatcctaaaattacatttaaaaatagatttattttagatatttaatgggatttttttccagaaatgccaatttccaaacacagaatcattacattttctgatacatagtatcattttcatccacttaacagtgagatgcccatagacaaacgttgtgtctaattcaacacccagcacttagcataatatctaacacatgcagataatccatatagattaattgaatgaagaccacgtaaatgattgaataagcagacttttatccaccaaacaacatgtagctggaacaagaaggaagggggaatagcttttaaaaacataattttcaaaaaatattctcacagaaatttcagccccctccaagtaatgtatctaaaaatatttctattgttgatgtagattttcttgcctcatcatgattctttatgacctacagtcaataaaattgtattctatgaagcaaaagtcactccattatgccactggattgtgaacgatgcccacccttttgtgttcctttctcagattattttatgatttttataatgggctccctgcctgcagtctccacctcaccaataatccaaccccagacttcttcccacattgctaccagagatcattttccatcatatggatttatccttgtctttccctaatgacagtttccaaatagccagcactttattgcatcaggaataaagtccatgttacttagcatgtcattcaagatcctttccaaattggcatgggctttatgttcctgaatctaaacaagatccactgtctgtgtgtatggctatacctaagaagtatgaaatttccttcctcctcacctctgtttattttgtctcctcccctttggaagtttttcccagtttctaagcacctttcttcaattggtaagcttccttccaatatcacccattctttgaagccttccagaatcctccaggcagaattaatcactcctcattctaagatgccataatatttactatgtacttttataagggtgcctaccacacacaatattagcaatattccttaggtgctatatcttgtactacatgcatttatatctatctctctttgaagaggaaaaagacttcttgttcatctttaaatgcccatcacctagaatagtgtgaagaagcacgatgagttcaataaacataactagagcatgaaataaagtggttaaaaagaactttgaggacatacatatactgcttggtgaccaaaatgatgaattcccaaaatacatgtgtatcttcctatagtctgagggctctgtgcatggtttagtagcctcttgcttgcatatagctttctaatctaaggaaagtacagactagctggtactccagcatctggggcaggagctaacttgttgactgagctgattgtggtgatctgtgcctgtgaaatatgaagtgggtgtttcccaagatagcttgtcttgcaaaggaaaccagggactgcccacatggcattattaaccaattaagaaatggatagccactttcagaaggagtttttcagcttcagtcttctctgttcagaaggtaacatgttagtacataaattgagtgaatcttcataaatcaatggcactaaaactagtgggaggaaaggaaaagaaggaagttctttctatatgttgcatttttaaagaagcgttgattttagaagtctcgaatagattatgatatagtatttattttgaaaaaaaatctgttcagtcccagtttatttctgaaactgtagcagtaaaaatcattttataagatcaatttatatattttgaaattaaatatttttcctggataatctatcattgcactgagcttgtaaacactgttttacacatgtgttttctaatcctctaaatttccttgcaaggtaagatgaggacttgggttcagataatataattgacttgccttaggtcacacctattaggttggtgaaaaatggtgggttttgccattggaagtaatggcaaaaaccacaattacttgtgtaccaacttatagttatgtacggcgtaatggaaataaaagtgaagtcacacctattaggtcggtgcacaagtaattgcgtttttgccattgtaacggcaaaaacagcaattacttttgcactcacctatagttatgcacagtgtactggaaataacagtgactttagaatgagtcacttattctagctctgccagaatgtgaacctgaatctcacttgttctaaagtcacttttatttccagtacactgtgcatctagggtgtgttttctatgatttgtgaccaggtggacttaaatatgaagattaaaatttttagcaggtcacaaaactatctcacatgccatcctaaaagtagaatccagagagtcatacactatacacatttttaatcatgactattaagccctcaatgctgtaacaagctacaaagccaagattgtagtgcttgatcacaatggctatgtgcttcctctaagacttaatactcagagaacccccctgtaagatgtagtcggccaagtgttagctttaaagtagtttttgacagcttccatcccgtaaaataatgctcagtgatgggatggcttacagtttcaatttcagtttaagaaacaattgaagggatgcattttataaattattctatattagaacaaaaagaaatttgtaaaagttattaaaaaaaggaaaaaaaaaactttcttcttgcatttgttttactcagaatcatactggccagaagaatggggcttttaagtcggatgcagagaagtgatgggtaattaggtctgtgtcatttattttgtagaaaaaaggagcctttatcacaaatcatattgcctttccagtctcccagaaggaacatttttacttcgtctttttctcttcagttattaaaaataagccctccaaatactgaaaccagacacagttacctaaagaaaagaaagcctctaatcctctccccaggcatgtagaggagctgaggatcctttacctctgcagctttgttagtgcaccaataactgaaacaagataaattctgactgaacaagcaatatgttgatagtgtctgtgcaaaagcttctgtggttcagccgctgggatcaaatcagaacacagtggccctgagcaccaacggctttcactatgctggccctattctttcaacagtgtgtccaaatacagtccttgttgtcagtttatgaagcatttagtttaaatttcttcccagaatggactttttatgtttcaaaaggatatgctctacagaaaagcaaaatgtacactgcaaccattaatcatctagaatgagaatcattattattattttacttattgctaccaaccttgatacctgacatttaaattgttctttcagcatggcaaagtgtttttatatttttcatctcatatgattcctacagcaaaccttgagatagaggaagtactttcattttttggtttattttattaaatgaggaaacttaagaaacacagtgtatgtgacttggcctagggtcatgacatttagttgcagtgtctcaattataaattactgttaactccagttctgttttattattattattttcacatctaactgtaattcaaatatcaaatattcctgagtaaaacaaatttcaagtattccaagaaaacaactcttattttgatatgtaagggtgtggatatatataaaggtatactttttcatacacatacatagtaaaagtaaaaatacaaataagtgtaatcatacaaggccataaacaacttttcatttttttactggacatctttattcatatgtatattttgcacactgtattattactttctaaggataaattacaagatgtttaacttcaagtctatctacctgcttttgaatctcccaatttcttcttaaaatttatgtattcttagaaatccttcctctactgccctcataatttactgtcaggtcctaaatggggtaactttgatttgttttgtcacaatatggtagctactgatccatttctccctcacagatttagatgtgaaactgacattgctaactgtctgcccaaatttgaaatagacaaacaaacaaacaaataaaatcaatctgccaaggcttctctgggaacagagcaccttctccacatgtctactaagagctgtgtggaaaagtaggagaaaggacttgaactccagcaatggtaattgggacaagtttgccccactgttctgttaaggttgactgacttcaaacaaaataaaattaagtatgaagtgtacctttagaaaaaagttaaattgaaggttggtcatcatcatattaacatttatatacctaaaaatagcaagggtaagaattcttattttgcattaatcaatgctctaagagcttcatttacattactgcatataatgctcacagcaccactatgagaccctgcttttaattctaattttgcccataagcaaaattaggctaccagaggttattaaatgatgtgttattgggcattaagccaggaagagatatagccaaatacacaaaccaagaaagcctgagaaaagagtccatacatttaaccaacttgcaattaaaaacactaattttaagaattccccttccctttagaaagcaatccaagtacaactatcaatactcagaatatatagaaatatagactcaataataaaagtagttaataacttacaaggcatttactagttgccaggggtttttccaatatgtcatgaattgcatttaaagatatttataccaattatacacataagaagactgaggcatcggaaggttgagttagtttcccatgatctctcagccgataagtggtggagctgggatacaaatccaggcagcgtggcctagatccatggatttaacaaagctacactactcattaacattcacttcaacttacacattttctgagaacatcataattgtgtaaaataaagtctaaatatacagaattagtctcctacttctagaggcctgaaattaagaccacattttaacttttatagtaacaagagaaataataaataatgattaactgttatgaactgatttgtgtccttctgaaaaatgtggaagccgtgaccctcaatgtgactttatttggagatagattccttaaggaggtaattaaggttaaatgaggtcataagcttgggctgtaatccagtgtgcctggtgtccttacacgaagacagagaaacaccaggaatgcacatgcacagagaaaaggccctgtgaggacataatgggaatacagccgtctacaagctaggaagaggcctccggagaaaccaccactgccggcaccttgatcttagaccaccagcctccagaactacgagaaaataaagtcatgctgtttaagacacccagtctgtggcattttgttatggcgctcctatcagacaaagacactgaccgagtcaaaaatttggtaactaaagattgaaagagaaggtctgagaaatgtaaaagccagacagaatgctaatgaaatatttccagagcaggaaagtgtatgttttaggttctcccagtgcccattcattttttttgccataaaatttttgccataagttcctagtatgatccatctgcataaatgtaccttacatttatttcatgttaggtgtattgcatgtggttaaagaggtaaagatctacctttctagttgtagcaacatttggtgacaaaatagcaagtactataaacatggaaaagatcgatttgatttgtaaaccaaattatataccttttaattttaagattccaactcagctcatgaatctttcatgtttggtaatatcctatacattagagatttaaattttgttgtggtgtaacagtgtctgtatatgttcaatttccattacccttaatgagtgttctgctcaaactggtttgtaaaaagttcacagagtgaactgaattttgattttatgtaaaagtgagatgcatctcgtcatacctagagcagcaaacagaagataaaatgcatattctaacagtatacccatttttaactacagaaaaataattgactagatatctactccagttttaggaagtacaaattattcaatttataaaactttgaagataaggtaccataatttacagacaacttatttgatccaaatcttgcttgaactgtagttttacactgagtaactttcctaatctgtgctctagtttgtcaattttgttgtccactctaacaagaaagatagtcagtgatgcataataatatcaggtttgtggatttgaagagatttaacatactgggggaaaaaaaactgctcttaaagtatatcatttatataaacttgtttaactgatttatttttcttaagacataggaataaatagctggtgaccacttctaaatttggctcaaccatgtatacttcctatcattactgaaggttatattcattataaaatatttggtggatgctttccaactggaatgtaccaaaatattattcctttgtatcttatttataggctttggtattcagttgtgaaatgtatattgccaagttctcctttcacaccatactgcaaaggaaaataagctctaaaagggaggagcatctcttttttattagtagcttcacaaaataaaattagaggttcattgattatagtttaaaacactacattactgtaactgttccagactgatctgtaacaatgttgagttgttattcagttattatggacccccaggttgaaggtcacataatctaagcatgcccagatgaaccaagtattcaatcacaggtggaacctaagtgcttgaatcaggaaaacgaactaagaagtggacaccacatggcaggatccaggatccaatctggttgagccctggcattgtcccatgagaggatccagtcagatcatgcctgctggcatcccttcattgcaagatccaatcagatcacacctcattaccatatgcttataaaacctgatctagcccctagctctggatgaccatttcctctgactacctgccagtggactcaataaacctttctcctgcaaaaacccagtgcttcggtgtttggctttctcttgtgcatgtacaaacagatgcagtttgtttaggtaacattatgtggatgggtggatggacagataggagaatgatggaatggataattcatgaattttagcatgtgtgcttctacctcagtgttttaaaaaggtcacataaggcaataaaacttcttgaagtaaatagaatgttatataatcagaactgattttaatataatagagtaccagctatgtaaatactttacctgaattaataactattggtgattttgtcttaccaagaagataaaattgtctctaaatgccagtttggaattattcttgaggaattttctagatgtaaggatatagtagcagctaaatatgtaatcatttaaatttaacaaaacacatgtttatcatgaatattatatcatttaataggaagaaaaaattaaggatatatattaaacaagtaaaatgttggtcaattaacactcggaaaaataattattttccttagagaaatcattgtgttttctggttactctcttgtctaataaactttcagactttaatcaataattaaatatcaacctaaaaggatttctttatagcatatatcttttgtgtcagtttaagtatgtaaacgatggctgggtgtggtggctcatgtgtgtaatcccagcactttgggaggccaaggtggagccactgtttgagctcaagagttcaagaccagcctgggcaacatggagaaaccccgtctctactaaaaatacaaaaaacaaaaacaaacaaacaaacaaataaaaaaactcatagccaggcatggaggcacactcctgtggtcccagctactgtggaggctgaggtgggaggatcacctgagcccagaaggcagaggttgcagtgtaccaggattgggccactgcactccagcttgggtgacacagcaagactctgttaaaaaaaaaagtatgtaaactatttacttattataagtatgaattttgattaagatggtaggtggtttatatcatattgtatatagaggtcataaatctacttttgatacctgtgaaatggatatccactatctctctcttacacacacacatgcacacatagaacacatgcacagtctttttatctctctattcagtattccttcacagtagttcccactgaaataacactctataggccaaggaaattggtatccaattaagatgaattcattttgtatctaaaattgagtcctattgtgttaacactgaaacagctttagaaataaattttgaatattccactaatcatacataaaagaatacctgtggcacactaatgatctagtcttctcagaatggcattatatgcaattcctgtttcttggcagttttgacagtgtaattctctttcttcatggacatccaagtttatagaataatttcaagtatatctatctgttttttgattctatcaaaataaattgtattaacttttcacatgaccaggcatggttcttagtgatgtgatgatttatttataccataatctataacccaggataattaatagtgaacctcatgttacagacatacatttaagacttttttaaaaaattaataccattgaaaataaaaatgtatttaatatttaaaatattatatcactgaattatataaactgaaagctgatcctcagattactgatcttttaaatataatctacaaaggaaagtagattggctgcattaattaaatttgcttcaaggtttctggaggtattcaataacttttttaaattatagcttaatgtttctttcttgcacttgcaaaattgaaatttctctcctaatggctttcttgtacttgttctctcttttcccctaaagagtcgtaggagtagtaggattctaatttaaagtcctgtcaatattagatatcaatagtaatttggtgaaaaaagttttcatgtttaatactataatttcccatgtttcaattttattgcttcatgtagtagaagttttggaaatgataaaaaatagagagctatatttatgaagtaataaaaatgtatagattctaaactcatctttttgataaaaacagtaaaatataaggtttaaaaaattaagttctatgacaacatgacattaaaacccagactaacgccatgtatgtgaacattagtattggcaatccctgactccaccataaagtcaaggaaaatatataacatgtcatataaactcatccaactacattgtggttgtgtttctttgatacttgttatctactaactatattaaacaaaagtctagttgattttatggcatgggagacagcatattaggaaattaagatgtttcaaaaattaagttatattggtttataataaaggtattaagtttatgctatctctacctttagaatgtttttttcattttatgtaaacatgtccatccttgaaacttctaaaagcccatgacctaaagcccaatctctgtttgcatttcttttatgtagtcccataaaagtaagtggaacatagtttttattaacaactagagaacagcacctaaaaattaaacagaagattcaattctcaaagttctcatcagcaacataagaaatgaaaaatagaaccacaggcatatctgaaaaaatccaaatggaactgctagaaaagtgtttattgaaatgagaaaaaaagtcagacatgttgaatattctattagactaagatgaagaaacaatacatgaaatgaaagctaaatcaaaagaaatcatccagtgaacagcaagaaaaaaatggaaaatattaaaaataagttaatgtatattctactaattctaccaatattgccattaatttgaatatatattccagcctataaaatattcaatttaatggcaatattagtagaataacaagtatcccaaattaggtcagtacatatgtacttttctttcaataatcttattttagatgtcaataatctaggaatgtaaatcaatgttcatccaggcaaaaaatttagttgttgttttggcttacctgtcaccatccccattagagtttgctaatatatgcctgctaccagtgatgaacccttataaaatattcttctttatcatccactcaaaaaagaccttagtgccagtgtggaatgtcccctctctcatcccacttttgcactatgtttgataagtctcctatttcttttgagtctaccactgaaatatctttcaaaggggtcttttcctgtttccacaaccacttcctcagttggaaaccctaaccttttttctatgttagcatttcaaacactgtcctcaaaattagtgtcttcttcactctgtagtccttctctcccccagtattcctctgtgtcacaagctttgctttctgaaacaaatgtaaacattgtgctctcctgcttaagaagttttcaatagctcctatagattttagaaaaagtccaaactcctcagttagtcttatttcttgtcagtcacttatgcaaaaagcaaactcttaatatgaatgtgttatatgttttctagcctctcttacttagtattgaaatagactttcctacttccacacatggcacattcctatttctattttacaatccagctctaatatgatctccttagttataaggatccctaatataacagtctgaatttattatatcttttgtaatcctattatattttgctttttgtacattcctcaagtatacctttaaaatactgtgctgtaaggagactacattattcatctccatcaccagatgtttgaatatggtgagtactggagatgtcttaatcatcactgaatttctaatacctagtatagtcacagaaacataggtgattaaataggaaatatttttctcatgccgggggacagctcttaaaatacttatgctaataaaatagtgttcaaaatcaacacaatatgcaatttacaaataaagtttatttgcagacagacctgcatgaaaagtggatctaatatacttttcctatagccatcaattatctgggtgaacagtttcacaaacaaaatcctagagaaataaaagcaattatatttcaatataatctttccctcagaataaaagctgagaaaaaaataatgggtttgatctagcctctgaaggaactggatctgggctctctgtgtaacacaaaggctgagagtcttctggctagcaaaggcatcgatctgagcttgattctcagcactccctgtccttcggtttatagaaagagaactccctttgtgttgctaatagcatgatctgccaatgcggtctcattcaattattgttaaataattggtggggaaatatgcctagattctccatccacatacagataatagtcacaaattaatcaccatcttgtgtcttgtactactttatgaagaaatacatttatgtactttatttataaattttggtttagctgctgtccaatctgttcccttagacacagacttcaagatagagatttgtatataggacatttattggggaatgctcctggcattaaacacctatgtgagggaggaaaaggatgcaggattgagtcaagggagaatgtgagcagtgatacagtccaaagaagaccttaagctaacttcatggggagccatggagtcaggataggccttcatagttattctcatttgggtcaaggtcaccaggcctttatgtgccttctgaggatcgatcaatagatgaagactttcacagatgggtgtctgaccttcagcaaggcagctttgtgggctgacactaagggccatctttcatcagaactcctaggagttagaggagtatgtttcattcctaaaaatgatctaggtaatgcatcaattatagtcactaaattttgatttgcttgtgctctgtgattatttcctctattatctctctatgtatctgtgcaacgatctattttaaagtattaaggggagataaggagatgtttatagctaagaaaacttagcaacactgtaaggactttgtaattataattacaagaaatgcacaatgtgatacataaatttaaaataatatttacatttttaacaaacaacatattgatttcatgttcaatgctacatatatactttcttaaactatgtcaataataatacagtgttcaaataaaccagctcatggtcaaagttttcttttttaaaaatagatagatggactcaagattacttaagctacagcttggaaagagatatccttaagattcattagatggctactgcagtaaatcattttttttccaaaaaaaaataaaaaacaagaagagacataagaaagaaaaatggaaaataatgacatagctgtaggattttatatgatactgagccaaaagaaagacaaaataatatcacagaatgacaaatgatactggatgcaggaatatagaaatacaaaagttttgagattaaaaatggaagcttaaatatatcaggtagcatattaagaaaataaaatctttcatcaattctatgatacgctatttcatattttatcacctctgaaattaggattgaatttagaattaagggtcattaaactggaccctttgttttcctttcatggtgatacataaaacaatatgtcttataatagatgacatcttggatttgatgaaatatgttattagctccaaaactgatagaggaaaaaacagactgaaagggtctgataaacgtatgaatgactatgttgatactcctaatattcgtctgttggtcagttgattataattcaggatatagttttccatataagaattgctacaaaataattgttacaattccacgtgcctcaaatatttatatagtttagttatacttatattaatattattctttatcatcatttttatgtgcgaatatatcacatatatcagttgggaaaggaaaaaatgtgtatctctgtccactgctgttccaggttttatcggcactacaccatttttccctctcggtcatggcactgaaaaaggacttttgctatactcctacttctacgtcattaaaaaagcgttgacttttcgacgtaagtgaaagttatgaatttgacaagtattatttgagaatgatacaataaactcctataatacctattcaaaaactgtgattaagcataattttattaaaattattaatgcctcatgaactttcccaatgtgcttttatttttacttcattctatattttcaaatatgcctctatacagtattgaatttgcaaaacataaattatcactcatattgtagaaccaaagaaaatgatgatttctccattttttggtcttacaatgttttattttaaattcagttatgatttcaaacaagtctttttcctctcttaatgtttctaatataaataggtgggaatcgttttcagcatctggttcacatagtacatattttatctgacatttctaaatgcaattttaaggacataaataaagacaacctttagcttaaaatattgtagcttttattaatcttattcccaactgatatgacacttgaaccatggaataaaataacttagcaattttcctaataaattaattttaaacaattttagatgtttttggaaacattacaatatttcaaaccaccacatagatatagagaagcttagtaaatatttatgtttacaagttattttgtaattaaagttttgaaaatatacagggagcaaatagatggtacagtttttacaatttcttgaaagaaggtggctttttctctgttttatttaaaggcatgcttacccatagtgttacagaaaacaggcaagtcagtctagtgaggtagagtccttttactctaaattctaatttactaaaaacagcttaaaattgtccttcaagcattacacaatgtagatattaagactatatactggaattaaaactactaatatgtaaactggcttctatgtttcaaaacaagaaaaattctgagctctcaggcacaatttaaaaaatatttcagcagtgtcaagctgtgaagcatctacagctcatctgcatatcctaattttcatccaagtttttatggtgctgaccatctggatgaatgaatgctacagatgactacccaggtcctttcaacagaagctaaagttatgcctgctgctatgaaaaagtatattttggtttagccttaggaagtccatttgtcaacatgctggaaagtggaaatgtgcctgggtatgttgaatatagaatttctcctctacatattaacttatgtttcctttagccctgtgaacaagagcatcagttccgttcctgataattggtgaaaaaattacagaactaagatcggagtaagagttcttggattggtttagaacttaacacttctctgggtggttgttgttgatttttgcaaatctcaaactctatgaactccaatgtcttcacatttcatggggataacaatagctaacaagactgttatacaaatcaaaccaaataatataagtaaaacagaagcagaagctgtttataaatatcgataaccttaatatactcttataagcctgatcaagaaaatagagaagcatttgttacaactagatgtagccatatgcaatggactgaatatttgtgtccctcccaaattcatatgttggaatcttaatgtgacagtattagggactttggggaggtgattgtgtcataagggtagagtcctcatgataggaattagtgcctctataaaagagaccctggagagttagcttctttcacgatgtgaagataatagtgcaaatacagccatttacgaacaaggaaacagaccctcgcaagacaccaaatttgcctacaccttgatcttgggcttcccagcctccagaactatgataaatacatttctgttgcttataagctatccaatttatggcattttgtcataacagcttgaacagagtacaacagaaacattcccccccatccccaccccccctgcctcaccaacctcattctcagatctgaattacaccactggtgatgctattctccggctggctgacagtatatcttgatcttccataacaagtgagccaatttctacgataatataatcagtctccatatatatgtgtccgtgtgtgcgtatgtgtgtgtatgtatatgtgtgtacatacatatatacacacatgcgtgcacacgcgcacacacacacatactgtatccatatgctattggctctgtttctctgaagaatcttgactaatacattatataacaaagtttgtcaatgggaggaaagcaaaactggtatttaatgtctacaaaaatgaatacaagaaaatgtgtgcttttttctcatttatcctttttttttttttttttttttggaaaacagagtgtcggtctgttgctaggctgcagtgcagtggcacaatcttggctcactgcaacctccgccccctgggttcaagtgattctcctgcctcagcctcctgaataggtaggtctacaggtgcccgccaccatgcccgtctaatttttgtatttttagtagagaaaaggtttctaccatgttggccaggatgatctggatcttttgactttgtgatccatccgcctcggcctcccaaagtgctgggattacagacatgagccaccgtgcccggccctcatttatctatttttatgttaaaggaacacgaatgtgatgtatgcaaccggagcactcatgttgaacaatgggatgtcatcaatgtgttgaagatggtggaacaagatagaatgagccagtgttttttagaggtggaggggactttctatcacttgcagctagacccaatgttaactgaaccacatcactgaagctccctttttcttgtcataaaacttctaccaaaagaagttataaggaaaataaaatcaaacctttgccatctcagggtaaatctgacttactgaataattactttaaaattgtatttttgctgggtgcagtagttcatgcctgtaatcccagcacttcgggaggctgaagttggggtatggcttgtgcccaagagtttgagaccaggctgggcaacacactgaaactctgtctctacaataaataaataaataaataaataaataaataaataaataggccggtgcagtggcgcatgcctgtagtcccaggtcctagggaggctgaggtgggaggaacatttgatcctgggaggttgaggctgcagtaagccctgaacttgctattgctctccagcaagtgatagagagaggccctgtctcaaataaaaaaaagaaaaaggggatgaaaatttcccaaatcaagcacaaagaattaaaagtgaaattacctgaaaagaacagtcaacaacccctagaaattaggataaagcatcaattgatttgtatttcggtacaattgtagtatagtaaataatttcaaataatcagaacaaagtggaaatatggaacgatgaatgactaccctgctgaaaagatgcatattctttgtgtattaggttggaactaacattgtcttggttcaagaaagtataattctgatattgttgtccattagtcagtcagcctggtttttcatccataatcaactagtagtactaatttattactccctaaattaacctaaagagttatctaagtcaaatagtaaaaaatcagacacagcagagatgtgaagtgtagtgtatttgcatgtaaacatcaaaccagaaaaagcagctatagcaccgtaatatctcagtgagttcaccttactaaaaggccacaaaaatgactaaaaacattctgaacacactgtctttcaaccttttacctttgagctaaaaaatttcattaaaattcatacatggcttttgaaaagcacatgcacataaactaaatgttcacacacacatacaaacactctaaccttgaagtctaaacttttatgaatctatttttgctgttagatatgtgtttacaaattccactgataccagtgggaagaatatgtattacatgtaaaaattcagcaactgtcattgcaaattaaaagtgatataaatatatgtatattaattatcatatacactcatatatatatatatatatttatttatttttttttttgagatggagtttcattcttattgcccaggctggagtgcaatggcgtgatttcggctcactgtaatctctgcctcctgggttcaagtgattctcctgcctcagcctcccaaatagctgggattacaggtgcccaccacccttcccagctaattttttgtattcttagtagagaggggtttcaccatgttggccaggctagtcttgaactcctgacctcaggtgacctgtccacctcggcctcccaaagtgctgggattacaggcatgagccactgcgcccagcctatttattgatattttaactatctccatttcaacatataaatcctattactgaatataccatttaatcaaatgataaatgaggttatttagattttaaacaaatgagcaaatttaatagatatatgtcaatggttacatttaacagaatatatatatatatatatatatataatattatatacataatctctccaaattaaatgagtgccaaatttctataactaaaataatactaatttaagttaaaaagtgaaagtaatttgagcattcttaatactcattagtttatttaagaatatagctgcatgagttctgagtgacatatagttgcttaataatcagatctaagcttcataaacaactatccatcacattaattctttattacagaaaatctcacctaattagtatgccagtgggaacagaaatataacacttaagtcgttgttccagttatcaaaagtccataggaaaatattatgttagctggtaatcacttttttcctgaattttttaaaaatagaaagcagtattagatattagaataaatcagtcctatttaacaatcttagtacaaaagaaaaaatgaactgaagagaattccatattttttcttaagaacatgacaagtaaaacaataccagtcgttataatcaatatgtatgaacacaaatataggtaagatgtgccatttctgaattatttttaaatgatcaaaacttgggccaatcaattttcttttaaattcagaggaattaaggaatgaagaccaaatatacctccacaatattctactatatggaagagaatctcacatttcactttcgaatactaaaagatgtttctatgtatttaaaagtgttctataatagtttcaagtgaaaaatgttttactcattttaattacatttaatatatatttgttatattaaaaaatttggagatcactgaaccagaaaaaggttttcacattttagacggcttaacagaatccgagattatatttgcctatctgaatgaataactctcagtaattgctaaggcttctttcaccagacgaagaaccattacttagctcatttgagtcaataacccttgaaatactttatttagcagcctaacattaaaagggcttcctttttttgacaatgtgcaatccccatgatgttcatattttggtgctattattgttggtcttcacaactgatatttgatgttatgaatataatacatccctctaataatctacaatttattatcagggtgattttgaagtttaaataaatatttcatatcatgtcatattgaaaataatcttgcatctttataggcttatagtattttgaatatattaagcatttatgtacaagcatccagatagtttcttactgagacaaaagtctcattccagaaatatatcttccagatttatcgtattatttaatgatttttatgttcttggacaacatacaagatgtattaatttatgcattcaaaaactatttttctaggtactatgaatattaaaagaacatatgtaatatggaacctgttgataagaatttcatatttaaatatggaagctatatttaaattttctaaaagtatagtgaattatgcactaggcactacactgagataataaatcaaatattatgcaaatgcagaaaggaagtatgctggttaagttaaaattatagtattatacacctggagttgtattctgttctgaccatatacgagctatgggctgcaattttctcatttgtgaaataaaaattataagagaaaccacctcatagggttgttggaagctttcaatgagatgaaggcatgcaagtgcttatcacagagacttttacagaaaaaagctaaataaattgtatgtatactcaaattttcctggatgaacgaagaaaagcttcctaaaagtctcagcacatgacttggtaggctctagctcttgcactatgactggaatgaatgaatgaacgaatgaatgaatgaatgtgcctctggttgagagagggtatttcagcctaagggactggttaaaccaaaaaggacagaaacataaaaaaataagagaaacaattagaagttttgtgaggctgtaatatagaaggaaaaatgcactgtggataagttctagtcatttacatactttcagttgtactggtcagaaaaacagaggcaggacttgggctcaatttaggagatactaggaaataactaaagataaggtagtgcaatcataagttctaaattcagtacatcctagagaaatcaaataaaactacagagtaaatggataggacatgccctcctcaagtcttgccctatctaatgagggttgtctaaagaatggaataagaggagcttgataaagttttcccactcccacttactgtataaatatctctccctctgaatcaaagattctacagttattattccacaaaattttacatctgaaagaagcttcataagttatataaccccaaattacagatgactttcagttacagctccctgtaattttccttctttgcacttgccacattttaaagttatatgtttctgtgtaatttattaatctctatctctgtctactagactatgagcatcatgagtgtaagtaatgtgttcttttctgcacatcattgtatcctatgaaataagcacagtgcccagcactcaagaggtgaatattaattgaatgaatgaataaatgaaggagtatattatagatgaaaaaactgaggcctagaagtttttgtgctttgttttagttaacatggctagtgagtggcaaaatttgaacctaaaagcagctcgcttgattcctatcctactgccttctcccatcttcactatatcactgttaggtaatcatatccctccctgacacctcttagcaatgacaagtacttccttaagagaccttactagatgtctctgaaactttaatgcgaatgactgtatcaagttatttagtctgtggttaaacatactcagagaatatctgaattgggagattttagtaaggggtgtagcaagctgtatacatggtgaaagacaatattaaataccagcttggtccatttctcaatttgacctagaactatattcaggatctccatcctatgattgtggaaataaaatgtgtgagcccattttccaaccaaaagaagaatgagtttctatttgtcttctccactcttccaggttaagagtttatttgaacagcaaggactggattaagcatggagggtggcaggtgggggaagaaaggaaagagatccttaatagtctttcccttggaaattgacagctattattatgcacacaattcagtaactatttgatgattcttaagaagatgacagtaagggatgacattaaaatgaaaaagaataataatgttattttaattcgaatgtcatttttatgaatatattaacttatgtagtagagcttacttattgcttgtggtcatataagaatccacattccacatagagaaatttgttatttcttcaacaacaatgccatcttagagataaaataagttacattatctgaggacacacaaaaagtaaaactggaagaaaggaaatcttcaatcttttatcctgatattttgtttcttcagcaaaacttttccctggattattcactgataagaatgaacactgctaccatacatgacaaaattttatgctttcaaaacaacaaaaccacaattagaaaaaacaaaacaaaacaaaaaacaaaaaaaaaaaaactaatgggtcatcctgagggagactttactcttatttagtgccttgttgttagagtaccatataaactatcacttaattaaatgttttcttaaccaatttttgcattaatttcaagcttaattttcttcactcaaacacaaaagaaatggtaaccaaaatcaagctgcaatctaaaaattaaaatgtatgcctcaatattggaatacgggattatggagtgtatgtcttaccattgttataagtggtcagttgcttcattgtagcaattattttatctaaaacacaaagtatgctatgaatttctttttaaaaggtgacctgaaatcaattaaatatcaataccccatgattttaaaatcttggatcaatatttctatattatagaaacaaattaattatgctgaattttctagtgatgtctacttataattaaaatatttagtattaactgataaggaagaaaactttagaaactgattgtatctatgtgtgtcttcctctctcactaccttcttccatcccttcctgcctgcctgcctgcctccttccctccctccctcgctcattctctcccatcctccctctctcctcccttccttctctttcttcctttcctttagtctttttcatttttttagagataggttattgctatgtttcccaggccggaatgcagtggctgttcacaggtgaaatcatagcacattagaacctcgaaatcctgagcttaagtgtttatcctgcttcagcttcaaaagtagttgggactacaggcacataccactatgcccagctctctctgtttgtctttaaaaaataaatgtaaaaactagatatacaaaagtaactgttagaattcgatagaaaaaaaagaaaaatattgtcccattttattttaataatagtggcatttgttaattgcctcccagcaaaaacattccctcccatttcattagcattattttggagggaagttctttcctaggtttgattttttttaatggactttattttttagggtagtttcagttcacagcaaaatggagtggaaagtacagtgggttcccatatgcccattttccctctacatggatagcctctccactatcaacgttctgccccagagtggtatatctgtaagactttgtgaatctacactgacttcattatcaaccaaagagcatagtcttgaggttcattcttggtgagcattcggtgggctttgacaatgtacaataacctgcatccaccattataccacaatacagaatagattcattgtcctcagaatcctcctgtgttctgcctgttcctccagcttctctactaactcctggcacctactgatcttttcatcgtcttcatagttttctttttttttcttttacaggaagtaacatatttgaaattatagagcacatagcctttacagcaatattttaaacactcctttgaaaggtctacccatccccattttcagctatggggtgtggaaggaactgacttaaactttcagctctacaaaataggcccctgatgttttaagcaaatgactccatcacataccctaggcacagatgcacaagttattcacattctccacttatcagcatggctcccttctcagggttttatttaaatcttaccttcttgttgcagcattctctgaacattgcacttcaaattctaaaattgcaaacgtttctctagaacccttaatgctctttcctgaattatttttcaactgtaattgatcaccaatcaaaatacattatgttttacttattttttgttttttgctatgtatccctgtattagatagcaagttccatgagggctgggatttttgtctagtttgttcatggctgcaccccagagcctcttttactgcctggaacatgatatttgcttaatactgatgtgttgagtaaaggaattaaatatttacaaaaatgtttactgtggttctaatagtatttgcaaggactaatagaatttaagaaaattttctaaattagtgaccaggaaataacacctaccttcagagaaactcatgttggattatttgaatggaaaaatgaaaagaaaaactgattgtatatgaactaaaatatctgttaaaagtcacatgctactaagattacaaagtgataatgcagcacattggaatgatggaaacgattataaaagtgagtattaaattaaatgaaagcaacataatgattcaggttaggacctttttgggaatggtctgacagatttacagacaaaatgaaaacgtgagacacttgtgaactgagcacattttcaaagctcaagttttcataaagctcattttaggtatcttcccgctgattgcccaaagaggttaaaaaatccaagtgattacaccagattattttgtataagcaggactgcttcaataaaggtaatatgtttttattagacagaaatgcatgtaatgcataattatgggtatatgcgcatatatatatacatatgcagatatatagataaatacacaaagattagtatttgttataacagtgtctgggaaggtttagttctgcaggaaaaagtctgcaatatttgtagtactagccttgaaaatgtttaaaataatattccagagttaatattgttgtccctggtatgtgaaagagtatttgttatcatagccaattattgagtctgcttagtttgtagtttttgttttgaaaatgttttaaacaagtttttcttactaccctcagttgcaattgtcaaactaggtgtgttctgcacatttatttctttgttcttttaatcagttctctgaggaaaagcatctgctgtctttccatattccctattatgtaatgctactgaatactacaaataatgtaatcaggaactaaaataaattataaatattagtatttcgctcttaaaatttatgtttcttaagaaatgtgattccggccaggcgcagtggctcatgcctgtaatcccagcactttgggaggctgaggcgggtggatcacctgaggttggaagttcaagagcagcctgaccaacatggaaaaaccctgtctctactaaaaatataaaaattagctgggagtggtggtgtgcacctgtagacccagctactcgggaggctgagggaggagaatcgcttgaacctgggaggtggaggtcacagtgagcagagattgcaccactgtactccagcctggcgacagagtgagactctgtctcaaaaaaaaaaaaaaaaaaaaaagagtgattcccagaaacaggacctctgatcaagagcctacacctgcaacactgaaagcttactagagcaaaatgtcctcactggtaacttcaacagcagtaatttatcataaatcacctacaaaaatagtgtatgattatcaaccatatgatatttatagcaatttcgatattataatgaacatatttgaattactagttacacgttagtgacactaatcatgactcattattgacaaaactatcaattaatatgctttgtcaagagggtgatatggtttctgtggatgagcacaagacagactgtatgacaccagcctctcctgaatttgtaaggacgtacatggcattgctctgattttttacactatctattgttttgcacgttgtttgtttcttagagatttctgttaagtatccttaaggtgctttacaaaattaaaaatgagagagaacaaaagaaaaaggtaaaggtgaacctgattcttttctagattactccgttgtgtggaatattgagtgcccaaatttattcacaacatgaatgaatactttgtttaccacatgaactcagataacctgttaggcttactgctatcagcacttgtgctgcaatttttgttttgctgagtaggcagtgctataactttggttatttgatttggtgtctggtttcctttataataagtgttgttccggttgatctgatatttcttgcatcttgaatttgttaatagatttatttaaaatcacatgagtcattttgggatataaggtcgtgttatatttattatgatacattttaaaaattatattttttactttttaaagtatttattaatcatccaatctaaaatatttaaacttttatttcaatgcatatgtcataacttttaatgtaaagatagttgcaaaaggcttatggcaacacaaacaaatcattcagtacactgaattatagagtgattaaaaaaacacatggttagagattagaaaatttgagttagagttatttcattttacttcaacaatgtgctggataagctgtgtggttcttaggaagattcatcttaaacataaacaggatagataaattctaaggctctccaaattctataactctacaattacttagaatattatgactaggccgggcacagtggcttacacctgtaatcccagcactttgggaggctgaggtggggaaccatgagttcaggagtttgaggccagcctgaccaacatggtcaaaccccgtctctactaaaaatacaacaataacaacaacacaattagccaggcaaggtggcgcggatctgtaatcccagctactccagaggctgaggcaggagaatcgcttgaacccgggaggcggaggttgcagtgagccaagattgcgccactgcactccagcttgggcgacagagtgagatgctgtctcaaaaaaaaaatatatatatatatattattacttaacctcagtatagcaaaactataggcaggatgcaggagttatgttcaaaacatgaaataatagaatggcatttacccatcagaactacagtgatagaaacaacagtataactctataagaacatatttgtgttcttttatattttatttatgtatttttttatgtatttatttactgagacaagatccccctgtgttgcccaggctagagcgctgtgataccataactcagtgatcctcccacctcagcctcctaagtagctgggacaacaggtgtgtgccactgtgcttttttttttttttttttttttaatgtagagacaggctctcactatgttgcccaggctggttttgaactcctgcactaaagagatcctcttgccttggcctcccaaagtgctgagattaggtctgagtcactgcaccctgccagagcataactgcataatatggaagaaatgccctttatggcagaataaacaaaatggcacactgaaaagaaacagtgaatatctctttccaaaatattaggggattctcaaactcctagaaagttttcacctggtgaggtataaatctaaaaagttttggacaatcttttcactaactttctatactcagaactgttttatgtaacagattagtgtaacctgggtctttctttgatggctaattaaattaatttggagctactcctattaatcatcatagatgaaatcatagagcaggaagataacctgttagtgtggtccctagaccagcagtaagaacatcacctacaacttgttagaaaggcaaagtgtcagctcttactcaaagtgtcagacctactgaaatcagaaactttgggggagtgaagcaataatctgtggttcaagaagatctacaggtgattttcataaaaactaaacttaaaaatttactattcgggctatcacagtagacgaccattacgagtgattaagagggtaggtgctcatatggtgcatttcagaaataaagagccttattcacctcagattttatacaataggaaagaaaatgtaagtaactttgttcaaccagcaagtaagaagtagagccaggagaacccagatctgccttaaataggagttcaaataggagttcaaattggtactcaccattcttcccgttaaaatagcaaaatcaaggatactagaataatgtataatgtgttcaacactaaatcgtaccttcgaatttatatacagttttaaagacactgaccctaaggagattttgtttgctttaaaaaatggaaacatacaatgataagactgtaaaacaatgtataatgtagttctctctctctctttttttttttttttttttttttttttgagacggaatggactctcactctgtcatccaaactggagttcagtggtgcaatctcagctcactgcaacctccgcatccgggttcaagtgattgtcccttctcagtgtcccaaagtgctgggattacaggtgttagccacagcgtctggcctatacaatgtagttttaaaaggaatgctttaccaagaagcagtattaacagagccatgcttctcaaactttgatcaatcccgtagtaaatcttcaaaactgcaaatgttgaatcattaggcagaggtggggtacagattctgcttttctaacaagctcttagaggatgctgatcatccaatggaccatccaatgttttgccaagacccatacttgtataaaaagcttgagatggccacctctggagccatgatggaaccactagctaccacttataacaacccgagtttgagttagcacctctctctgatctccatctgtaaaatgaggataagaatagtgcctatcttacaagggctggcagactaaatgagttaatacgttcaatatgcttagaacagtggctgactcatgataaacatataataatttttagctaataattttttaaaagcattacctattaccacaaagcttatgtcatttccaagcatgatcataactgtgattgattaattcgtataaagtaacaccaatattatatttgaagcaacacatcctgtagaaaaaagagttaatttttaaatttgtaaaataatagcatttattcttttaggaaatatgtttgatttctgggtcaaatcacatatcttggtacttacatttgtcctcatcaatgataacatcaataacttctatataaaccttttatttttcctgatagtcttctttcctttctttaattccatctcattaattatagcctatgtctacttggggcactttaaataatttcttgccttgcagacaaaagattaaattatggactattaaatatatgtaactaattaatcagtgattaattttaaattttgttgagataagaaatactgagtcacacctcacttcagggatttgtggtacggagatttatataatttcttaaatagaaaaatgattatattttatgagccttttaatcatgtaagtggtcaaaatggaaataaagattggaagttagggatttgccagatgactaacagcttgttgttagattttagtctttgtcaaaaaaattagataaaaatatgacctcatttctgattgctccaaataactagttcacattttcttagtaagaagatagttgggtattcatttcttaaatatacctatgagcagaagttcctgtagatttaatcatttcccctgggctattgacacacagagtcatttaggcatattataatcattatattaatggaatgacttaaggcaaaacgtccaccaaaaagtaattctgtatctaggtgatgggggccagggaggatcaaaacagaaaaatatctaaaattttccaacttcagtttataaaataattctttttttcttaaaaaaaaaaaaaaaaagagctcccactatagaaataaagactaaagtagcgaagatttcttttgtaattaatatgtatgggaatttacacagttaatttacattcacatttacaggaattacctctaacccacatattgacagaaaaggctctttaattttatgagttcaagaaacctatctaagtgcctaatttttttctccattgcctttaattaaaataactccagggtcatctacctgataatttggataattttttttttaaacaggaagcaagtttcctcactgaacacatttgctaagcttccctaatgacaactctagattcatgaaaattaaaacgagcacagtctcggcaggcgttaggcctactcacatgaatttgggacacctgcctgcttgttttctccctgggtaaactagagagctgtggggttttgagtaagtcatgtgccctctagacctagttttcacatctggaaaaacaagggactaggccagtctccaaagtgctgttaagctgatattccataaaataccataatgtctccgaaaacatttcagggttctttttgggggtacttaatagcttgcagtgtacatgcagatgcaatccccagctatgaagctttttgtgaaaacatatatcatcacctgcatctgataaatgatgatttttcaaatttattagacaattccactcctccaaaattgcaaaagatgggttcggtcagagttttccaaccctctagacatttagactcattttactagggactggggatgagcatgaagctactgcctgtccagtaagagaacatgacactcttcagtgtttgaaatgatatgcactcagatatgtaaagacatacatggtcatgcacattatatatctacaatgatggtgacaatgacgatattatagacttcttatttatcagattcttttttcttcctccaccactctttttctctctctcagtttccctccctccctccctccctccgttcctcctttcctccctccctcccttcctcccttccttctctccttccctccttccctccctccctaactccatccctaactccctccctcccttccttctcccgttgtatgagactatgagcttgacgtcttcaagtacatcacagccccataggagagccaggaatgaatacatacttatccataatagacaaggcatgatcatactatagttgtattcaagtcccataggactgcagagtagggagaactgattttgcttggatggagggtggaaaggactccagaaactttacagagggagtttacttatcttattcataaagaataatgaaacctaagatctgtttgcgttgccacaaaataccctagactatgggacttaaacaatagaaacttaatttctcacagccctggacacacagaagtccaatatcaagatgccaataaggtaggtttctttctgaagtctcttctcttggcttataagaagctgccatctcactgtgccctcacataacgtgtgtgtgtgtgtgtgtcttattataaggacactaatcccattggatcagggccctattcttttgacctcacttaacattacttctttataatcttatctccaaatacaatcacagtgagggttagggattcaacatatgaattttgggaagacacaaacattcagtctataacactgattaaaaggtagacattgaatcagtgtaagtgagtagtggtggggtgggtgggttctctgttttgcataataaaattgtgttccatacaactagggcgcaggtggtatgtctggaagtgtcagataaatgacaggaaaggtagagactagcctgaaccatctttcttaggaggctggagggcatcctgcacctgctacaatccttggcaaagtttaatagcaactttcagtctagtcaatgttctctctctaccaaacatgaaaaaatgcttctgagttgatgtgttccacctcctgtaaacaacacactaggaggtggagaggcatttggggaaaatttctagctgaaccagaaatttatctatttattgacttttttttctggaaggaaacatgcctttaaaaatcatgttgccctgtgattttcacttatctagcaaagttttacttaacatgaatgacataatccacgagtcaaaggtaatcatgtttttctcattttcaatccacaatgaatacattagagatgagctgttcttcattgttgtactacaatgtataatttccttaacttccttttctttttcttttgaggcagggtctcactcttttgcccaggctggagtgcagtagtatatcttcgttcactgcagcctcgacctccccaggcttgggtgatcctaccacctcagcctcccaagtgtctgggactacagatgtgcaccaccagtcccagctaagtttttgtattttttgtagagaataggtttcaccattgtgcccaggctggtctcaaatttctgggttcaaactatatgcctgtctcggcctcccaaagtgttaggattagaagcgtgagccactgtacctgacctccttaacttcttatcattattggtgagtctaattttactttgaatattttacaagccttgtacctactacaaaagttccttaaaaatgagagactcaaggctgggtacggtggctcatacctgtaatcccagcactctgggataccaaagcaggcagatcacgaggtcaggacatcgagatcatcctggccaatgtggtgaaactctgtcccttataaaaatataaaaattagctgagcatggtggtgcatgcctgtagtccctgctagctggtaggctgaggcaggagaattgcttgaacccaggaggcagaggtagcagtgagcaaagactgtgccactgcactccagtctggtgccagagctagactctgcctcaaaaaaaaaaaaaagatgctcaaatgttagaataaacagcaaaaaaattttagttattaaactaacaatttcacatacaaatattctctcaaaaaacttatgtaattggcttctgagttctcatagttttggggaagaaattatttgcaagtcattaacactcatcaatagtttcaaatgtggaaaggcaagattattctgtggtcattatgttcctgtaatgtcaggtatttattattccaaatgcaaactacatttccatatcaaaacctaatgagatatgagaactttctaatattgtattatattggtgatgtgcttcttttttttaacctagaaatatgttcaaaaaatagtgagtctcatttaggccttacttataagccagcattttactaacacttcagcttgattagatgggatttatagatcttgtcagtaaatattctcaacttaatgttctgacttcttaataaactttttgcaatagaaaaggttagttaattagtatgctgttcaaccagcaaacattttagcacttctgggaagatgaacgtctagcttcaaaacagataggaaatcacagatgtgattaattcattttttaaaaagaattgaacagcataatacattttgtagaatgtgttgcttaatggtcaataataataaggcatccagaagtaagtattttgacttatttcatcccttttctttacaatttaataatcagtggtgtcacttcttactgaagtaaaagatcagacatggccttacatagtttataatagtatgtgttgggcgctctgatgctttcctgatgctcaagtgtaggggaaaccaacttaaaaaataagctcacaaatgaattcctaattgcacaattagaaaagggttataaagaaaattatcagagaactatgtcataaaagaaaatgaaagataacacatttatgtttggtgggggagtatgaagaaatctaagatctcaaagaataaaaagtaggagccagagaaaaagtgggaaagagtatggcttacagaggaaataacttgtgcaaaggccctgaacgaggtcagtaatgaagtccctattctctgtgttcttgaaaactgttgcaaaacatgtttttctgtaaccaagtccaagaacagtgcctggtcttttcaacgtcaaaaacaactgcagatggatattccataacttaccaccaacagacagtccacctggaaccctccaattcagagagactggtgatttggggtataaagatcatcccaatcaagtcccttctctttactccctaccactgtcctatgttttgcctttatcttcattagctccccaacctctgcttggagcacacttttgttttgcacagaaacctgctgtctacccaaactgaagattgtttttagaaaataaagttctccttttgcctctgtagatctcactggtattttgttaacactaattacagtgagtggaccaaaagtaatatgagtaaattgatccaacaaacaaaatgttggatgtatacaccttaaacattccaattcataaatagcaagtgcatcaaaactcctaaaaggttatatgagaaggtaatataatttcaactggtgattttcctttttaatatagcaaattccactattctccccaccactacagtacacaagagaaattattctacaagtgaagatgcttgaaagctaaaacttacaacttaaaaataatgaaatcttaccgcctaaacaggaagatgaaatatgatgatatgcctaattttttaaccttggcttcttatattgtctatataaatatccattaaaattcacattttaggatatatacatacattagtggtgacttttgattaaaatactgcatttcaaatagtttagtaatagttcatgtttattttgcactcaaacatgaatattactttgaaaatctaaaaggatacatattacctgctgcctaatatgagagtacagtcatattttccttactttatcaataatttcttatttgataattcttttggacaaatttacattgctttcaagagtataattctttaattataagaatcaagcagactatgtggaaacacttctatatactaattgattagtgtgatatatttctcttgaatgccttatattaattatgaatcccctgtcctctactccttgttataaaagtctctgtttggatcatgttatattctattttaaatgccaagtttcccacactgcttacatttttgaaagtcgaaacctctccttccccatgtcatctacatatacatatatatatttttttaaacttaaaaagaaactattagatattttatgtaattctctattatttcaattatttcccatgtaagtatttgataaactaaaattttggaatccactaacttcaaaactactggcattttgatagcaagccttaacccaagccaatctcaggttaggaatacctacgagggtgaattatgatgaaattggaatggctcttctttccctccaagctagccaagaaaagtattttcctttctcttttcctttccacttttaatctctgccttcctcactcccacagtcaattttcaaaatagtggattaaatatttccttttttttaagctttgatccaaagggtatgattcttaaagtatgataaagtatcttgctaagactttacgaggcctcaaacccagtttgtagtacttttcttctctctgtggacacatttttttatacttcaaataaaaatctttagatgatcaattttccaattaaaattgaaaatacaccaaataactagaagtggtgtttgatgtttcaaggtgaacatgaacttcatgtcattttaaatgttttttaaaaggaaaatgcttcatttattcaattctttggtttatgaagcccttagaatttgcataaaccaaaatttgcgcagagaagatagtaaagtaagtgattatttattattttattacataagaatctcaataatgaataagaagttaaactaataggataattcagtgaaatttggtgtgatcttctgaagttaactgtcaaattttatctttgtttggtttttacactaaatgaaggcaaaacaaatgtaatctaatataaaatttcttattaaaatatacttttgtatatagatcagaaaatcatagtcactgaataactattaattacactttcatacatttttatagcttgacatttcaaaaaataactcattcatataaaataaaaatccagattttcttgtagttgtatcttttacttttattttattttattttattttatttttttgagatggagtctcacactgtcgtccaggctggagtgcagtggtgcgattttggctcactgcagctccacctcccgggttcacaccattctcctgcctcagcctcccgagtagctgggactgctggcgcccgccacaacgcccggctatttttttgtattttttgttttgttttgttttgttttaagtagagacagagtttcaccatgttagccaggatgatctcgatcttctgaacttgtggtctgcctgcctcggcctcccaaagtgctgggattacaggtgtgagccaccgcacccagctgtagttatatcttttaaaagtccatgtaactagataaatattttgcactttcaagtttaaatttgcaggcaaaataaaattttataaagtcttacacagtttacttagttttactttttattttctcttaaagtcttactgacttttgagaagtggtattttataatgattaaaagtaaaggctccagaggctgggtttgaaacccactgccaccaccatctactagctaatcaatattttaacttgtttaatctcactgtgtctcagtaaggcatggactgtaacaatacctatcttttaaggttgttgtgaagattagttgagtaatatatgaaaagtggctacaacatatctgatacacacataaagtattaactattgttgtcaatctatccagattatttgataatgtaaattgcctaggaaagactgccaggctttccacgtcctgcctcactattttcctctatggcacaggactctgatttgtacttcataatattacccagggtcaactttaccccccaaaatttcctttttagaaaaagagatctaaaatggattaatagaaaaaaatataatctgggccttaagttcaaaaacgttaaccactaagcaaaattttagactgttttcttctgcccccatgccttcccatttcatgcttcgcaaaagattcatagagtgggaagaatattacatgctgtggttcagagaaaaccagggaaatcatacaatttctctaagaactgacaatgccttggctgagagtttcttgaaattagacaagctgctttacatataatattggcctcacgtgttgactcattcttaggggaagaatgttgtacttacacattacagagatctctgggatcattaaaatgtttgaaaatgatcaaagaaatcaagaaagtttaagtaatttggttgatacccccatatctctttctgtgtgccctttgcattggaaatgaaatctgttccctttctttacactgaagcaaatctggctcctggcttaaaacctctgatcataattcttctcttaatatttgtctgtgttgtagggtcaagagtgacctccagaggtttaaacacagctgcatagcccctgtcctataaaatgatggaataattgatcttttaacaggaaaaagaacaagaagcagtgggaggagagcgaacatccttagaaaatctacctatgaccatgacaaatcaaacaactgtatagacctggactgatcatgtccccagatcataatagtttattgtccactttaggctgaagaatgactggaaaaaaaaatttaaaacggaaacaacataattcctttgtctgtaggaaacaatactggaaacagtcatattctcccaccattatgttaaataatacagggtgcaggcctatttttctgtccttctgccaaacacgaaggctgttttttaaaaatcatagatgctggctctaggaaatgcttgttccttggagataaaacacattgcttatcaagaatcatttcaagaccctgtcactctctgctcgcccatacaaaactattatgtcataactctgccctgtcccaaccaattacctactttgcaagacctacgttaaaatcacccaccacagacagtaaaatctctaaatactctttctcattttcctattttgagtatctacaaagaatctctgaacttagtgtttttccttactgaactaaatcttagctttacttgatcagcaaatttttctagcagccgtaggaagtctatagttaataacatctaataacaggtaaactgcaagtaaatattactgttttttggactataaaaattttctcaaaagtttacatctgtgttaaacttcagcttttctggatgaagtggcatttccctcaaaaacatacaaaactaaataaaaaataaaactaaaataaacttttgagtatgattaagcttattaacagattttatactaaaattcgcagcaatgtaaaatttggaatttagaatattataattatattcaactcgacttttaataattcatttaaattgttattaattatataatcaaattttattaacatttattctgaataagaaaattcataattattagagagtatctctaattttatttaaaaatttatgttttaaagtttcataggaaaatttccaatatagggctattttgaataataaattttcatagcattttaaaaattccgtgttatcactcagattttaaaattccttggttatgtctaagagtgaagatgattttatttcaaagaatacaattgcttttcctatcctagcttacattcattgtatattttagtgtattttatttcttaaatataagtgagatgcttaaaaaaatatgtactcttcattacttagtcattataatagttttgagcttctgatttttcttcttaaatggaaaatgcaaaaatacacatggtattctagcatttggcctgcttattttctaacttggtaatataaaagcatttttaaatgagtaaaacacttttatactcataaattttcttctttagtagtacagagtaaatgacttatcactcgctctggtcctggtaagtagacttggtgaaaacttttctcctcacaggtctaatatttattttgcacagtaatttgccatttcatatacattataactttgattttctcaccaatttaattctttctgatgtagttagcatctaaattgttttttaaataataaaatagattttattttaaacatgttctacataaatttattattttcatctgcaaatggtacataaagtacttttagttgatataaccttaaaaaataaaaatttcaatgtatacattatatatactctctctctctccatatatatatatatacacacacacacatacacatacatatgtagaatccaatcttaagtggcaaacattcttatatttaaccattgcatgacaactgaaatataaacaaaacagaaatagtgattttggcattgccaacatagaagattggaatttaaataacataatgtcaaaaataaagtaatttgattcttttaaggactaaagtaactttttaaaatgcacttgtaaattctgtctgattgattttctgtttctgaagaataaaaagacagacatagaattgtagctaccaccaaaggatccaagattataactaaaaaacaaatcaatacttaattttaaaacgtccccatggaaagttttagaaatataacataaactttctatactagcccctgctgagaaaaccacatacatgcatgtccttgtttttgcttaaaattgattttctctgatttcagtgcttcctccgtttttactattgcaaacacccaagactatcaactcatgtacctcaactaataaaaatgaaccagcaaaagactttgttaacaatgtatttattcagtgtattagaaagttcaaagttttgattctactctagaacatagatgttttagtacataatctggactaacagtgaccacattaatgtaactgcaattcattcaattgttccagttttatggaagtaatgtggcatagttttcatcacatgcacataaaacagttctaaattatttgtttattatttagcaattatttgatgagtgtctcatatgatagggaacctcgtcttctgagggccaaacaagctaagagttaaatcttatcaattatgtgcctactgtatacctgtattagtttgctcgggcttccataacaaaatccacagattgggtggcttaacaacagaaatgcattttctcacagttctggaggctggaagtacatgatcaagatgctggcaaattaggtctctggtgagggctctattcctggcttgcagatggctgccttctctctgtgtcctcacatggccttttcttcatgtgcaagtgagctccagtgtctcttcctcttttgtaaggacaataatcccatcagaccagagcctcgcacatgacctcatctaaccctacttatctgtcaaaagccccatctccatttaccattacactgggagttagggcttggacacaggaattttcacaggggacgtattgcagtccacaaccatttgaagcacagcatataagtttgactgtgtctttttctttgtctcttataaaacatctttatgagcaagaattcagtagaagtcatctgtgtagttttctaacaaaatcagtaacaaaataaaaacctaagattcatcacagtgaaaactagttaagtaataaacaaatatactgaataattacccagtaggaaaagaactattgagctgcaaaaattcgctcaacagagaccataatatacttaacatgaagaatgcaaaggaatgcttttaaaatattgttcaatggtaaatgtggaatgtaaaaactgtgccaaatgaagtttggcaaattaaaataaaaccaaattactaggtatgtattcctatttcagggtgcaattttgcaccaaataaaataatctcatacagtttgaattcaccaagatttcaggaaagtttttaggagacttctttttttaaatttattttcagaaactcagaagactgtagacttttttttttaaatggccaaaagagtaagagatagggttaattcagaatgaagaatcacataactgagacctttgtctcagattgtttcagaaacagcaaatgctggcttcaaacacagcaaagaactggcactgcttactctagggccatttgtaaacaaccaggttcaaggacctcctaatacagagatccattaaaatgaatgctagaagtcaaattagaaattgctaccagttttatagcaggttttcattctgtttttatactacttggtttaatgaggtataacaacattatattgctgctttaaatacatgttagttctttacatatgttttaatatctgtctatccatctgcccatctattttctcatgatctcttatctaatcctaaggctcccacctgaattgttatgctgactctgcaactctaataagcagtatttgatcgctagaagagatgtcttactctaaagaaaactaaagacacatttaagtttctcaacaactctcaatcaagcctgccttacaaagaacgctatagtagatttaggaaagaagtatacttataaaatgttttatttgtatgatgaaaaaatttagtatatgttgcatgataaattaaatgatatagctggtattttatccaacccccccataattcaattatactttaaaaatttcagaagtccaataataagaaagctccatggtctttataagtgtgaccttcaacattaaaatgctacattaaaaaaagtgccaatttagcataaatactgtagttttgctattttacaagaaatttagcaacaggaaataacatatgctataactctgaccatgtgcctataaaatgggagaaaatagcatttaaattcaatgaactactcatactgggaagatactaaaaacagcctaggtcggtaatcatgctggctttgtaactttttgctaatgatggtgtaactgaaaagcttttaaagtaaggtttttgctatctgcatacttacgaaagcaaactaaagtgtcacatcttattaaggtaacaaacaaataaaatattatgtgcatgtacacatacacatttttacattcatatttagtatcatgatacatttatattcacttataaagttatttttacttaattattgctcattttattgctgaaggaataatacagaaattcaaatgaatccaagtatctctcaataaatgctagaaatatttaagaggcaagcaacttcagcagtaaagtagcacatgaaacgatttttaaaagttttgctaggttagcggaatggcaattgcttttgatcaaaacaaagtcaatagataaggggaataaagatacatatcataagcaaccacccttatgcgaattaccatgtttttgttctattgtgcaatgtttatcatttgtcactctgtttttatttttatttatcttttgtcttccctttaaaagtacttttctataagtatacaacatcataccatgtgttttgtatttgctacaggtgaaataaagttgtttaattaactctactgatcatggacatttggccattacagtcttaagattccatatgcttgttccttatatggtactatgctccactgaggctatttgagtaaagactgttaatgaagaacattttaaaatgaaatataaatccttcttttgtttgatgggaccaaccctctttttagaatatggtatgttgacagagcataattaatgatttaataaaaagcaattcaggatgtgatgaagatacaactttacattctgtctcccaccaattccttctaactttatttagtaaggaaaatcttcccctgctactggatgaaatatgcagtatgcttcttgacttctctgcttattcacagaaaataggcagtcattatgtcaccctctcaattcactaagaaataataatcatgtctaaaatattaactaaggatctggatttaattttgtgttaagctacgttttccctggactcagacctgtttcaggctggaatatttacaataagatatgagaggagagagtggttagtttctctctatttctcaggtttatattttctctttctcccacttttcctgccgcccttcaacaagcagagtctgatccatccctagtagggaagtggggtgttgacaggagtgataaagaagtaggaaaactcttagggacgtattttaatgatcgttcactgtctctggatcgagtagattattataggtcaacaaggaatgatgctatacagacaaaatttttagaagatctgaaggattacaaagtaatatatttgattttaatttataaaatccatatgttttggtatataaccaatgactttgaggcttctgactgtgctccaagaattgaaatttggttccttccttcctataaaccacattcattatgtgcttttggatttgtttttttccatggagaacataaagttttgagtgcagaatgcttacagattttgtttttatccccttggtatgctgaaagcccctcccaaagatgtctatgtcctaatccctagaactttccaattgttaccttacatggcaaaagtaactctgtagatgtgattaagttaagggttgtgatactgggagataagcttggattatctggttgggcccaatgtaatcataaaagtttttataagataaaagtagtaaggtcagagtcattcatagaaggagatgtgaccgcggaagcagaggcccaaatgacgtgattgctggattttaggatggaagagagctgtgagccaaaaaacatggaaagccttcagcagttgaaaaaggcaaggagaaaattttatccttgagcttcctgaaggaatatggtcctttgacaccttaattttagccctttgagcctgattttgaacctctgatctccataactttaagataataactagtttttattttaaaagaaaatgtaattgtagtaatatgctacacaacagcaggaaccaatatatttttctgtccagtcttttcaacaattatcacatccacaattaatttgatagactcttgtaggagccttgaatttgttttttaaattgtccgatttagttttataaaacaacaatacttttttgcctttgtatctcattgcttagcacaatattaaattttctaattataaaaacaattaaattgtcatttgtaaacaaacacaactactctttgtaagaatgtaactctaaaagtagaaagaaaaatgactggacttatcagagtacagtctgttcacgtggcactttttttgtgctaagatataacctagtatgtttttaaaaagaaatggagccagaccccattcacagcagaaatggcataaaggaaagtttgttggaagacttttttctgtaaattcacaataacgagacaaaactgtgtatctctatctgtctgatctgtctttagttttcatcacaatagttaaagacaataaattcaatctttcctgcctccaaactattctctatactacagccagaatcatctttctaaaacatgtatctgattttacatcattcccatcattaaacccttcaactaatccactttgagaataaaaactagattgtttgatgcagatatacatgaatttttaagagatgtttcttccttcacacttcagtagaagtaaaaggcaatagtctgactctaggaagtgagtaatgagaaaaccttgtcaaaatgcatagattatttattaaaaatgtcttgagggctcagtgtttgagtgtgctggctcaagcctgcaattcctgcactttggtggggggccgaggcaggaggattgcttgggcccaggagtttgagaaaagtctgggaaacaaagcgatacctcatctctccacagtaaataaataaataaataaataaatagaaagattttgaaatgaagaaaaaaactgacagaaaaacaaaaacaatgttagggatcagcaatgtttgctgaagtcttccttaggatgtggaaaacctgacgatagtttcaaacatggagagagagagagatgcaatcacacaagtaatgctgacagacgagcatcaaaggaatgggtagggaaaggaaggaggaaagatggagaccattgtttcatagtcaagaaagggaaatactaagcaagtttatatgaaaggtctttaactaacttagtaaagaaagttgcttttcataacagaatagagggcagtgttaagtttactgagagcagaagatttttggaaacatttaatggaaaacaaaatacaacattcataagagatgccagatggcagtgaaaacctagatataactaagataaatatgactttgccctagaataagtaagatctaaacttaatttttgaggaggagaaacaattagataacttttctaaagttattgcattcagttgaaggaaacataaagaaatgtgaaggtaagtacaagaaaataataatggcaaagttaaagaacatttaagaatagtaacactaacacagagtcaaaaagactcattacttgtaagctgtatcaaaaaagttactagacaaaaggattgggagcttggtctcactggtatatttgaagtcttacagttaatttttcctacttttcctcttacactatggcacagggaaaagctgagatgttagaaccctcaaattcaacttgaaaaagcagtgacccagggacatgcaaaatgaaaatttcactgtccacttccccaaagttctttgttcataggcatgcctcattaagtaggaaaaacttcagtagatattgctagctctcttagcttaagttactcatactaaatttcagatatcaattttcaatcccaactatgaaataaaaaggctgggagaaaaaaaaatgaacttaaattataagattttaatttctaggatgattggattatgccttaaaaatgacagattacaaatttattcctattgccttgaatgaaaaactaataatagaaatttgactaaggaagacaatacatctagaataagaagtccatcaaacatttcaacaaagcaaaattggctgacccagagcaatggtaaattaaagattaatttactaattccaaagtttggataaatcttttagacacaattgtgagtgaagtaccatcaaaattttcagtgttccctctatatcaaagacaaaacgtcatttaaatatagatatagatacagatatagatatatgacaatttcctgtttcatgtcatgaattcaggtaaaagacatttagctacttaatacaaatccaagaaaatttagaattgtaaagggtttgggcttgatttatataacatctttgagaaaccaatttttcagatgagaaaatttcccttgttattaggtctgtatacaatgatttaaatgaaatatctttagggtgagaaataatcacacgtaatcttaaaagtaggttacaatgaatcaactgattgaaagactacattgaaatgataacagaggagggaaatgaacttacattgagaatattataaatttcattatgtaaaattatcacactgaacccttctgaaaccatacttatgaatagaatgttctaatacacaaacttcatggtaagtcctatttataccgtggagtctatctaactactggagtataaggtcttactttggaaaaaacattgtattgaacaacatgaaaaaaaaattagcctgggaaaagtatgatagatacataaattttttttcagaaactttttacattaaattttaaaatatgctaaacactttaacctacttaaacccaagtttgttatgtttcttttggctggatttctaatttcatttcaaagaaaagctaattttagattttttttaggcaaaaagatgtcacatctattgtgctttggattaaaaaatgttttgttatccataaaaactctaaaacgaatctttcttctcaaaagctaatgtgtttatttaaataaattattttatcaacagaatcttatatatattagaaaaatgactatgtagaatgacacagacttaagtgtatatatgtacatatatatgtatgtgtatatatgtacaccatacgtacatccaccatgtgtggtggatgtacatatatatgcatatatatgtaaatgaatatatatgtacaaataaacacatatacatgggtatatacatataaccacttaagtctgtgccattctacatggtcacttttcttcaaagctaaaaaaaaacatttggctaagcctttattctattctatttcctgaaatctgtggttatgtttgccaaactctatgtctaataatttttttaagtgcagccaggttttctaaagagtataatcttcagtaaaaataaaagcttccaggataaaatatgtgaaatttgcagctgagcattttctagaacatcttaatgggtaagtaaagtaactgaatgggtcattacaaataatatttttaaaagtcaccttgcactgtgccctcaggtactcataaatccataagatgggatattttatgacaaaaagattcagattttctgatttttaccaccaaatatggtgttcattatttaggtgattatttcaatgtcattaactcttagtattctctcctaagtccattagagtcatcttccataagacatttcctatagttgtaatttttcacattttgcctcagggtcactagagtactttcagaatcataccattacactggcaaatatgacatatatgcaatatgattaattggtttgtaggtagataaaaataaactatttatagtttataacataaccctagactctcagaatatatcaaaatgactcatcataattcatttctatttatattaataaaataaatatatcattgcaatggcatatgacttgtttagcagaagaaatagatgataatttagagaagttgctttacagaattcatgaatatataaagaattattagctaaagaaagcataatttacgggagattataatagaccttaggaatcagatatcttgacctccttaggaatctggagaggtattcaaagccccagaactggatgcaagaagaacaatgaaccgagcctcctaattctgcccatgttgctcttttctataatactttaaacccctctaagttaggtattaattttaatccaagtttgtcacaggtaaacaatttctaacttttttttttaactttagacttttacttcctcctacttaaaacacaacgctacttaatagattctaatattaaagtcttctcctggctgcagtgagtcaataacttcccgggtaagcaagtgacattatcacacaaggttatcaagtgtagaaaacaggtgtaattctattaccttaatctcatttccacataaacacattttcagctaaacaaagtataaaattatttaatgatctagttatgtagacaaatttctcaatatgacagtagcaagcctagaatatcaagcttatagaaaagtagaggtgatattaaactttaaaactgtgttaaatattaaaatacagctccaagaatataaagaaaaaatatattatttgctattacttctctccgttttatctgagagttctttttattccaaagaagattgaggctaatggttcagaggaagagaaagaagagtcataaataaaaactacttcacctaattctaaacatgtgataagtacaacggactcataccttaaactttttctttcaaaacctactgagatgagtattgttaaaaatttttcctaaaaaatgtctacagagacttattaacttccaactgattctatggtatcttttgagacaaatgttataataattgttctcctgcagatccttttcatattccaaaagtatgaacatatattattatttcttcatctttctatttgcttcagaaatttcatgtgttcttagtatgaaggcagacacttgagattttctttaattccttcttaagatcaagacaactaggagaaaattaaaactcacatacttcagtgatcagctcctaactggctttaaataatccacccaacatttgcactgacaaagaacaatgaatttattgttatgttttaaaaaggaacaaaaaattgaacaatgggaaaaattggggctggtttacatatttaaaaggctgcatatatcattggagattcttaaaataaaattattaaaccttcttactcagtttgttccccccatcaagcatgtagataacagaaagaaagcacagctgttcctatttaggaatccacagtgtagaatttccattatttatcctgataggaaagcaaagatttaaaaatgaaaacttttagaacttgtcctggctggggagacatgagggatcatgcaactgtaaaacatcaggagattagttttcagaccagtgtggagacaaaaaggaagtattatacgcacgtaatttccaccagcaatgcatatgtaactaacttgcacaatgtgcacatgtaccctaaaacttagagtataataaaaaaaaaaaaaaaaaaaaagaattgtgtgtataaaaattatatacaacacacaagtatcttgtttcctgtgatatacaagattgtagctacatgactgactatgactgttgggaataattcttttaattatagatgtatagtcactaaagtgaatgcacttgacaacttgataggtttaagtaaaaacaaagtattaaactgatagaaaagtaagaaagagtctttcttaggtttgcctgtttattttatggtagccatggtaattatctgctctctaagggataaaatgattttccagcattagccacttttcaacgctgaattattatttttaaaaacttcagtttattcataaattaaaaatactataaacccgaaaaaactttctctaaaagagctatgtaattaacccttaattacttcaaagtaagtaattccattaattttgaaatttaggagggtattgtttaacctctgaacgaacatacttagaaataagacacacttgaaaaatgtaaagaatcctgcacaccttgttttcacgactttttacccaattttcactttttctggtcatttttacatgtaaatataagatttgtgattttccacatataaattccgacaatttattatttacaaatagaaacttacattcataatcaagatacagtcagtcaaaaaatacaggtgttttctttgggaacatgaaaacaaattgaaaaaaagaatgtatgaaatagttattatatcctacttcatgcattacttggtttcctggctttagttttgtcttatggagaaggagaaaaaggtaattacactaaatttttagatatatacatacacatatatatatatacacacacacacacacacacacacacgtatatatatacacacacacacacatgcagatttctcatttctcaggttctcgtggatactgaacatgtgttccatgatttggggttggctattaaacctttctaagctttagtcttctcctctctacagtggaggtaacactagtgcccatgccactgaaatgctgtgaggattaagtcaggtagccaataaaaagcagctagagataaagagtattagctattataattttaatattttattttagcatctcattctgggtttagaaaaattaaccatttggcttcattttgtttttctcttctcaaagcacaacagaaaagtatctgaatatcatgaaaaaaagattcattaatacaattataccaacatgcataaagtgctgcttattaaatcaattcattttaaattttaataagtattaggcacagtgttagacatagtatgacatttaaagatgataagatacaacatggattcacaaagatatcagagtttaatggtgactaagataaaaaacacttatgacaaatgattaataatgaatattaatttctttccttttcgaaatgagaattttgaaattctcatagtttgcagtcatggaaacgttttgttccatgaaaaccctttcttgatatgagtaagagatttaccgactttgcaactgagcttctgggtgtcatgaaaagaggaaatggagagaatggcaaagatgattgtccaatttcctgaaatatttgtggcaggaatttgcatgtacatacatccttgtcctcctacataggagataattaacaagaaggtaacagatgtttcctgagcaccttaccatgtgctaagttgtttccacttaggtgacgatcattaagttcttatagtaattctgtgaagggagattagttcacagacaaaaaatgggacagaattgttaatatgaagaaggccacagagtgcctaagaagctgagtgaaattttaaattcatttatgttttattccacattccatggtctattcataacataaagaaacctatttaatttctccattttcattctccaacgtaagcattagcaaaatagacctaattttcttcactttttttttttaatttagaatattgatggctcagagttgtacacttttacgtttaaaaaaaaaatctacccctttggcttatttttctctacataattatctgaaaatgtaaagtagtaataatcagagttcttcgtttatactattcttcattataacttatttcattttttccaaaatttattttttccataatatatccattgttttcacattttattttataatatcctactttttcttcttcccaccatgttttctgatctcaaattgttctgaaacaatgtattatttgtatggcttgactaatattatgatacatttgtgattgttaggtttcttcctccttgtattgaagcagatagccaaatctatgttgactgattcaataaaccatggatcttggtcacaagccctaaaggaaatactttttgcagactaaaaagataatttccctagactggagggagggggaaagaaaaaaaaatgaagaaagagtgatctgaaggttaccagtaggcttcaacaatgtttctattaaaaatcatcatcctttctccactccacctccctcactactgccattggccatagtacaggttgtgcttctctgggcgctcccctgacatgggttttgggggaggaatttggtgttttgcaaaatcttttccccgacttttttcaagcattgctttttatttttccttcccctcaaattcctcctttttaacaccacctccatgttcacctgtcagctatttttttactacttctttttggcaagaagtctccgacttccacaatttagtgttttggatttaaatttatttattctccagcaacctgagaaatcagtattgcatactcaagataggtacagagttaagagtccaacctgacacatagaagcacagtgagcactagacccaagggtttttcatgatgaccagtattatgaatttatgaacggactagcaagctatgtggaccaaaggcctaagtcttggtgctacatgagactctaaaactgtgaatcagctttggagttggggaaagccagaagaaaaactggctttattgacaacccaggtgaatggagactcaaaatcagaaaagcaaatacagtagagaaagtaaagaaagtgtatttattgcacacctgagattgtattatagctgttatccttggagaatggcagttagaagtgagtaagcttttatacaaaaaaaaaatatgtgtttagaaaaaaaatatatatatttagaaatataaatacacttagaaatatatatgtttagaaatatgtgtttgtgtgtatgtgtgtgtgtgtgtttagaaaaggaagaatatcagaagcactgtcaggaagaggaaaatggaaagtaaatagaaaagcagataagagcacaaggaaagtgtggtgaaggatgggtaaggctgaggaattgtacctactttagtacagtatttcaaattactctttctaagcagattcaaactgtgatctttctctccttaatcctggattttctgtagaatttgtcctaacagttaggtgacttcattttctacaaatactgtcaggctgtcagtttctcagttattgccacctaacacaacacttaggacttaatttaactcttgtgtgtgacgtgacagcatcacacagactgctttatcaatcagggcactgttgctgtttcttatacttttgccatagagcctattgaaaccacatcctctacttttctatgtataaacacttgtgtaatgttatgttatcatctactaatcataaaaccatatagcttacaaatttgaaatacaggtacttgagtgttttcaaaattgatcaacgtattgagtgtgatggttaattgtatgtgttaacttagccgggctatggtacctgtatatttggtcaaacgtgatattggatgtttctctgagggtatttttttttagatgagattaacatttaaatcaggagactttaagtaaagcatattaccctccataatatggtcaacctcattcaatgggttaaaggccttaatagaacaaagactgatctccctccccatcaccccacacctctgcccagcccaagcaagaagaaattctgccagtagaccacctttggactcaaattgcctatcctgtagatattggactgaccaagcctccacaatcacatgagccaattccttaaaataaatcgttatctctctcatttgatagataggatagatgataatgacagatagataaatagatagatagataatagatctagatagagctccgtttctcttactttttgtcatctatctatctgagagataaagatatttgtttctgtttctctgaagaaatctgacccatacactgagaattaaaattaggacttgaaataactacataagcaaaaatagatgctttgcttggaagaagcttttcacttccttgtaatatttcaaatggtgttggaacacattccggaaaccctatttatttttggttttaaagaaagcaagacagatttgagagcacccttttatctaattgattccatttccttccatcctcaagaacaaagcacacattcctttggagcaaactgctcacataggagttatgctttattttactgaacttgcaattaattgaaagtaaaaagaagttagtgtactcataaaaagtttgtctttttgaacaaagttgagtattgtaacaagacaccgtgttatatttgtcactattgctttttatgtcaaaatgggatccattgaatcttgaaaaatctggctttctaaacctggaagctgattttgttttgggaaagatagatactgaaactttggttcagagttttgctctgttaaacttcctgagtaagccttttatttatgtcagtgtgaggcaaagaatattctcaggaatgcaagtgcctaagaagctgtgaaaaatgcgttaattgtggtcttttatatatatattttttcatttagcatataaaataatgtcataatgcactgggttgagaaacctatttctccagatctataaaccagaccaaaagttaggcatggaggcattctgaacagatctaagaaaatgtggctggcattagcttttatactggtgttcaatagcaagttttaagtttattagtgttatatctctctttttaatccctacaattgtgtagaaagtcctattcagcgtttcagcctggcctcagcaatggggctctgtaatcttgttaaggccattggaacactagtgccagtgattcagaagacattacttatgccagaaaatctgatattagcattagctgctggacagaacagacatgagtactttgagcctgacaaaagagtctgaaatgggagctatacctttaaagtgtgtatggaaaagtggggaaaggtcgtgtttttaattgacttggctggagagctctccaggtatttagtgggtatacgggaagtaccctggtgacaatacactgactaacctaaaatcaagcatgggacacccattaaagggaagggaatttcaaatttggagtatgagtgttgagggtgttaagtcttttatcttacctcttctgtggtgccatccttatggtggggtgggtgccaaagcacttctgataactttaatgtaggcccatgaaatgaagaaagcaatttgggttgaaccagaaataggagttgacttaagagtatctgggtcacatttcaacattaggtgtacttttatgtgtagcctaaatttaaaacatttatgcaaatgttaattagcctctttaaaacaaaaggtgaatattatgtcagcaaggagatcaccctagacagcattactgtattattatcagtgtggaggttcaatagaaggacaacagagattttcattcttaaaagagatacagtaaaagttccactctggggagtacaatcagttgagtcatgatataagacttttactttttatatactagcattctgtacttaaatctttttaactttgtgcatattaaaagatacttagaaagttaagccataaactttaagttaaaatgaatccattcaatctccttgaaaagtaactatgatctgtaaagtagcaaatgcattagagatggcattttaaaagaattgctttgtgaagcagagatccctttgaattgtgaacagtaacacccaatctgcaaacttacatttagcactctggatttccttagtcatatgcggacttcatgattgaactaatcattagtgcattgttctatctatagaagataatcaattagttgaatgaaaatagtcgtggttttaagttaattacagttaatttaatccctacttcatgaaaataaaatatcccagtatgatttccaccctctcccccttaaaaagtagttttaatttgctttatgtgtaatatttattctgacttacaggtaacttaaaacttaaaaacacatttctattatataaataagtagcatttaacacttaaagttttatttcaaatgaaatagtctgtaaaagtgtttacattatttattttcatctatttctttagaaacaatttgctaacactaaaatgccctccaatattcacatctatatgaatttttataggtttttcactgattttgataacaagaatattaattgaaatgttttattatatgacatcaaaatagttcattaatagcttagtgccacacacctctgagaatgtgtcttatctgagcttattattgctgatctaaaagctcaaatgaaagtttaagtagttttctgtgagctttggctcagaaaaaagtgatggcactgcaagccattttaagcttaatctagttcttccctctgttttcttggcttcatctctatcatatctaattgatgagttttactaatacatgttaaaatacagtggagcaacaatggtccattcttctcatatactttaatgcacactcccgcaatatattatttatggtcttagttatttgtctaattaaatctgttacttttatttaaactagagatgtttatgcatttttgtttgtttgtttgtttgtttgtcctcagtgatccttaagcacaagcctcactggctgcattagttcctctattattcataccagcagtgttctgaacacagcagtgaattgtctgtttgagaatacagctataaggtaaaccagaatttagcaacactcacaccaatttctgtgctttaatctgccagcattctaggcacatataaaacatctagaatgagatatctaactatgttctctggggagggggaataaatccagtggtgcctggacaaatatgctacagtaataccatggaatttgggacaacctgtccacttacacacactatggccctagcattgctaatatttcaggaatcttcctctgtttaccagtcccccagagccagacatttattccgcaatggaaaataaatatctctttttggtttgtaggcagaatgcgtctgggggtggacacctgctagtttaacattctttatataggccagactgtaagcagagggatgttcacttgcctcaaggtatttttgatcctcaagtgccacctgctctagaaactgcagccaaatgttatttaagagaagtggtgaaaagtatggcaaagaaattctgtgattagagaggactatctaaacactgcagctactcactctagaaagtcatctgcatcactttgctggggatgaaatggaaggaagtcatcaaacactgctggaattctctttgggcaagaaactactgtgttccttctacttctcaaagctagatataatttttggggacaagagattattcttatgtgtgccccaagatttgtgtcccactataacactgagctgtgtggctagtgcataataatatgtggacttgattaaggagatatagcatagtctttgaaataccccttattaggtgtgctataaaacactggtcctggaataacattacttgtggccaaaccccaactctggcacctacaagctgtagcacatctggaagactggtttcctcagtctttcttcaatttcctttttgtactattttgtactgtgcagatgtggagggttttttaaatcccatatttcttacagcaaagactccagcagtgactgagaaactgagttaaatgggaggacagatggtgggccatactttattcatttgggttgtgaggatccagcgggtgtgttgtggctcaagtggcaataattagggcaacagctaaggtggtgtgatcctggaagacagtcagtaaagctgtatcctgtttccttggctttctgattgttgtacattggtcattctgcaatattgctctaggagtcattactggagggttttcccagagtctgattctctggcccttccagtacttttaagtacccagtttcctaaattaattcaatttctgcttaaaattgttatagtggtttctattactttagccgaaccctgactggaatgtatttatgtgtatataaataacttctataaataaacaattttctattgtttattttctatattttctatgttctatttcgggcactattttcaaccaaattttaaataaatgtagatgttaacaagaaatattttatttcttaagcaattatcttaaatttccattccccacaatattaaaaaaacttgcatttttctggttattggtgaaaaattttaatgcagatattatataccagatagaattgattttattatatatagtatatttagatatccaaccttttccaagataaaaatattaactgttactttacttattctaattattttcttcatcatgtttcgtactttagatatgatttacagtaacatttcttgcattactactatgtcagacattaagctaggtgtttgcagtttgacaatgtttaatcctctggaagaaagtgagcattaatatataaattcatatgctaatagttgatgataagagaagttaagggctttcctaatgtcacacagtgagcgagctgaatagcaaactgaggaattagtgatgcttccactagaacacactgctttttcttttgtttctaattgagtagtatatggtctgtatgagacaaaactggaaattagcatgatattatatttagcacacatttattttaagaggctataatgccttagtattaaaaaaatgaggggggcataagaataaaaaagcatcctgaggtagaagaaagccacattacttgtatgatacacaatactgcataggttatcatattggcagaaatatgtcaaaaggtagtattcatattgtcgtgtatatcagatgatcttagtacttctcaaatggggatgatttaatccccactctccccacatgaggcatttggacatgtctagagatatttttagttgccacagctggcagggggttgttcttggcatgtagtggatactgttaaatgtcccacaatgaccaggacagcctcccaaaacaagtaattattcagcccaaaatgtcaatagtgttgaggttgaaaagtcctagaatatcttcaaagaaggcttctcatagggaatttgtagacaatagacacttggttacactcacatcttctgaaatgtctggttatgctggaagagacaagcttcctttaactgggtcttatagtgagtttaaaataaatgatgtataaatgattaattacgaaaaatgactcaaatgaatatgaaatcttgaggcataaactggcaaggtcagaaccttttgggttttacataattttaatcaagtaatcctttaggttatctcatagctaacctattttcagaatagtattgataacaaacacacagagtctatgtcagtgaacctttgggaaatgtgagaatttgaaaaatttttcataaatatgtgatggtaaaaagcatattagataaagagttaaacatgttttcctcaaatccaaaaattatttgactgcattgtaaaaaggagagggtcaatctacaaaatatattttataatagaaagaattatttgctgctgaaatagaatatttttaaaatttatgaattattgaagagtatagctaaaaaagaaaactgcaatggtaccatgtattctgtaaataaactcagcaattaaggatgaaattagccaccaaatacaaatatccatcctattaatgttttatatatctgcacaatttaacacttctttttttttctttcttttttttatcatactttaagttttagggtacatgtgcacattgtgcaggttagttacatatgtatacatgtgccatgctggtgcgctgcacccactaactcgtcatctagcattaggtgtatctcccaatgctatccctccccactacctccaccccacaacagtccccagagtgtgatattccccttcctgtgtctatgtgatctcattgttcaattcccacctatgagtgagatgctcatttaacaaacactatttttaaaagatgaaattgaggtctattataaattcattcattgttttgcttatggtttgcaatttttagtgaatgatatatcattctgaagctgcattatttaaaataacttgctttcacatacaatgttgtcatataaaattttgtttaaaaaaaaggatcagtaatgaaggtgccaacactcagtaagacacaattcactgtggaaatttacaacaaatgtttgcacttttatgtagattgactctatttaaacattgaattttggggtgtacagaggttatttttctttcacagtgtagtcattttcttacagttcttttttgtactttttgtataaaatactttaccgcaaattttactattttattgtgttacatcttttacaatgacatgtgcaaacaacccttacctgctgcatacacaccccaaagccaaagtcaatctttttgtcacctatcaaatatttaaacctccaatgttactttttaatatcactgaacattttaaaaattaattgcatagaattctgagtccatacttccaagaagacaatactataagtacgtaagtttgccatgggatattcgaacttctactttagatatataatacagctataacaaatgtatcatacctaagcataggttttacttttctatctatgagaagatagaaataaaactgtaactaagctttccctaatgtcattagtcaacatctcttaagaagtaaatgtctcgggattgtgatataggcaagagtgtaaaggtacagaaagaaaaacatgtcagcagacaaagtagaatagaccctcttttaccctctctccttgttacagaaaaactgttatttactagaaatctatttaaaattcatcaggatagatgtataaaaatatgatgagtctatcaattgatctgtaagaactgtaagaaaatgactacactgtgaaagaaaaatcacctctgtacacaccaaaattcaatgtttaaatagagtcgatatacataaaagtgcaaacatttgttgtaactttctgaggtgaattgcgtctcattgtgttagcacctccattactgatcatctttttttaaatttatatgacaacatatcaattaaaaaattacaactttagctccttttgtggggcaatgcagataattttaaggttcatatgcaaataactttataatattttatgtaaatactgtttacccagataccaaactaaataccgattgtttccctaaaaagagatttaccctaaaatatgcataattacaactttaggaagaatttgtaattatcaatgatatactgcaagaacatattttctatgcttgttcaaatcaaaaacaccaaaactcccatactcaataagttcctaactggattttgctacagataaattagaacatgctgtcttcatctatttccagaaaacattaaaccacagctctcaacaagctgttctcatttataacacaatccatttgttgtgttggcaaatgggaaatcccagagtgagtgaataaacaggaagcttcatcgagtgttaacaatcccccaggaccctatttgtaaagaaatggcctttgcaagaacatgtacaaatacgcgatttcatatttggcaaaaaaaacttgtgaattttattcccaatccatttagtaactttatgctttttcacatacataaacttgtgaccctgggtacatttatgagaattatatagaaaatgtatgtgatatatgtgtatatatgcatctatttgattatgttatgtatgtgtgtatattaatcatatattatttgtatatttattacataaataagggattcaacagcagttcttagggattgcacaatgagctgtttatagaaaatatcagcatgtcataaaatggagtgaaactatgcagggtggagtggttaactcccatggtagcaatttttaaagaatactaacatttttaatactatctaagtgtacaaaaaacaaatatttatcactttggaatgcagttctctgtaattccaccaccaccctaacataaaacagtgaggtctagcagcagtgttagatcacgattaaactggaacacagtattttcaaaagacaaaataaaacaactctatattccataacggcaccatgtaggttctagacatattttgaatatgtctaaataatgggatatattgagaacatgtaacattcctggaatacccttttaaaatatttgttcattgttttccatgttattaaatctgtttcatgccagaaattttatttagggagcactagtcaatctccatgtgaagtttcttaagcgaataagaatttatttagaatcatagaccctcagatcttctattttaattgtttctgtctgtgttcattttcatgcatatttggctataatgaaatgatggtttaaaaaccaaatttgaccattataaatgaaaagttacttatgaataaaatcatttccatatcagtttaaatgtatagtagataatcttgacattgtattagtataattcatgcaactgtatataacatgtagaaagaaaaaaaaaatccctgtaggagcacatgagcatgctgagaaataccttttgtttaaaaccgtataactaaaattgctttaaaaatgttccaggatcataatgatgagaaattgcaactacaggtggtcattcatatggagataaaggcaaataaaacatttgcctttatggcaaatggatgaagaattcaatactagataataagttttcaaaaagttaccaagaaacataaaattttaaaaatataatagcttctcacaggttttagacaatagaaaagctctgtgggaggacatgtcataggtaaagaagctttacctcatttgtatctcagcttaaaaaaattagtcttaagtatgaacaaatcattatcaaaaaggatgaggtaacatattattttatataattgatttaaaagatggaattcaatagcttctttattacaatgtctgtattcaagtttctgagcactgaacacctataaaagcaaaagggaaaattgatttatttggtatgaactgcaaatgtaaaattagagaagtgaagtacaactgttggcctgggggatgattctgtttcagttagcactggtgctgcttcagccactttaagcaataatgttcttttagagttatgtataaatcaccgttttgaaattagaaatctatcatttatatagtttgtataatctgagaggtaatgtttcaagaattgaaagggattgaaaacatatttcttccttcaacctcagaagctgctggcttgctcatctcttgccttgagttttcttgatgattaggactaagaaagtaagaaaataagagtatttccaagccatcaccaaggaggttttcagctctcctatcatctccatgaccctctccagtcctaagcaaacatatatttaagtaaatacagtgtgccttctatgctaacttcagagtcaaggtaaattccctaggtagacttctcctactattatggccctgcttacccacaaagattttggaaaaatccctagagttaaagagaactgaaaaaaagatcagcccagagcaaaacctaagatattaagactagggcagaaaaaatatacaaggcaacagaacagccaaacaatgacagcaacaaacactcgagcgatatggcaaataaggaaaggttcccgggaccccgtaattttaggcatatattactggaaagcaaagaccaaatggctcacaaatttgggattatttgaactaaaattaatctgggatacctgtataaagataaaaaattagcagggacctaattctatcatccacactatgttaggttaataactatcttatgtatgctagtggtggaaattgcaggtgttggctgttcggcattggatacttttcattggtagagtttggattttatagaagaattgctaataaaaaactgaggatgactgtcaaattaatttcaggccagcattttcaccattaaaaatattggtaaaataacttcatttgaaattacaaagtcacctatatgattttaaaagactataatttctcatttgataacatacacattgaattttaaagtgagtagtattttttcttaacaaaaatatttactaatgatgataaaaattttatggcgtatataaaagtcaaaagttactctaacttacttagttcttaagtcttttgtcatcactgtacgtcactcaaaaacaacttcagtaaagaattaggttgtaaagagtgacatctaggaaaacatgaaagttattaaaaattttatgaaaatggtattgctagaataacacttgtgatcacacctcattcaaagttcgtatctatctaagaaaaatacacaaatattactgtgcaagaaatataaaaagcttcaatcttactgagaaaaattgaacgtatcaaataaaaggctacatgggcacatgtatttcagttacttctgccttttgaaattaaaaatattttgattttaaaatgattcacatactctaaaatagcaataacagaataatgaaatattcataacactctatcattacttatagtatgccacgctatgtacaaagttataaaatgcaatagaaaacgtggccaaataaaaaaaaattagtccataagctatatactgaattgcataggcttattatttgtaagtaatttgtaaatcacattattatgaaatgtcagctttaaaatacaatggaactttcatcataaagataataaggaaatattattactataaagggatatacacagagcacagatagtgtattaaatggaccaaatatagcagctcacgcttattgtattcaaagtatgaagtaatgaggtaggataataaagactatgttaattttgaacatttttgtatttctcacataaaataaaaaaatagatttttgaattggacagaccctcttaaattattgaaagtaattaatattctttttcccaccagaacaaagtaagaaacaataagcttaagagattttacagtggtcatatggctagtgacacaggaaagaacagaagccaggtgtccagactctcagtctagaatttttattacattctggtgtccctcagagactgctttcccaacaaaataaataattctggtttgcgaatagcaataacactaaattcttttaaaaatctaccaagactgttagggatagtttaccatgtgacgtgattcccttatgagtcattagagaaaagtatgtgtgtgtgtgtgtgtgtgtgtgtgtgtgtgtgtgtgtgtgtgaaagacagagaaagagagaggaacggagagagggagagagaacgcattttatgaagagacagtgttggaaatggcaatttttctattactatttctatattattccctgacctttgcaaactccaagaacatctttttgcattaaactacaattacaaaacaaaatttacaaaaatatgaacaattgtaataactttcttaaaaagtttttagtttgctatatcgaagatgtaatggaatctagatggatacgtattatttatttctgattaagtatttactactaaaacaaaaatttctaactacatttggtttcaattacttccaggaggtaaatttaatattttttggcagaaagcacactcagtagaagcagcaccatactatgacacaaacgtaaaaccagatttcaagttctaccttcttggttactaaggctttgggacagtttttcaccatccctgagccatttcctccataaaatgttggtagtgtcaagaattctgaagggtcagagatttttatccttcttgaaagctatcatgtcagcctgtcacattttcataaagactgacagtagacacaagactcttgagtcagacacagagaactttattattcattgcatgagcttcatgtcctcataagttctccttctaacccaagaacgaataagatgatcccaaaaggcccagaggatgctgttgtaggtttgtctcataactgaggatcccacaacttagaaaacaccatcttataaaaggtatttctgctcaacatttgccccaaagagagactttattttgattatactggtctgcacacaaatccgactttttccctggagggagtcactatctgtctctcctccaaggctgtctgctttagaacattcttgaaaatataaggacaaaagctgttccaagatatgtagaaatgacaaggaaaattgccccacaacaggtaatagcaccatcttggtgaatactgacagcaataatgtataaacaatggcactttaaaaagtgagaattgcggccaggcgcggtggctcacgcctgtaatccgcccgtaatcccggtactttgggaggccgaggcgggaagatcacgacgtcaggagattgagaccatcctggctaacacggtgaaaccctgtctctactaaaaaaacaaaaaattagccaggggtggtggcgggcgcctgtagtcccagctacccaggaggctgaggcaggagaatggcgtgaacccgggaggcggaggttgcagtgagccgagatcacaacactgcactccagcctgggcgacagagcaaggctctgtctcaaaaaaaaaaaaaaaaaaaaaaaaaaagggagaattgcaatttgttatataatattatttatcacctctataaactttaaaaaagctttcatataatgacatgctaaaaattaaaagcatctaaaggtggtataaaagcctaatttattaagtaattctcaataaagcctgacaccttaaacatatgtgttttatttacaaaataaatagatcaacaagtagtagttgactgtcttcagcgcatctacatctttgataaaaagactctggaagacacatagttcatcacaatcagatataaatggactcacaatggttctaattctaaaaggggaagccagtatcttcatatacaactatttgttcataatcttttgtcatctttttcaaagtatgaaagagaagacagaagtaaacattatttctaattggttgtggaaaaaacaaaacaaacaaaaaagaaaataaatgtttatatgttagaataatattgtaggaagaaagaagatatgagaatacacagtctatcagtaaaatgaataaaactaatataactaagtctctaaaatgaaaataatgatcttacacactcttagcaaattcttaaagaattatttaatctgaccttaaaattatctggataaaaatcatattgcctttgatgaccacagtaagtaaagcatgaaatatttcccatttgctacaagatacaggcttttaacaattcaggagtgtaaaaatataaaaaaactaagattgtattatacagtataatcactttggatcatgataatgcattccattaaagatttgcaatggtgttaaatccctttaaagatagcatatattggcaaagagcaggtgtggaacatttgggaaagcaagacagaaagtattaaagtgcagcaataaatcatgaaacttgtacatctgaaaaattgaattgctgtcctcagagtgtgaagtataataaacagaagtgctatctaacagtaataatttgaaattgaaacacaataatagataatattcacaagttatgtgaaataagatttccagagttatgaataaatatggtagttatataaaaatgactaagctaaaactggaataggtttggaaattctatgtatgtttaaataacattattttacaaagagtcataaatgtattatattaattttattaatattactctaaattcactattataatggttaatgtaacgtgtcaacttcaccgaaccaaggggtgcccaaatatttgggtgcccaatatttggttaacattgcccaaatattttcggtaaacattatttctgggtatgcccgtgatggtgtttctcaattagattaacatttaaattggtacacagatatccctcctcaatatgagtgggtatcattcaaaatgttaatagcctaaatggaacaaaaaagagaaggaagggaggactggttcaatctgcctgactgcttgagctgagacctcatgacttcagattcagacttacaccaccaagtgctccaggttctctggcttttggacttgagacagagtggttcaccttgttttcaggcctgtggatgaggacttgaactacaccactggctttcctaggtttccggctcacagatgtcagattgtggaacttttcagcccccttaatagtgtgagacaactccttataataaaggtatttatatatatgcacatatatgttactgtttctgttactctacagaaccctgagtaatataagcatattcagtccttttagatactattgttaaacttcattaataaatctgtttccaaagtcacatttatgttattgattaatctaaaatttagttccttgaccaaaacgtatttacttttctatatttaatcatgctaatggcaatatataacctagagcaaaataaaagaaactacatctagttaatacaaaagttacaattgccttatttattaatagatatacagctttgttaattgcttcttatataccagagctagtgggagtgggaccacaagtggagagtagaacaaaatatgaagaaaagagtttttgggcgaacaagctacaaacagtaatattgaagtttagggagaaaagagtttccaagaagacaaacagataaaagtaataaaatgttgcaaggaaggcaagtagggagatgtttaggggtctaatttatgtatttggggttaattccaaatgacaaggtctaaatgaatgaatgaaaaggaatggaaataggtagttaatgacatttctatgccattcaaagttgctcagaagaaatagctttgggtcatccctcactgcttttgttctcatactctattcaatttaagaaaatattgtcacatctgccttcaaaataaattcaaaatacaaccacttttcactatctggactgttaataacctgtactaattcaccattgcctttgcccagattaaagtaatacactgctattcagtacccttgctttgagagtttcaccccctagatacacttcttaacccaggttccaaaatattactgttaataaataacccagatactgtcactcctctgctaagtctcttaatgcttcatattttcactttgagtcaaattcccctccttactatggtggacagatagcccaatgtatggtcctccaattacttacgcttttttctttgtcctgcctgagaaaacacacataatagcctaaccattcagtgatccagcgagctgcatgtttttaactacaggcttgaacccaacccagggccttgaacattctcaggcacagataaagttgtttaggttttttgcccgaaacactgaaatatcaaccaggttgctaaacaagtataaatgagcccctgccctgagacaaaatcattaaaccttttataacttccgttcttttaagtaacaaccctttccttccagatatactggagtacaacgtcacttttcttacgtctgtcatgaggaagctgaagccctctgtatgatgtcaagtttccctaataaatgctttaaactgatgaacctggcgtttagtgcttttttggaatcaaaactggcccatctccagacaatttggggcagtcccttgcagaaactccctcgctactgcttttagggtgactccagtcacgtgcttggacaatcagaacatttaagtcatgctcctcagtctccattacctctgagacctcatctcctattaatttcctgcttattctagccattctgacctcctcagccaacgcaaaatatccctaaattcatgcctcatatccgcaatagaatataagctccatgagggcatgaatatttatgctatctctatattatctataatcattcctgttaatgagtacaaactttaaaaatattttttggatgaaaggaggaagaaaagaaggaaagaaaaatggagggaaggattaacggatgaggaatagaattaggaaaaagagagaaatgatagggaaattgcttaatagagaaacatgtatctacagggatccagttgttatagcacaaaatttctattgctcatgttgtaaggtcatatttatatccacttaattggcaaatacttttacattttaagttctgtcttctaagtctcctgaccaacttgttaaaatatttccctttttcttgatcaagcttatggataagattaactttgtataatttaacatctagaaaccacccgctgcaggtacctaacttttaatatatctgaaaatacatatccaacaactatgcattacatacttattaagttgtgtcaggtattttgatattttagaaataagtcaagaaaaaatgattttctaaaggatcttataatattataataggagaacaagatatgcacacatacatcaaggtagaatacaacaaacaatgtacaaattaaggtaaagaaacaattaaattccagcaaagatgagattaggggtttctaaacaaagagaaacaagggcataatattctcacaaatatcttattctcaaacaaagcacttgtggatttggggacagcttgaaaattatgtaactgtggaactagcacaacatttttaggaagtccaaatacgataacaagataattttcagtagtctgttattctcagagaagactgtttaaatcaagcgtaaaaatacatctaataaatagatttttcaagataaccttataatgttaaatgtaaattaggtgataaacctaggaatgtactacatatgcatttacaggttatgtctacattagtgaaccaatatatacaatattagttatccttaagggtattttactcccagtattggctgagcgtggtggctcacacctgtaatcccagcactttgggaggctgagatgggaggatcacctgaggccatgagtttgagaccagcctggccaacatggtgaaaccctgtctctactaaaaatacaaaaaaattagccaggcgtggtagcacatgcctatagagccacctacttggggtcctgaggcaggagaatcgctttaacttgggaggtggagggtacagtgagcctagattccaccactgtactccagcctcggtgagagagcaagactctgtctcaaaacaataaaataaaataaaataaattttaaaaatgtattttattcccagtatacatgcacataaataggacacaactggaacggtaaactaatgtgatttccacaatatcttgataacgttactatgaagttagaaattcaaatttatttactgtccatagagaattaaatttgattgcataggtcattctgcccatagtgtcatgaagtagcccagtttagaagaagaaaacctgaggtcagaaaaaagggagcaggcaaggatatcttctaacaagttcaggaggagcctgagccttggaaaaatccctaaaaataagcatgttgaaagttgaatccttatggagtttttgcagctaagccttaaagccattcatgaaaacaaacaaacaaaataaacaaacaaaaaacttgggtttgaatgaagaatgtgatggtgaagatgtgatggtaattttttgaaatgacatttctttaataaatatgatactgctatttgtgcacttcactattaccgtagggtgacttgtaaccacaataagtgagaagagcaatacctacttctctctgattttataataatcaagcataaaaataagatacatggtatgttaagccaattgtgatcttccatataagtaatttatggtgaatgtaaaattaaaataggattattttaaaactgaaaatggaatctaaagtgcataatgcaaagactagaggattttaaagatatattagtaaagttatgactaatcaagagtggagtagagttgaatgattttttttccatattaaacagttgtgttgttttcttcaagttattcttgagatgctatttatctttgaagcaaagagataggctagctaatttctcttttagcttctttttttctgaaaaaataataagacattgaaacaattctggcttctacaatggttagctaccactcctttaaaatgtgacaatcattttgtcataacaatactcatttaagaataaagacttataaccactgttactaatcaatctatacctgtaaatcaatccatatctgcaaattatctgctttggtactgatgtaatatatgtagaaaaaaattaccataaattcgattaaatttaaatgtagagttcctacaacctaatttgttgcctagaaacaaaatcttttgatatgcattggtgaattgctaaatttactttgtacatgcagaatatatttttaacacactactgcccatttaatgagaaaatatgtaatgcaatgggaaatatgtgttttctgtaagaaattctcttttatgaaggtaaggaaagggaaaaaataggaaaaactattttgttctatgtagtaaaatataattttggtttgtattaagcaatggaaacacttcactcagatctatgttatcaaaattgctcaaatgtactatataagctttgatactcaatagtaacttgttaattaaaaaagtgacattgtggttgaaattccctcatatttgaactaaaatcaatgtttaaataagtcaactttttataaggcaaaggaatatgaaacaaatatttttaggtaaaaactgaaaatattttagcagagattcattagcacataagtagcaaaaaaagaatgtcatcagcttaaacttttgtagttaatatagaaaaaataattaattatatattatatttcagtcatatattatcccatttaaataaaataaattataaaagtaaatttcatatgaatattttaataatcgagttttacagtactattcaatgtttgcatatttccaaattctgcacaaagaatgttttaatttttaaatttgatgaaaaatcatgtgtttcataaaaccataactttgttatataagatctattgaaatatcatacaggaaaaaaaattaagatggtatttagcactttaagtactaaataatttttgccatcaaaatttatcaattgcatttaaatgcttgttaattcatcacctattcctctttctttttattgaaagatgtatttaagtattactgaaaaccatgcaaccacatcagtgtcaatgatgatgattattttggggggaaatacgttttttttttctttttttttttttgagatggagtcttgctctgttgcccaggctggagtgtgtcacgatcttggctcactgcaagctccacctcccgggttcacgccattctcctgccttagcctcctgagtagctgggactacaggcgcccgccaccacgcccgctaatgttttgtatttttagtagagacagggtttcaccgtgttagccaggatggtctcgatctcctgacctcatattccacccgcctcggcctcccaaagtgctgggattacaagcgtgagccaccgcacctggctattttttggggaaatatgaaaaatttattcagactcaatatataacattgacattatatatacaatggcaatttcatgcctaaaccaacatttattctagtttttattttatataagatctagataagattagaggtttccttttttttttttttttaactactcaaaacaataaatgaggatttccctcaggccaagatgaagtaaaagatatttaatttatttatttattatttattcatttattttttgagatggagtttcgctcttgttgcccaggatggagtgcaatggcacgttctcagctgaccacaacctccgcctcctgggttcaagcgattctcctgcctcagcctcccgagtagctgagatcacaggcatgttccataacacccagctaattttgtatttttagtagagacggggtttctccatgttggtcaggctagtcttgaactcccgacctctggtaaactgcctacctcggcctcccaaagtgctgggattacaggcgtgagccactgcgcctggcccgagattgaatttataaagtaaccaaaacaatcagacagtatgtaagaaataactttcggccgggcgtggtggctcaggcctgtaatcccagcactttgggaggccgagatgggaggatcacgaggtcaggagatcgagaccatcccggctaacacggtgaaaccccgtctgtactaaaaatacaaaaaattagccaggcgtggtggcgggctcctgtagtcccagctactcgggaggctgaggcaggagaaaggtgtgaacccgggaggcggagcttgcagtgagccgagatctcgccactgcattccagcctgggtgacagagcgagactccgtctcaaaaaaaaaaaaaacaaaaaacaaaaaacaaaaaaaaaaacaaaaccaaaaaaaaaaaaaaaaagaaataactttcttccagacacatgagatttagggactgaaggacagtgatctctgggagatggaaaacaaatgagttagatctatgaatgcatcaattattgccttggagagtttccaggctgcagcacaggaaaagcaaacccagacagagctcagcaaacttcctttattgagaagaaagaactgtgagactgggattatgatgcagtttccaagagaggatcagagacaacggaatttcacagagaaaggaccccaatatttgcaacagggtctcctaaagtattcagcaaagtactgatcagtccaggaatttcaggcaactaaccaaggaagagaaaataactatctgaacaaaattaaaaagcttaatacctggtatcacatctacatgcaatagagtgactacttttagtagctagacttgaaatctcataattcacaaggcacctacacatataatgttcacaatagatttgccttagtgttggagaataatttgcccaagattgaacattgctctaatgtgcccaacagactttaaaagatggtaaatgatgaaacaatttccaagtaactaaagtacttctaataagaaagcacaaaaatgttataggattaaaaatgtcaggcaaacaacaacataaaattcacactgtctaacattcattcaataaacacattacatagaaaaaaaagcaataaaaaccgtaatgaaggaaaatatatcaatcaaaattgactctgaaataaaatgttaggatgagaaagcacatgtattaagcagttattattgttgtatttcagatgtccaataagtgaaaagatatagaggatatacaattattatattagaatgtaaaagctgaaaaatgcacaaaataagattagcagtcgattgcagttttaagtaaaaaggatcaatgtcttgaagacacagtaatagaaaccacccaaaatgaaatatacagagaagaaataatttaaaataatgaaaaagtataaatgagcttgggaacaacttcaacagccctaataaaattttaagtaggatctccaaaacaggagtgagagaacaaaaaaaaatgacttccagaaataatgagtaaaaatggccagactttataaagctattactccacaggtcttagccagcaaaaaaaatgaactgaaacaataaaaaaaaaaattactcaatttgtccaaaaaaaaaggcaaaaaaaaaaaaatccaagcacaagatgggcaaagacttcatgactaaaataccaaaagcaatggcaacaaaagccaaaatagacaaatgggatctaattaaactaaagagcttctgcacagcaaaagaaactatcagcagagttaataggcaacctacagaatgggagaaaatttttgaaatctatccatctgacaaagggctaatatccagaatctacaaagaactgaaacaatacaagaaaaaaaacaaacaaccccatcaaaaagtggacgaaggatattaacagacacttctcagaagaagacatttatgcagccaacaaacttatgaaaaaatgctcatcatcactggtcatcagataaatgcaaatcaaaaccacaatgagataccatctcacaccaattagaatggcgatcattaaaaagtcaggaaacaacagatgctggagaggatgtgaagaaacaggaacacttttacactcattatgggagtgtaaattagttcaaccattgtggaagacagtgtggctactccccaaggatctagaacaagaaataccatttgacccagcaatcccattactgggtatatacccaaaggattataaatcattccactgtaaagacacatgcacagtatgtttattgcagcactgttcacaatagaaaagtcttggaatcaacccaaattccaaccagtgatagactagataaagaaaatgtggcacacatacaccatggaatactatgcagccataaaaaaggatgagtttgtgtcctctgcagggacatgaatgaaactggaaaccatcattctcagcaaagtaacacaagaagagaaaaccaaacactgcatgttgtcactcataagtgggagttgaacaataagaacacatgtacacagggaggggaacatcacagactgggggtgggggctgggggagggatagcattaggagaaatatctaatgtaaatgacaagttgatgagtgcagcaaaccaacatggcacatgtagacctatgtaacaaacctgcacatgtaccccagaacttaaactataataaaaaaataaaaaagaatacggtgctcaggtacattataaacatatttctcaaaactagtgatagagaaacttttttaaaagccagagaaaaacagcacattgcatacagaagaccacttgtgttataaatgacagcagatttcttgtcaaaactatgtaaggcagaagacagtggagcaagatctttaaaatactgacagaaaagtcaacctagagttctataaccatttaaaatatatcttaaaaacaaagacaaaattaagagttcttcagacacagaaaggctgaaagaattcaccactggcagactcatcacactccaagatatgctgaaaaaaaagtacttcaggcataaggaatattataacaaatggaaatacagatatacataaaggaataaggaggagtagaaagggtaacatgatggagtatatgtaagatttttcttatacatatgttatgacttttacaatgcacattttattttagttcatacaactaattatttttttaaaaaacaattaaaatgtaacaataaaaaaccactccaatagtcaaaaagaaggcagaaaaaaaggaaaagggaaataaacaacaaagaggacaaatgaaaactacaaagcagggtgataaacctaaatgtaattatatgagtaatcacactaaatacaagtgttctaaataccttgattcagaggcaaagattgtcaaatttgatttgaaaagcaaggccaaatatgtgctgccaagaagaaatatactttaaatagaaagacataaataagttaaaagtaaaagaataataaaatatatgctatgaatactaatcaaaagaaagttggaatgactgtattaataatagaaaaaaggttatttcagagcaaagaaaaactgagataaaaaaggtgatttcataactataaagtggccaattaagattacacagcaattcaatcttaaactgtttcacttaggaacaaatgttcaaaatacatgaagcaaaaactgctaaaactgcaagcataaagaggaaaattcacaattatagttggagatttaaatatccatctttcaattagataaaatatcagcaagcatatgaaaaactctaactcaaccaactttatataatttcacatttatagaataccctaccaaacaacagcatgctgtacattctttcaagtacacatgaattatgtataaagatacaccatattctgggtcataaaaatgtctcaataaattagaataaattcaagtcatagaaagtatgttctcattccacaataaaattaaataaccattcaaataaagaaagatatttgaaaaattcctaaatattggaaacacatatctaaatagctcatgagtcaaaaaaaaaaatcaaaggtgaattacaaatgtttccaatgtggctagagcagtatttagggaaattttatagcattaatggcctagattagtaattttttagaaagggtctgaaccaaatgacttcaacctcccccttaagaaaccagaaaaagcgaaaaaaaaaaaaagaaactcgaattaaacagaagataggaaataatacagatcagcatagaaatcaataaaatagataatagaaaaaacaacaaacaaaagttagtgatgcaagaaaattaatgcaactgttaaacttttaatcatactgatcagaaaaaaataaaaatatttgatcattatcaagaaatatgtagtaatattactcagattctatagattttaaatgtataactagggaatattaagaacaaatttatgccaacaaatttaacaagtttgatgaaatgaattaactcttttaaagaaacaaaatatgaaagcacactcataggcagacaacctgaatatccctatatctaacaaagcacatactgtaaaaaatcatttatgtaaaattctagaaaatgaaaaccaatctatcaataaaaagtcgatcagtgtttaactggaaacatgcaattgtagcagggagggatgaaagagtgaaattaacagggagcctagggaagcatttgaggatgatggatatgtttactatcttgattgtatgatggatggattcatggttgtattatatgtaatatattgcaagttatctcaattgtgctatttcttctctgttttttcttcctcttttgacaacagccaggtgtgaactgggagaagcagcagctactccactttctttggtatttgggatccagccattagatgagtttaccactccatctttgcttgctcgtgcctagaataatcacactacaattccatatccaatcataaaagattaaatggtcaggtcattttgagagaacacctctagttctcatgaaactatcaacatgatacacacagagaaactggttgaagaggctggaattaatttctgaatccttatgtcactctatcaatttcctagccttaatttcttttctgacctgctcttcaggacttaagataactgtttttgttgttgttgttgttgttgttgttgttacagttgttttttaaaggattatgtgttagtttatttttgacggtataacagaatatctaagaacaggtaatttacaatgaaaataaatttactggctcacagttctggaggctaggaagtccaatatcaagatgctggcatctggtgagagccttcctgctgagtcatcacatggcagacaacaagagggcaagaaagggcaagaaagagcaagaagggtccaaagtctcctttttataatggcagtgatcacacccatgaagatgaagcccagatgacctaatcacctcttaagggtctcacttcttaacgctgtcacagtgacaaataaatgtcaacatgagttttggaggggacaaatattcaaaccatgcaaagtagtatgagcaatataaaaattttttctttagtcagttgtttttcaatcgaaataaaatattttctttcatgtaaactaaaatatattttgttaaatgttagtgaagaatatactcaaaattatacgtatgtaatttttagacattaataattggacttgatatattattcataattattatatttaattaaggaagaactttttcacctatttactcattcactcattcaggattactttccaaaaggaatttatatttagatatgaaaagggagttaaagttactcattttttctagaaaatttatatagcattacctaatatgtgttagataatttgctgaatgatatgaatgtaaagattagagatgtaaaccctgacattgtgtacactaacatgatatgatataatgtagtaaatcctaaaaccgaaaaatgtacaaagtgttggggagcatagtagattaagaatggtatatgagaaaagggaaaggaaagaggcattttaagaagagactcagtgtgtaatatggtggacttagggagccatgagtggtttagcattattataatataggccataaacaccaaagatgcaaggggaaacacatggacccatcctgtggagatataagaacactttgtaaagaggcaaaatgtatgcatatgtcatttctaagaaattataaaaaatacaaatgctatattttgtccagattttccagtcatgacatggtatgaatttataccagggaactagaataaaaaataccaaaatcatacattccataaatagaatcaaacatccaaccttatagtgtatattatcctgaactatatttggaagttggttactgtaatttgaatgagttatcatcttcttaaaatactatgcaatcaaatgggagcaccactcaatttattggtacctcttattaaagttcattttaacaaatcagtgacagtaatgttggtcaaagagtgacagtctgattaaggcaatgtatttctttaggatttgattgatggaattctttgtttaaatgatggtaaacaggtaaatacacctctatgataaaatatacaggacctcaataaacaggttctttataaagctggaaacatacaaattacattgggctgaaggacaaaagcagaaagtcttttctctaatgcactgtgccttgtagtttatgactgtctagtatggtaggggtttagcaaaagtaaatctccataactgccagtcaaacaatgacagttaatagaagttttacccagtgtcatgaaggtaataattaacaatttatagcaaaaaggaaaagcatgataataaaaaagtcagcagctaataaagaaaaagaatgaagtagctgcatgaacactgtacccaggcaatcatcataaataaaccaatagagtaactatccctttaacaaagcatctccgtatcagagaatcagactgcagaagctggagaaggcccgtacttcatcattcattctacctcactagactccaactccatgccctcctgaccaaggaggtaattggtacttagattttataatttaatgcttcgttaaggaggttctactatgtcagagtgtgatttttttcatttctactaagcaaaacgcaattctgaaagattatctgagacacatgcaaataaagatacatggacataaaaaatgtgagattgatctttcacataagtaaaccaattttcagctattgaatataattttaagttataatgaatttcatgctaccaaaacatttgtcctatatttcatcaaaaaagacagattttctcatgaccaaggccacttaagttaggcaacaagataagccaattactagccacaataatctgatacctagatagatgatagatagatagatagatagatagatagatagatagatagacagatagtgatagaacataatatcactatgtagtataaacataccctcatatatcttgtctcatttaagcaaaataaccaatttgataatatctattatcttccaggctaccttacatatacaatctcattgaattctaacagcatcagtggctcgaatactgaggcagaatttagtttttgtttttttgtttgtttgtttgtttcaggtccagtgatcctacatgaaaccctattccttttcttgaaatcatgatgatccctagaaagaaagacaggactcaagggcacctattagaatgtatctaatacattcaaattaattgcattattctgattatatatttgctttggaaggtacattttgctacagcatgaagggatgtgtaaggtcattccttgaaaccaaaggagaaatttctataaaagtttaatgaaaatctgtagaaagctgattgaagtcaatttgctaaaatttgtgagcaatactgttctgatgaaaaaactcaaaacaaaatcttctttctctcttttaaaataaattatttctctgttttggcagtaaaaatgttggaagccgagaggctcaaaaattattatttctgtctctcctgctcccattctaaattacttaaaaaataagtcaaagagaaatctttaaagttgattaagaagaactttgtttatatatgccagcaattatttttactaagtccgaaccccagaatatgataaagttttacaactagatttccccaagattggcctgagccagtcatgcccaaatattccttccatgttcacaaatcaagacagtcatgatgcacctaaggcaaagagtgaatgagagagtgaggagaggataaagatacataaactgatgtcctttaatcctgaaagaaatatcatgagtgggaaataaggaatcaatgtggctaaacattaaaagactctgaactcaatggaaattcctaataaaatataaataattttagatttttaaatgtgtgtaatttgcaaaaattatattaattcattatttttctgattaacttttttgcagttggtgcatctcatgattaaatatctactttttctgatgcacttaaggatgtcatctaaaacagatactttccactcaatagtgagtataatttaaataattattaaatagaaaaattttgatctatatacacattttattgaatatgggccttttattatctcatattttaaattgagctgtgtcttcaattcaggaaaatgtactgataacaaagaagatggttctaaatatatcatatatatcatatattcatatatatatattatatatatgatatatataatatatatatatatatatatatatattcatccattcagtattttcaactggggagagatttgtaagaaagacctgagatggtctcaatgccttttcctcttttgcatcaattatattattgatgaagaagtattatatccctcaaatgctgtgaggtaagattttttttttaaaaaaggaaaattactgcttaattgaataagattccagaaaacaagtatatcaccaattttgagtagaatgttccagaaacatacaagatctttatgttcattctaaattacttaaaacatataggtcttgcaggcactcccaatcattcgttcattcactttctaaacagatagttattgattagccaggtttgtactagactatgggtatacataaggggatataatagtgagtgaaaaaacataattatctaatattatcataattttccaatgctatttgcctttgaggtgtattctactaatgtaaagaggatgcaatcataaaactataagaaacactgttaaaaacagataacaaactacatatatgcacataaactgtaaatgctatgggatatgaatttaattcaggacatataattaatatgtgcatggagcatacattcatgattagagagacatatattttacgtgtgaagaagcaaaacaacattgtagagtttcaccattgatgttccttaaatgtccaccatttatagctaagctgtttagattttgaacacttttcccaaagacacaatctcacttctctaatgaatgtccaaatttcagagacaagaaagaaggaagtgtagtgtggaacagggtctagtggaactccatacttcaaagggagaaatctgtcttcttttgaaatatcttcttgcttccctgactgtacccccatgtatcttaaaaccaacataaagatttttctctgatttccttgcaatatctctccctttagaaaattacaagaggagatttgatcttggtctttcatccaaatatagatatgcaactcagtctccagggcttgcattgtccttccatattctggataccttacctatgtacttgcaacagaaacccttgttaaaagcatgtcagtcatgcagttgtcagatttaacaaggaactgtttggaagacatctgaagtatttccttaataataatgaatctggagttttataaagagtgaggttttaaaaaaatgtctacctggccctcaaagggaaaaaaattcagtgaaattacatactataagacctccttaaatatctgggataagataacactaatacatgtcaattatctgaatagtaagtagaaagatatgctcaaaaaatgcatcctcagagtcaactatcatttctattgtgtgtgttcttctgacttcattaaagtattcccatgtagttttatttttattccaagtacattaatcatttagagtttacttcaagtgaattgagttgttgaacagcatttttgttacttgtgaacactaaatgtaatagcagaaaatagagtttgcaagatggtgtgaaacagaattttgtttagggcactgaagcaatcatgtgcaaacttaaagttgacaagtgaatgtgcatgcatcttgcttttctacattgtttttgtccactcgatgaaatgggttgttttggtgttaagtatggttggactagggggtagagattgcatttttgcccctccataggtaagcggcatttagttgtataagacacatctcacaagacagttgatatcctaggataattgttttgacactgtttctctgaatgattccactccaatctttatctctaccttcattatttttccttattttctttactcagaattatcataaagcaatactactaacatgtcattctactgattttcttaaaatatttttttcttggtgattgacactccaattagggcttctttttactaactccatccatatggaagaactccatctgctgtgacctattgttttggatatgaattacataccttatagtttttctttaaaagttaaaggacattattgagcagcattctcagagtttcctctgttttcacatgctgtgtatttctctcctcttttcttttggctgttgtggtggtggggcagggggagtgagatgtcttcacaatactatgttttcactatactatatttttgggcaaaagcacgttctttcactgtgtcaatagcaacacaggttgagcctcttcaattcaaaagttaaaatctgaaatgccccaaatgcactgaaataatgccacaagtgtacaataactttttaattaaacacaacatcttaagtggagccagaaagcctgccatcgtctgttgttgtttaagagcgatgcaggtattctggtgatgctgctgtgctgctccattaccctgaacacattatttttcactctattaatgccatgtcatactttttttactggtaagtactctatatgagtaagtgtaagaaaatgatttcttctccgtagcttgtaaatttagagttagaaatgatggtgatgccaaccaaccacagattgcacacatgggtggctggatgatgacaccttcactttgcaatggtcccatatatacaaactttgtttcatgcacaagtttttttttaatattgtgtaaaattatctccaggccatatttataagatatacatgaaacataaataaattttgtgtttagacttgggttccatccccaagatatctctttacatatatgcaaatatacaaaaatctgaaaagaatcaaattcagatacatttcaggtcttaagtatgttgaataagcgttactcaacctctattgtatctgtaaagctgatttaatttgctgttttaacacctcagtaggttgcctaagtgcacacagcaaatgccatttacaggtaatcacataattaagtggctacattaataagtagaatctatagtgaaattttggggaaggttgcatttcctactatgtcttgatgtacaattgctttcaaaatcatagggactatattctcttcattgacctacatacacttataataaatgaattttggttgtgtctgacttagcccatctcttttactataaggaaacagcacaatgtgtatttgttgtgtatgcacatatgtgcgtctttgtgtttgtatgtatcgggcataagtcatataaggcaataaaaattttattttaaaagtaaaaatttagatgtatatgtgttcatttattagttcgttttcatgctgcttataaagacatacccgaaactgggaacaaaatgagatttaattggacttacagttccacatggctggagagacctcagaatcatggcaggcagtgaaaggcacttcttacatggcagcaacaagagaaaaatgaggaaaaagcaaaaatggaacccctgataaacccatcagatttcgtaagacttattcactatcacaagaatagcaaggaaaaggccagcccccatgattcaactacctacacctaggtccctcccaggacacatgggaattctgggacataccatgcaagttgatatttaggtggggacacaggcaaaccatatcatttcacccctggcccctccaaatctcatgttctcatatttcaaaaccaatcatgccttccaacattcccctaaagtcttagtatttcagcattaatctaaatgtccacagtccaaagtctgactgagacaagacaagtcccttcctcctgagcctgtaaaaatcaaaagcaaggtacttacttcctaaatacaatggggttgcaggtattgggtaaatatagcagttccaaatgggagaaattggccaaaacaaatgggttacagggcccacacaagtctgaaatccagcggggcagtcaaattttaaagctctaaaatgatttcctttgactccaggtctcacatccaggtcacactgatgcaagaggtgggttcccatggtcttgggtggctccacgcctgtggcttagcagggtacagcctccctcctggttgctttcatgggctggcattgagtgtctgtggcttttccaggtgcatggtgcaagctgttggtagatctaccattctggggtttggaggatggtgaccctcttctcacagctccactaggctgtaccacagtagagactctgtgtaggggctcagactccacatttcccttctgcactgtcctagcagagatgctccacgaggaccccgcccctgcagcaaacttttgcctgggcatccaggcatttccatacatcctttgaaatctagacggaggttcccaaacctccaattcttgacctgtgcacccgcaggctcaacaccacatagaagctgcgaaggcttgtggcttccaccctctgaagcaacagcctgagctctacattggcccctttcagtgatggctcgagtggctgggacctaggggtctaagtctctaggtcgtgaagttttctgatatagcctagagacattttccccatggtgttggggactaacattaggctccttgttacttatgcaagtttctgcagctggcttgaatttcccctcaaaaaaaaatgggtttttcttttctactgcatcatcaggctgcaaattttctgaaattttatgctctgtttcccttttaaaatggaaagcttttaacagcacccaagtcacctttcaaatgctttgctccttagaaatttcttccgccagataccctaaatcatctctctcaagttaaagtttccacaaatctctaaggcaggggcaaaatgccgccagtctctttgataaaacataacaacaatcacctttgctccggttcccaacaagttcctcagctccatctgagaccacctcaggctggaccttattgtttatatcgccttcagcatttttgcaaagccattcaacaagtttgtaggaggttccaaagtttcccaaattttcctgtcttcttctgagccctccaaactgttccagcctctgcctgttatccagttccaaagtcacttccacagtttcagttatcttttcagcaacccccctgcaactttactggtaccaatttactctattagttcactttcatgctgctgataaagacataccaataactgggaacaaaaagatatttaattggacttacatttccacatggctggggaggcctcagaatcatggcaggatgcgaaagacacttcttacatggggggcagcaagaaaaaaagtgaggaagaagcaaaagcggaaacccctgataaacccatcagatatcgtgagacttattcactatcacgagaatagtatgggaaagaacagtccccatgattcaactacctccccctgggtccctcccactacatgtgggaattctgggagatataattcaagtttagatttgggtggggacacagccaaatcatatcagttcataaaaagaatctgcattgagatttctgaaattgtaaagcagacgaagaagcttcttaaaatcttccgttctatgtcatatgctattatacactaaatttaaaatagacattgagatatagtctattttaacacatacatttctcaaggaaccatgaagcacaatcaattaattcaatctataaagttagtatattaaatccaccaagtaggccgggtgcagtggctcatgcttgtaatcccagaactttgggaggctgaggtgggcagatcacctgaagtcgggagttcgagaccagactgaccaacgtggagaaaccccaccactactaaaaatacaaaattagccgggcatagtggcacatgactgtaacgccagctactcaggaggtgaggcagaagaatcgcttgaacctgggaggcggaggttgtggtgagccgagatgttgccattgcactccagcctgggcaacaagaacaaaactctgtcaaaaaaaaaaaaaaaaaaaaaagaaagaaagaaagaaaaaagaaagaaaaaaaaacaccaaggacaagtatccttatatagtaagtttaagatgagaccagtttataacttgaatatcagacttatgttgaaaaagcctgtcacacatatcttcatgttgttgtcttcacatatcactattccgaatcccttcctaatttgcctagtagcaattcattttatgggcattaaatttccaaaactgagtgtcttaagacaaagattttgcagactttctctgccattcatttattattctttagtattaatttgaatcaccaccaatcctgccacctgtcatgaagcacagtctttcaaactacaaatatactatgaatttgtaactgtcacatattgacttggaaagtagagtcatttatcacttcttttaaaaaggaatatataataaaagagaaaatctggttgagatttcctcttgaaggtgtaaaggttaaggggctactatagaaattgttgcttctacaataagtaaatacaaccattgaaaaaataaactgaaatgaatttgaggaagatatttctgatgactctttgatggttgtcaaaccaaactaaatgagtttacctgggatcttagcaaatattaaagatgatacatgaaaatacagtgtctgtttcaaatcttaaattttgaacagtgacttttttttatggtatttgactagcagccactttgtaaaatgaatggatctagagtataactgattttaatttatggaaaagcctggacttctgtagccacactgaccagaaagctgtcaacagtgaagatttgctggtgaattttaggtttttaaaatatgcacatttatattacagtctataatatgagattccagcattttacaaagccaaaaaatggtaattttacttattcacatattttttgcaatgtcattctacaacttgaaaaacaaaaatattataataacaacacaaagcttacataatcacaatcttcctgactcatcttgccttttgcttgcttgttttaggtaatggcccaacaacaactccttggactcctttagcaattgttattaaaaaataaacaaataaacaacagaaaggaaaaatgaaaaaagagaaaaataacagccaaagccatctaactgacccaccaaacatcgtcctcatagaataataattttaacaaatttcgaggaggaatttcttacaatatagagaaacaaacaagaaacgaaatgaagaacaaaaggtttgcacaatggttttctccttatttattctttaatgcataaatgtttgcttctggcagtacatatttattgatttactcattttaaatttaataaatataatttagtttaataaatacttaaattattaaatatacttatttaatctacataatatattttaggcattatactaattttaggcattatactaagcaacggagatataatgttttttgtttttgattttttaaagcagatttccctttaaggaatttacactcaataggtttttggacagataaacaagaaatgataatacaataggatgcaaattatgtatagcgacacccccacatacatacacacatatacatgataatcaataataaaatattaaaaaccctttaaagttaatggtaaacactttaaaagaataaggacactttactctcattattactatgcaaaatttactggaagtttcagtcaatgcaataagagaagtcaacgggaaatataataattgtaaaagacaaacaaaattgccattttctctgagaatataaaaatacttctatgatctaagaaaaaaattgatttcttcaaaagacaaaaatcaagcaaatcataaaaattttataaatgtttccacatcatgagtgtctttatataataaaaggatcaattcattcataatatatagtaatcccaaagatgtagacacctaatagaatagccaaaattgtatacataaaattaacagaacaaggtgaatttgacatagtaatattaaagtagaatatttggatttgtttctcttaatatggatgctctattaaaataatagatacagaatttttgtagaacaattaatagaatagatttgatgaacacatatggaatactgcatacaacagacaaggattacacatcctacgcaagcttatatgaagcaattttaaaatgattacatattagaacttaagcataaaatggatctaaagaaatagtaaaaatcatattctttgaccataatctaattaaattaaaaagtaaacaaatgaaaggaatattaaaataattatacattcaaaaattaaaatagtaattaacaatatttcgttaaagaagaaaccataatggggtttttcaaacacttgtaattaaataacaaaaatactacacatagaatgctaatgaacttagtgaaagtgatatttgaagaggcatttattgctttaagtaaatatactggaagaaatacaaatcaaaaccacagtgagatatcttctcacaccagtcagaatggctattaataaaaagtcaaaaaacaagagttgttgttgataaagctgcacagaaaaaggaatgcttatagactgttgttgcaaatgtaaatttgtccaccactgtggaaagcaatctgaagatttatcaaagaacttaaaacagagctaccatttgacccagcaatcctactcggaattatatacccaaaggaaaatcattctaccaaaaataagcatgtacttatatgttcatagctgttctattcaaatagcaaagatgtggaatcaacccaggtgcccatcaatggtagaatggataaagaaaatgtgatacatttacaccatggaatacaaccataaaaatattttcataaaaaaagaatgaaattatgtcctttgcagaaacatggatgcagtcaggggtcaaatcctaagtaaattaacgcagggacagaaaactaaataccatgtgttcttacttgtaagtgtgagctaaacatcaggcacacatgaacatcaatatggaaacaatagacactggagattactgagagaaagggaggtgtggtttgaaaaactacatattcggtactatattcactaccttggtaataggatccataccctaaacctcagcatcatgcattgttcccatgtaccaaacctgcacatgtaccctctgtatctaaaataaaagttcaattaaaaaattaaagaacaaaaaggcatccaacttaagaagtaagaaaacaaagcaaagctgcaaagaaataattaatgaaataggaaacaaagacatgatagagatgatcaattatgcccacagatggcttcttgaaaagactaattcagtggaataaaactatagtgagatttatcaggaaaaaggagaaaaggcacacacaaatacaaaagcacacactatttagaatgcaaagtctaaaataacacagatatattgtttccaaactgtatcatgatagcagtattttttaaatacaaagacccaagttaaaaactaaaatttggagaaatattattattatcatatgtttgaatatatacaaatttatattgtgattctggatgaagatttcaaaaaagcagttaaatatatagaactgaaagtcagaatttagataagtggtggtgatgatacatgatagagttaaataatatgtatctattatctatctgtctctctatattagtgtataaatagtgattgaaaccactcatatgaaagaaattattcatagactcatttagagtgagaagaaaatcagacctaaaaacagaacctggatgaataatagcttttaaaagataagtggaaaagatactgaagtagactaagaagaaaaaggcagaagaatggaataaaatctactaactcacggtagcatggaaacaagaataaaggaattccaagaagaaaggtggtcttgaggtatgaaattcttataatttaaacaaactaagggctgaaagttgctcattgattagtatagtagaaagcagatggtactctcggtgaaataagtttctgggtagtgattgaagtatatgtcatcttataaaaaaattgacaaataaaagagtgttgaatgagtggagacagcaaatgtgagtatctcattgcagatgcgtggggagatgtaacctggatagatttgggcctgagagacaattgttttgtgaatttggttgtgtttacttttggcaagagatgagcatgtatacacgccaataggtttgatgcaatgaagagggagacaattaagacacagaagtgaacattttaagggatgaggtgaagttcctgagatgtcaggaatgtatttcaaccgaattcactagacattcaaatcaagacccctccccaaattttcattttttgttttatattattctggtctctggtccatgaatggctaattgttgttgagccagtgttctcagaacctcttccaaaataaatttctgttatcagtgtaactcggaaagctctcactttccttcatgtcacaatgggctacataaatttctagagcaaaagcattaaaaaaatcctttgaatgagaacgattctaggaatgcccaatgcaagtacgaactcaccaaataggaaatatttttagctggttcaaacattaacaaagtgttagagactgtacacttcatggaaaaaattttacttcactcagaatatgaacatgtgcattcaaagtttataaagcactttataatgacatattcttattacatcttaagatcgtacatacctttaggttaatattctttacacatgacttacagggcaaatctgagccttgttgctttggaagttactaaatgtctacaggtcactgagtacatcaatacattaatacattatccttcaggatgaaggtcagaagtcacatttgaacagggtagataaaagatgagactatcattagaggcaagtctatgagtaaacttattgtttgaatacaatagtaaatataaattacaatatatacaatgatacatattatagaaaaactctgcaaattcttgtcccctagtgaaaaaaatacatggtagaaaatagcaatccttaaatgaactctgtatttagttttctttttataattctgattctactttttttgcaaccatttaaaacagtttcacggtgtaccagaagttcatacatctcaattacgccttgagtactttctaattgttctaaccttttcatcattgataaaaccactacgacttttatcccactagtggttccaaaagcatctctctttagtaataaaactgttcacttcaaatgttagcagttaaaggacaatgaaaaattaactattaactttagaggaagaatcccatccttcataatatgtccaaatcacaagttaaggaaagcaatgtcatgagtagccaaatcatataacctagtggctttgtcaattatcctaagaacaatcagatttcaattttgaaataattaacattttggcaaggatgatatctctttatacctagtaatttaatcatgacccaaattctcaaaaaaagatgcattaattatatttgatttataagatatttgggcattttcacttctcaggttattaattgaaaataaaatatgtatcttcattgtcctatgatataaaatatttttaacatttactgaaccatgcagaatctattccaatattaataaagccaatttaggctttcaagatctttacaggcagaatgatatattgaatttcagagaatagacctcagacaaatttcctatctaaaataagcctaggtttccttacctgcaaaatggggatgacgacaagtacttcacagacactgaatgtgatcataaaggcaatgtgacattggtgtctaacacacagttgtccaatagtgagtagctattaacatgatacaacaaacattaaattgacaggaaatatggagaaaaagtaaggaagcaggtctcaatgaaatgtcacatttgacttatccaagaaacagggtggtctgcaacaatactggaaagtagttgaagtgtgcttttgatacttcaacagtttcacatacaagaaaatgatctaagccataacatttgaaaaaggcctacaacctcttacaagaagttaacatgattcttctggaagaacggtactatattatatgtgtatgcaatagcataggagtaaaatattttagaaattttcacagatgtaacgtgttctgactctatctgtttgaataatcatttttatgctttttatgtactattatgaataatcctttggattcctgttgtaaatcttcaactactgaaatataaaatcactcttcagctctcagcactattttggggcttgggagtcaacaaggctaccagctccatttcacaaggtttcaaaaaaatgtctcaaaatatgtcttgaacaagaacacaaaccacatttttgaaagcagtagaaagaatcatctaatttctattagttttacacttcaaatgaacttcactgttaagcaaaatattatttttctaagtgagagattgacttttgttgacagaattgtactatctatggcagatgctatgcatacaaaatatttcttcaataaatgcaaagttacatctgtattgctattttttgtcattgctgttgctaccatagtcttttttcattcctcaaaccaaggaactacagtgtttctgtgatggtcctgctttcatttcataatttctgcccaatgtaaagcagaattgatagactaaaatacatggaaggggaaaagtttcacacaaatacataaataaattgataaatgtttttcttgtttaatttgaacacaaaattttttgtattactgtctgctttttaaatataagaaagaaattatctaaatctcaattcatgtgaaatttcctaccttccagattactcattctattctatatattaataaaacagggcttgcttgtatgtgttttgttgttgttgttgttgttgttgtctgtttgtgtgtttttgagacagtgtctctccgttatccaggctggaaggcagtggtacaatcctagctcataagagcctccacctcctcagctcaagcaatcctcctacctcagcttcctgagtagctgggactataggcatatgccaccttgtctggctatgtttttgtttcgttttgtttttgtagagatagggtctcactatgttgctcaggccggcctcaaacccctggcctcaagtgatcctcctgctttggcctcccaaagtgttgggattacaagcgtgagccaccatgtccagccctgtttgtttgtgtgttttatattgtattggagattaatacaaatgcttcaattcacttccaaaatataaaagtatttttattcatacatcagtgatagacattatgataaaagatacatttagtataaatgttaattcatccctaatttcagcattttgatgacttgcttttatgacagtgggttccagattctgcattttgtaactctcacatatatttcttatagacagatatgtatgtaagactgggagtttaaccattgtgccccttgtaaggctgtcttcacacttacagctggtgcatgattataaaagcattgtttttaatatgaagaggttatctcttaaatctgagccaggctagattaaacatcctatctggtatgagtatatcatttccaaataaagacaaagaaaacctactggggccatacccatagccactgctcactatgaatccaaggcaataccacttcatcatgtgaggactgcgagtcattaaactgacatacaggttatctaattccctttgaagccttttccattccttgtacaggccaagaacacaagtcaacctgatagacaaaattactgctgcatacctacttaagaataaaactacacactatgagaccctgtctaagaggacaggtggtagctgttgtcagtgcaaacatcagggattatttgcttgagcaaatctctcccattttcaccatccaattcatggaagtactggaagatagagccagggactccctaaagctataatacaggtctatatgggaaaaagcatgctgagattagccatggaagggatcagtaattttgaaatttcctccagcagcatatgtgagaagctctacgtgagagccaggcattctctgccacttgagatagtggtacgctgtcacttgtgaaagatgggcaggtaacttgtctgaaatgtaggctttgggtcaaaagacatcctgaggaatattctatgaatataatattctgtaatattggcaagctgtaatgtctcttcagtgacctaatacagaaagtaggatattctatggaattgttccttttagtgtagctctcaagtgctggtgtagctcttgcccagctgccctatggcaggctcacaggtagcagggtccactttgctactgatgcagtggaaggggtcactgcctcaaatagtcttacacttttcatgtgacacagtggcccaaccaactccactcaacagaccacacagtggcccaaccagctccactcaacagatcactcaatgatccctggcattttctgttcttactttccttctcctctgtctgtgccagatgcatttgcttcttaaattttggatgcaattttaagtcagacagaactggcacagagttatctatatagacatgaaaataaagccctttttctaggtcaccatatatcagattgaaagacaatttgtacaataaactgagctatcatgtgaaaatgaataataaaacttatgatctaaagcatatcttagttgatctagtgatccaaggccattactctggtggactttaaaaatatgatgactataattgaaatggagatattgctcatcttttaaatcattaacattttgtaagaagaattcagttgataaagatcagacctaagatctaattcaacatgttaaactgaatctaaaatgaaatcaaacacagttctttgatccttgcgaggctgaataaaacatctgctgagactgctgatggtgagtactttgcctcaataatgtgaaatttgtgtactagatcctacatatctactaaagtttagacatgagcattttcttctgtgcttgtagatgtccactgctatgctgattttgatacttcggttttaaaatctatgcaggttatattttcagctgtaaacttttatttctgccagagaagcagagtatttaagagtaagaagagtctttgcaatagtctccttgccgttccgtaacctctatcctcgtaagttagtagaaactgtcacctgtgagaaaacaataggccaaaccacgtaagtcttggttgattaaacacaagaccctgaatatcactcagaggtaaaacaggcacagcagaacataggtacaacattggattcacattagtgagtaaatgggtcactagattctgcacaatgtaaaacctccctgtggtcttcaaggacaactccaagtataaagtattatacttcagtaaagaggaaaatcactagctaactttaaatattacatatagcaagcagtgtcacatacctattctacacaaattaaaatatttggtttccatgaacttaaagaacatagaagaatgcaaagctttgcttagacattaagtattccaactttctttgtgtctgataccatatattttatttgaatataatttacttgctgctgcgattattttctaagaacttttgggggatacgattactcatatttaaataagatgtaaaaagatatcgatgataaatgcacaaatcttatgtatagaagaacactttagggttcacattttgtatcttttagttaatttagcttttaaataaaaacaaacacacaaactatacatattataaactgatctaaaattaaggtgtattataacagtttcttgactctttgatacaaaaataatttgtagccaaagttaaattaaatagattttataaattggttcattccatatatatttttgaaaatgtgtctgcatacttttgataactattgggtttttagcaaataaccaaagtttctgcaagcaatatctcactttcctctaaaatataagctggatattcagaagctagcttagttcattatacagcagaactgagtgtgaaactatcaaggtttcattcctttttccaactcaaacagctgctaccatctcagaagaaacaggagttgatgcgtgaacaatattagcacaaaaaggacagaccatttggtgatgacttttctcactggaatattatatcaaaatactttcaaattccctaaagtgcccaggtgggaaggcaaattaaacattaagaaaactaaaaatatctcaatagtttcattagttcttcttctccttacaaatacaatatgcaactattagaattacaactttaaaaggatattatatttcaggaattgtattgtttatgtgactaaacataaaaatatttttaactaaaaagtcaattttcaattacagaaagaccaaaggagcagcagaaataagtcaaatagttcaagtattgaaatccaaatttggaactttataataattctaatttccaatactatatacatagattctatcatgattctcgctcctgaaaatactaacaaaggggattatatttgcatcgtttttctggaaagatcatcagtaaggcttttatataaatggagctttatcagaatgctaaaaattactactttatgtaacagggcattccttttgaggctagaatttaagattacctgaaggtagaaaaatgccttataaaaatgtacaagtaggttctgccttcaagggctaagatttggattttaatttttgttgtcaatcctttggttcttagggatatataaataaaaaactattatttaagttattacatagcaaggatctatccatgtttcctggctgattgaattctgtgaaataacccagaacttctgtgtttaataggggcaattaggtggattctttaattacatatttactgagttgtatgttatcactttgagcagttgtttcaggaactccagaacttgaaaggaaataattactgccaaagagaacgcagctctgagagttccttcatcataatctaggacagatttgtaaagaaactggttttaaagagcacaagcataccctagctgtatggaaaaaggccattcctggggcactgaagaagataccaggtggtggacaggtgcgagatgaacctctttaatatcctttgtagaagtgtgcatctagatttaggtttgtggtggcttggagtatttctggtgttagaagttagctggtacattttaccctaggtgagttcaaaatctccatggtgtatttcaaccatggagattttgccccccagggggcatttgtctggaggcatcgttgattgccataattagaagagtgttacagtgatgtagtgagtggagaccagagatgctgttatacatcctacaatgtacgggtaggattattcaaagactatcctccaaaatatcaagaggacaaatgttgtgaaaccctaccctagatgtaagccaggtattttacctatctgtgttttgtgagtttttctgttgttattattaattatttattttttctttctttctttctttttttttttttttttttttgagatgtagtcttgctctgtcacccaggctggtgtgcagtggcagatcttggctcactgcaacctttgcttcctgggttcaagcgatcctcctgcctcagcctcccaagtagctgggactacaagtatgccagcatgcctggctaatttttgttttgttttgttttgtattttaatggagatgggttttcactgtgttggccaagctgatctcttaacaactgacctcaagtgatccacttgcctctgcctcccaaagtgctgggattacaggcatgagccaccatgcctggccatgcattattctaaatttttcattcaaccaatgctaaaagttacagattgggtgtggttgtgctgttagaagttatggaaaaggtaattaccttaaccagttttagataatttaattcagtttaactaaactatgtattaattaagtgcacaagaaaatgacataaaaacaacaaaaaggccaggtgcagtggctcacgcctttaatctcagcactttgagaggccgaggcgggtggatcacctgaggtcaggagttcgaaaccagcctggccaacacagtgaaaccctgcctctactaaaaaaaaataaaaataaaaaataaattagctgggtgtggtgataggtgcctgtaatcccagctacttgggaggctgaggcagaattgcttgaacccgggaggcagaggttgcagtaagccagccgagatcgtgccactgcactccagcctaggctacagaggaagccaaacaaacaaacaaacaaacaaacaaaagaaaaacaaacaaagcaaaataaaacaggaagacttacaccattgccctaagttcagagtgacagtcatcattaaaactgccatgcttagtaaagcagtgacatctttgtgtcacacatatagcaaacacaacatagccaagaaaacagggttccagagtagaacaacaagtgataaattggttattgaaaatacatgaaacaagcccccaaacctccagaaatcccctgcagacaagctgatgcagttagaccaatgaagtattgacttggacataagaacaatcatggtcttattatgtgatttcatgcagactgcagaggatagcagtatttaagtgactgttcattaaacaacaaatacttttttgcatatctctataataagcaatgttctgagccctaggaattagaaaattataaacagaaatttcttgttgcttgcaagagatacagtttcgttataaggtaggaatgctgtgttctagacaattttctagggatgttacagattgctggtgtttaaaaaaatagatttaggttatctttccttcagtttttatttattaaataaaatcatgtataacatttattaaatggcagtttttcttggaaaagggattataaagatcttgtgagattcactaaattgttgcagtgcagttatttaacagtattctatcctgctgccatcccgaatttaattatgctatttagttttccagattacatttcttttacaataagtaatatataacgtaaataaggtcatcaatttagtaagtgataaaatacaaatccaaacctatacctccagagtctattctgctaacctatgacgtgaagttaacaataaaatctttttattaactactgtatgcatttaaagtattactgatgttattttttgctttttcttttacttgctttctttctaccatgcgctacatgataaacacaaacatataattagaaaggattaactagtaaatgtagtcaagctataaatctgaagaacaagtaaagcaaatggagacatgagaatgtagttttagaacaatttagttgttaaactaggctcagtatagatttagtacatgttatctaatttaattaaattatctgaaggtgcctccatatagaagccaggtcaaaacttctaaacattaattttgtccttttctgaaacaatgtcaaggcaaataatatatgcccagatagctagattacatagacagatatctaatagatagatagatagatagatagatagatagatatagatttagatatgtttaagttcttaacattagaaagtagaaatataatattaaattatggcacataggtcatattttccattagtaactgaaaataattataaaatacaaaataagaatggtatcaaagaaaatgagtattttattgtaagtaaaattacacttgaaattaagagataccatgaaactgaatgttcccagaatacaggaagtataaactaattttagcttgcatacatcttcagacaagtattttttttttttaaagtaaagtaaaagcagaaacaagaaggttggatgggaaaggaggcttccatcagtaagttttcaggtcactgagaaaagtatgcagactatggaaacaaaagttccttcagctttgggaggaaattattatttccttcaagctacagtttaccttgttgtgaacaactgctctgaacctttaacgaccgttgaaaaggccctagtctttcttaaaagaaggtagcttatgtttagaatgtaacccattgacttgaaaactgttttttttttaaatttttatttatttatttattttgtgatagaagcaggaatatagtctaagaccaggtattgctatctgtttagcaagtctctacctgctcttcaaccttaaggtcaaccagtctcaagcactgtcacacaaacctctgaatcagctttaatattccccaaattttcactttatgctgtgtatctgcacttcaaataatatccaatctttattttcaacttccaaacatttgtcattttactaatacaagtgttttcaaattaaagtaaaaatctaacaatttgtactccttaaatattttctttgctttcagaatttttacacttcttctgtagaggacctaacacttaattttctagaccatcagtgtcttgaatatttacattcacagctctctgtttttgttttgttgtcttcacttttttttcttgcttcctttatcattatagaaagaaaattaaggtggaggaaccaaataaagtgtatatatttgggatttttaaataatgcagtggttagattaatgggtataactctgaaaaataagatggggcagaggaatatttttaaaatgtcatttttgtatgctaagtatcaccatagctaacttccaaatcaaatgtttgctttcaagtcttacaaataccctttagagtatcctttaaaatatgacccttgataatttttttttcatgaccatttcctttttttctccttggggctgctgcagcagaaggtatgagccttgacatagttcattatgttggatctattatcattggtattatattaaacaattgtgatttatcagaacaatatctgtgtagaaaattacaattagtgaaagaatattggagaggagaagagcataacatcaacaacagctttctctgttacatgaaatatagcattagaaattttaattacagtggtcacaaatgttcagaacatagcttagcggtgaaccatattttgatatacagaagatacactgtttagtaagaagcaaaatagttggtcaaacaacattttaaacaaagatgtcaacattaactaataaaattatttcataaagataagccagaaagaggatatgcacaagttgctatcagcagttttagatctgatgattctactgaagctatgacacctagtttcctagatcattaatccaacagcatatccagggaattctggagaggatgaagcattacaaatagtgtttcctttaggtgttatttgtgcttgcagcaggaaaagaagcatttcctattctttgtttcttccattgccatactctttccttctcccttctcattcaatccatcaagtgccccttcttaccaactagcttattgaaatttgaaatcgattttgtagcaaggcatggtgtccattctcggcatctaaatacttataaaactatccatcaaactatggtagttgagtaaaatatcttctctgatctggaaagtatgctttccactattcttaaactttaagtgctactagtttaggagataggtagcaaaaaggaaaggaggactatgaataatttctaagtatctatcttctcctctctcacattggtttttgattaggcatgaatgaatatgttatatttttatttgtctgtcttagaactctttggattgcagtgtcagaaattcaacttgaactacgttaggcaataagagtttatataataggaaagggcaatgtataggtagaatagactggaattagagaccgggcacctctttctctatttatctccttttatctatgtgcctttatctttcaaacaagaaatctcaaaatatataccttttttcccaaaacatacagccagggaatctttgagcgcacaactttaattttgctaccaaaaataaaagagacttttactgccaagtttcaggttaaaaaaaatatcgcctcatacctgtcaaaatagctattatcaaaaagatgaaagataagtgttggtgaggatgtgaagaaaagagaacccttgtacactgttggtagacatgtaaattagccaacatgaaaaactgtatggaggttcctcagaaactaaaaacagaactaccatctgatccagcaatcctactgctgagtatatatccaaagaaaatgaaatcagtatttcaaaaagaagatgtctgcactctcatgttcattgctgcgctattcacaatagccaagatatggactcaacctcagtgtctaccagcagacaaatggataaagaaaatgtggtaatatgcacactggcataccattcagccttaaagaagaaggaaattctgtcatttcctggaggacattatgttaagtgaattaaggcaggcaagagaggacaaatactgcatgatctcacttatgttgaacttataagagttgttctcataaaagcagagagtattattatggttaccagaggccaggatctggggaagacggatggatgtgttaattagcttgactgcattattttaaatttatacatatatcataatatcatagtgtatcctatgcatacatgtagtatttgtgtatatatatatacacaattataatttaccacttaaaaacaaaaacaaagtataaaataatattccagagaatacttaaatggcttgattgaagtgacagactcctgaattaatctttatggccagtagtggtcaagtgaaatgatttgcctagcctgagcctgaagctaacacctaggccaatccctgaaggtacagagataaaattttataaaagaatggccactgccactcagacagtatccttagtttcagatgagatgcaaaatcttaaaacaagatgctgttccaaaaataagaaaaaaacattttgtcagggtaaacaataatgtttcactacacaacctgtattaaaatcaaagccaccttccagccatttcctttgtccatgatttccttaagcttacctctttagagtataaagaataagaaaaaactcatagaatgtaaacacattctttaacatactcctatttatgtataagatagagattttaaaactcagaaaacacaaatttaaataactgaattataagtgagaatttaataattctcacaatattatcatattttctaagtaaatataacttttataaacttaataaaataccattgtttttattagtaaaacaaagaaatcatatatagtgttatataacatatgagtacttgtacaaataaaatgactacattaatctaaataaatgggataaagcaaaatggtatttttatttctattatttcttattgtcactgtagaactgtcctctgatttgagatttcttgagtattttcaacaacaacaaaaacagtttaacaaaactgtcttttcttttttccctgaagctatagctgtttttagttgagctttctttgtgaaactaaatttagacaggccctgagagatgttcacttaatatccttctgtaaaatgttaaggattacatgttattctgagttttggatcaatcgctttcttcaactaatgtgtcattctacatttattagtttataaaactcatctctaaagcattaattattccaaattacaaatgagactttgtaaaaattttacaaaaagtctgtaccagaaatagacaaataatgtcatgattaataaggtagttatattattattattatttttttttttttttctgagacaagcatctcactctgtcacccaggctggagtgcagtggcgtgatctcggctaactgcaacctccacctcccaggttcaagggttcaagtgattctcctgtctcagtctaccaagttgctgggactacaggcatgtgctgccacacccagttaatttttgtatttttagtgagatggggtttctccatgctgaccaggctggtctgacctcaggtgatccaccagcctcagcctcccaaagtgctgggattataggcatgaaccacaaaacctggccaggtgtttatattaaaattttaagagaaacttgttagaggagagccagtcctttttttttcactcccccttccatgtcctctttctttcttcctattcctcttttgcctaaacccacacacacaggtatgtacacaggaacaattttgaaagttaagaaaatgaagattttctggtgggttttcttcaagttaacatttttaagtggaattagtgggaatatctttttcaggccaaaggaaaaaaacatcccactctaccatgtaatagccatgaaagtaacttcagtctatagagcactgacaggctgggagcagtggctcgtgtctgtaatcccagcactttgggaagccaaggcaggcagatcgcttgagcccaggtgttcgagacaagcctgggcaacaaggcaaaaacctgtctctgcaaaaattaaaaaataaaaaattaattcgccaggtgtggtggcttgcgcctgtagtcctagctactcaggaggctgaggtgggaggatcacttgagttcaagaggcagaggctgcagtgagctgagatcaccccactgcactccagcctaggagacagagagagaccctgtcttcaaaagagagaaaacaaacaaacaaaaactaagaaactagaatgtgcgtacaaaaagtaactgcaaatttggtgaaggttttggaaactttatcaaatgcatagtagctaaaataattagcgtgaaccagaaaatgatgggagacaaccataagaaagaagatataacaatttttaaatttaatatcataagaaaaatgtattaattattttctccatacaaaaaatcatgataattagttggaaaattcaaggagtcagatatccatacatattcaatagctcattatcagcaaaggatattaaatgttgttgaacaaaattcttacaatgtctgtattaggaaagcatcagatgtaaatcagatctttcaaaatcatatttttatgtcttttagctatctttttgtgaaaaatcagcaagatgtaactttcagcacattctattagatatcaacctactggactttaaaagcttaataaacaatttattacactatatattaatttaatagtggctatattgctctatagcatttcaattctgattttaagttaattgtctattataagatattttgcctcaggctgaacttagtgtataatcttataatttaggaattaagtatattgtctccactgaattcttctttatggttttgaatattatttcggcttctgaacttttacaagattcaacaggttaatgaagtataaattctccaatggttctctttatgcaaatagtgctttttctgaaaaggtttttatgtgatacagaatttatgccaaactctccattaaatggatctatactgatgagcctttccttctgacccactgtttttaacacaaaattatgtctgacacttcctaatgcttgagaatcttttccaaatttagtgaactttaataaatgtcagttaaaggttcactgacaaatgggaggtgagtagaaagacaaatgaaagacttaacacactaatgttctgtggaaaatgagtaagatatcgcttgaaaccaccatattgaaagaaataataaaagtatgtgatcattaataccagttttgggagtttacagtaaatcaggaaatttaaatctagatttccttacactcagtactatatattatttcaattagatgcctatagaaaatgtgtacctctttaaaacatcttttataaaattctaagtatatttcctaagtgttcagaaatctttctcctgttttagatagttctgtgttcctccacagcgctcagggctcatacctgcactcaaatattttttgaatgaaggaataaatgcttcttttatatcagttagtttttaattgacatgaatctatatttcaggcctttccttaaatatcactttttcaatgataatatttgaagttttgccaactcattcttattgttttccctgatttatttttatagcaattattatcatttaacacactgtaagttcttcttatttgtccattgtttgtctccctcagctggaatgtaaaagctccctatggacagggatttgtgttgtattgtctgcagtaatactagtgtctggcacatgataggtattcaaaatggaatctggaatgagcagctaaatgtaagctttatcattcttgaaattcagaagcttttggggtgatgctaagccagaaaaagaggtaatctttcaaatgtttgtccttgcaagtcctatgttgattttcaatgagcaacagagcaaattcatttgtttacaattgtagctgaaacaaccaagtttgcttatgtgacatgtttacagtttgatgtaactgtagatatcagaggctaacatttcttctgtggtccttgtttttgtattcactgttgtttttgggtttccttaaggacttcttcctaaataaagtcttagatgtgcagtcctttaaattccattaacctgttattatacaagacccctactaatttgagtgtaaggtgtgggatagccttatgctttgttctcaatgttttagttagtctgtgctcctgggctttgaccttcataaatgcttctcagtgccctcttttccccactgttagatgagacagaaaggttacagcaggctattggtatttccttttccctttggtcttgaataaaaccccacatggtaggctctgccaaaataggctatgagggtaggccttgttaagaagaacacaacgctctgggtgtatttcagaatggctgtttttccctcccctttccagagcaggaaggaatttttctctgagctaatttgatgtggaagaatcaaaaattaaaagaacaaacagccatccaatacaaacaatctaacagtagctataaatattactagagttacatcaatctcaatataaagatattagaatgctatatctctctaaatttgtgtgcatacatggaacatcaaaaatctacagacgctcatggtgtaagagcacataaaagtatccctttgccctttctggcacctattgggattctatcaaagaaacatggagaaaagaaaagttcagaagctgctctcaagtagaaatatcaccgatagctacatgtttacatacaagaaccttcggctgagattctaagggcttttgaagtttagtcaagttatttttcgctgtgagttctttgtctgctgttactttaaatgatttccttccaatgctttgtcttttttgccataaatagtatattgtcaaaatttactcgataaatattagcaatatctgacctatgtgaaaaataagttatgtataaaaactttaatgcttgaattttgagtaaactattcagaatcaacttcattccccctctttaatcaagagaaaaatcaatatatttctaagaacagttattgaaacattattgttttgtgaagttttatgaggaaacaccaaataatgttttaaatggatataaaaatcttaaactattccttcaacaactaaacatttttttctcaggtcattaaacagttgttatgtttgggaacccagtattttctataattaaagttttgtaatgtcaaatgactcttctagaaagtcaactggagaccttccttgtcaggccattaattttaaagtaaagttgtctaaacaggaaattgaaggaaaaaagtagtggcttggaactaaacattttgatattatgaatcagcagtaggtggaaggatggagaggtccaagatgtaaaattatagaatattaatgatgcagtattttcattttttaataaaaccaatatgattgctttttcaataaaagagcccgaaatagaatttcttccaccttaggcaggtataataaaatatttctactagttccttttctacattatttcaataattttgtcattagaaccaaacaccattgttggcagctacttccatttgccacaatgtactcttcttcaaaaaacaggagatagcatgaccataccaacatgcaaccttaaaagacacttttaaaaacttcatatccaaatataattcataaatataatattaataatgaggacatgattgtcttctccataaataaagggcccatcattaaatgcaagcagctctaatagtccctaaaacacttcacaataggtttaaaaatccatttttcatcataaaaaatggatttcaaaaaaatggtattctttccttgtcaagtgaaacatattgtaatcgtttcctgttgttgctgttaacaatttaccacaaattcagtggcttaaaacaacacaaacattgcagttatgaagtcacaagtctgaaatgggtctcactgggctaaaatcaaggtgttcgcagatttgcattccttctggaggctctgagacggaatctgtttccttgtgtttttcagcttttagaggctgcccaccttatttggctcatgacccttcctccccttttaaagccagacatgttgaaccacgtctttccatattgccatctctctggttctctctggttctttctcttctatgtctctcttcccttgtgattaccttgtgcccacctgaataatccaggagaattcacggaccatcccaaggtcaagttttttcatttttattttatttatttattttttattgagacagggtctcattttgtcacccaggctggagtgtagtggcatggtcttggctcactgcagcctggacctcctgcactcaagcaatcctctcacctcagtctcacaagtagctgggactacaggtgtgtgccagcacacctggctaattttttgaattttttatagagacagggttttgccatgttgcccagaatggtctcaaactcctgagttcaagcaatctgctagcctgggccttctaaagtgctaggattacaggcatgagccaccacaccagcctgaaggtcaaattgttagcaatcttattttcatctgctgcttttgctaggaaaattaatatattcatattcacatgttccagggattaaatttattttaatgcagtgcaatttaatgttggattatcacctcgaatgaaacaatcataaacatgttctttagaataagcgtttgaaaagttaattttttaaagaaaaagtctacagtaatgaactagactttccctcctcactttttaagctatctaatttctaatggcctaatctccagatcttgattacacatctccttacatcttttcattgttattcctgctctactaaataataaaggatagatgaaaataatatgaagaccgacatggtggctcacacatgtaatcccataacttttggaggccagggcaggcagatcacctgaggtgaggagttcgagacaagcctggccaacatggtgaaaccctgtctctactaaaaaatacaaaaaattagctggacgtggtggcaggcacctgtcatcccagctactcaggaggttgaggcaggagaattgcttgaacccgggaggtggagattgcagtgagccaagatcatgccactgcactctagcctgggctacagagtgagactcttatctcaataataataataataataatgatagtggcaatgctaataaagttgtaacttcctggaatgcttataataatcaaactactttctcattttctcattttgtttcacaacaatcttctaacatggacatcccaatcgtttgttttttttaaaaaaactgtcaattttatttatgcttttaaatttactggtatgaagatgtaaatttcattatcttgcaactttcttaacgtagactgttttttagagaagttttaggttcacagccaaactgagtggaaagtacagaagtcccatatgccgctttcccctatacatgcacagtctcttttactatcaatattccccaccagagtggtgcatttgctacaatgaatgaacctacattgacctacggttatcacccaaagttcataatttatattagggctttctcttggagttggagattctatatgtttggataaatgtataatgacatgtatccaccattatagtattatagagcagggaaattgctttaaaattcctctgtgtgctgtctattcatttctttctcccctccaactctgagtaaacattgatccttttactgtctccagagttttgctactttaggcatttttaaattctgttttacacgtaagttaactgagacctgagtgattcactgatattcatcaagtcacttagcaagcctcatgtctggatttgaattagaacaaagatcccacattactctttccaaataatgttataagcttgcatcctaatgttaatgggccaaaagagcaggaagttatttcttataaaattaaaaaaaatttaaaaaaaattttcggctttatgcctctataacattgtattatcacaatctaagggaggcaacgaaggatagtaaaaacaaaaacaaaaaacacagaattagaagtcaagtgttcactcagctttgacaagttgtttaaactctctgagacttagtcattttatctataatgtgtatgatattttctttttattttattttattttattattattatactttaagttttagggtacatgtgcacaatgagcaggttagttacatatgtatacatgtgccatgctggtgtgctgcacccattaactcgtcatttagcattagctgtatctcctaatgctatccctccccccttcccccgatattttcaatcaaccaaaactgtgtagattagacacagatatggtgcattttaaattatcttgcaaattataaagttcttttaaatataacagatcattagattattagctgtggatgctcatctacccatcaacaacagatgaagatagtttataagtggattcaggttatgcttacaaattttccagaagctatcatccaaaattaacctacagagaaggtaagtcatatctagaagttatcactggtctccagattccaattaatgttctatcaatcctgatttttcctctacttatgatagtgataaatttaagagtctaattgggctttcacatgtggttttcaaaagtcacttaaatgcaaaatgttcgcccttcctctttaaaaaaatctaaaattgctactagtgcaatgactacaatggcatcacgattgcattgaggtgtctaggaaacagttccattagtcaaagggctgaggtaaaagtgatgatttatgttggaaaataaaattaggtgtatgtttcaagcatgtgtttaaactaggggtaaattaaaaaaaaaacacatgtgaacacaagtaccaatattctccatctgtaagaaaattattaataataattttagaagtattacagaaccagacagcaaaatttggaatcacagctgcttttccacaaacggtttcttatgtttttaaaactggcatattccacaaactccacagcttaaactagccttgcattgaggcatggacattataaataaaactattttatgtcagtggtttgaatgtaagtatgtagcttttaaatctgcataatgtcagggaagtgaagacttataaacactgtaagatactttgcaagccttagaagacagctaaaattcagaactgaatgactcttttatgaagactttctcagaaagcaatacaaattgcactagtactgaattataaagtttttttggaaattaataggaaagttaatacaacacatttccataagtcagtcatcttttttcctatgatattttttgcacagttctagcaatggtatgtagaattttatgcaaaattttgtatgttgatttttcttacctcagaggatgtcacaaacttttctctgtgactatataactttttgtaagagttttaaaatgtttacaattatattaatttaacatttatttgttcaaagcattcatagaccaatcactgtgctaatgttttaccaggagccagagatacacaatcttaagactttgccatcaatatattcaaactctaatggagaagaataccaaaatggataattaaaatgcaaggtagtcgatgaaatatagacacacattattatgagggtccagagaaggactaaatctagctccagaaggatgtcacactcactgatctaattgttcatggatgaataaaagttaatcaatgttagcactggatgagtattctcaggtacaggagacttggataatgaaagtggcttaatgaaaacagcctggaattgtatgaggggaaacaaacaaacaaacaaacaaaaccactgtgggatggctaggatacaaaatggaaggtagagtggtgagaaatgagcttgcatttgtaagcaggaacaaatcatgggaagcctctatgcctcgataaggtatatatgccaggggagatcaatgcccggttttaattagggaaatgaaatggccagatgtagatagcttatattagtggctacaaaataggagctggatttcagtggaaaaggaatcaaaatctgggaatagtaaggagtcagtttcaagataaattcagatgagatcgagcgcgttcagggttgtatggccatagactcaagatgaattcaatgaacattttcacataaaatggaatgactaaagaaataattatatcatcatcttcacaatagtgaaaatctaatattcattgtggacctattatttgtcagaaatcgatctaagtgttgtagtagttatatgatcttggttaaccaaataagatagataccactgttactactatttcacaaatgaagaaactgaggcaagaagaaggtatgcaactttactcatggtatatttttagcaaccgacagagtaaggattcaaagccaggcacaggtgatatgatgtgatgagtaaggaagtgggaagaatcatgcaaaatgcctagtttctagctaaatttaccagaatgcagtggctccaactgagaatcacatatgagtggtttaatgtgtatcacagtttaaccattttcctattactgaacatttatttcatttttctaataatttattataactaatagtacattgaacatcattgtacatatacaattccatgttttgaattatcttctttttatggaaattaatacacgtaattttagtcttcaacaacatatatcaaagttcctctaaaaaacttattcatactgcctattttttaattttcttacataaaacattaatattctgaccttttagaaaaacaacaccaccatttaaatgtaattgtagaatacatctttttgttactattgttcaagccttctgaaaatttcaaaatgccatttaaacgtaattatagaacacatattttgtttttgtttttttttttttgctgttgttcaagccttctaaaaatttcaatacactcacaggttatttttacaatgactagggaacacctccaacacagacagcacaaggaagggccaataaggtctccattgagaagagcagaatgactcagagatgaagcacagctggctgctttttagatcctaaatatgggttttgaaaaagtcatatgtgtctagaatctcaagggcttacaaatagaggacaatattaacctagttctcagatgtctttaaaaggagtgtttatttaacagactacaaagaattcattttaaacagtaaaactggcagtcaaagatattaaattgcatatttttccttattttgtttttgttctttttttttagcaggatgggtttatactcaaaggaacaatctgtcatgtttaattgaaataatgaccattgcattccctattattttattgacagttaattataaaaaatcatatatgttgaatttgtgaccaatagccagttgtattctgtgagttttacagtcagtccctaaacagagtatactacatttattggtccacttcttctctgaatgtcacacattcattggcttgcggaattccaattaactctgttcttagtggcacactgtcacagcaattcccttgccctctacctattctgcttgacagctcacataaaaaactaggctaaattaggacaccaatgactcacagagacttgagaggccttttacagctcttaatgcttagactgtatctaggaattctatgacatttctttttctcctttggttaggagaatccctagctctaataattatttcaattaaacatgactaactaacttacattcccaccagcagtgtataagcgttcccttttctgcaaccttgccagcgtctgtttttttttgtttgtttgttttgttttgttttttttaatttaatagtagcctttctgactggtgtgagatggtatctcattttggttttcatttgcatttccctaatacttactgatattgagcttttcttcatatacttgttggctgtgtgtatgtcttcttttgagaaatgtctgttcatgccctttgctcatttttttaatggggttggttctgcttgttaatttgtttgagttgcttatagattctggatattagacatttgtcagatgcatagtttgtaaatatcttctcccattctataggttgtctgttttctctgttgacacttcccaattttagaggttttttcataattgcttttgtcttcatcatgacgtctctgcctgagctgatgtccagaatggtatttcctagattttcttctaaggtatttatagtgagaggttttacatttaaatctttaatccatcttgagttgatttttgtatacagtgaaaggtaggagttccctttcaatcctgcatatggcttagtcagttatcccagcagcatttattgaatagggtgtcctttccccattgcttttttttgtcacctttgttgaaaatcagatggttgtaggtgtgcagctttatttctgggttctctcacctgttccattgctttatgtgtctggttttgttccaataccatgctgttttgaatgttattgagattctgcagttatttgttacatagtattcttgtggcaataattaactgatgcagggtggtaaggagaaattcattagctcaggtgaaatgctcagaacagtgcctagcacactgtatgtgtccagtaagtattaagtaattatttagttatttgcatttgcacttttagaattctaagaactgtgttttgcaaaggaaagtttaataaatatctataagcatattgactaacttggcataaagtactaggcattttattctaattttttcaatcataagatgaggttgcagtgtacaaaaccaatagacaaaaataagtagcatttttatacataaataatgacctaactgtaaaataaatcaagaaaacagtcctattaacaatagcttaaaaaaaaccctaggaataaatttaaccaaggaagtgaaatacctgcacactgaaaactataaaacattgatgaaagacatagaagaagaaatatataaatggaaagatatcccttgccaatgtatcaaaaaattagtgttgttaaaatgtcaatactatgcaaaatatctgcagattcaatggaatacccatcaaaatcccaatggcatttataacagaaatagaaaaaaatcctaaaatttgcatagaaccgtaaaagactccaagtagccaaaacaattccaagaagaaagaaaaagttggaggcatcacacttactgatttaaaattatattacaaagacatagtattcaaaacagtattttactggcacaaaatagaaacagtccagtggaaaagaatgaagagtcaagaaacaaatctaaacctagatagttaactaattattgagaaaggcacaaaaaggatataaagtgaatgaaactgtactcttatatcatgcacaaatatcaattcaaaacggataaaagacccaaacataaaaccaaaaactataacattcataaaagagaatgcatgggaaaaacttctgggcattggccatggaagtgatatttaaaaaaaaaaataccaaaatctcaggccacaaaagcaaaaataaataaatagaattacaaaaactaaaaatcttctgcatagtaaaggaaacaatcaacaaaatgaaacagaggtatggattgggaaaagctatttataaacaatatatctgataaggggttaatattcaaaatttatgaagaactcatacaattcaatagtgaaaaaaatcacccaattaaaaaatgagcaaatttcccgaacagacatttctccgaataagacgtaaatatggccaaaagatatatgaaaaagtgctcatcattaatcatgacggaaatactaatcaaaactactatgagataccacctcaaccccattagaatggccactaacaaaatgttataagagccctagggtttaaaactgtctcagggaggctctgctttgttttctgttacagattctgacttcctcctctggatccttgcagcagttagtttgggatttttttttctatagcttcctcctcacagctgtttctttgagcaaaatggtgactgtggtgctgatggtgcaccatgtctgatgggaataccttcagtggtatcaaccggcgaaatgatggtgttgactgtagtgttcttgagacgaagcaataaatgaagaggaggaaggacagtggtaaagaacacactagaaccataggcattggcctttaaggttttagaatgactgatattttagatgagtttatttgacattgaatgtccatgggcttctgagcagggtttcagtttgattaacagttgcaacaacatggggcagctgttttgctctttatcttcaactgtacttcagataataaccctgaagcacaagataaggttgggcagaatgctgctagagaggacaacctggatggtctttattctcttcaattgtccctctacatcatctggaagtcatctcttggtgtcactcttgcactttctttgtccatgctatagctgctcacacctagtgagtgtgtggagaagagggaatacgtatactcttggggtgggaatgtagactggtatagccattatgaaaaacactatggaatgttctaaaaataaacaagcaaacatagaaccaccatatgatgcagaaatctcactttgaggcatatacccaccctactccccaaaatgaaatcaccatctcataaagataactgcattaacatgttcattccagcataattcacaatagcctagagagggaagcaacctaggcgtctgtggatagatgaatgggtaaagaatgtgtaaaagaaagagatcttgccatttgtcacaagatggatgaacccagaggacattatgctaagggaaataagccaaacactgagggaaaaatagagcatgatatcacttatatgtggagtcttaaaaaattcaaatatacaaagagaatgaaacagcagttaccagaggttgggagaaggacagaggggagaaaataaaatggagaggtgtatctcagaggatacaaagtagcagatgtgtagaatgaacaagtctagagatgtaatgtacaatatgcggaccagaggtaataaaatttcactgtatgtggaattcatactaatttaatagaggttttgctgtcattgctacaaaagcaaatacaaaaaatgggtaattgtgtgacataatggatatattaacttgctttagtatagtaagcttattactatctatatgtatcccataatatcctgttgtataccttaaatatacacaatttgtctttttaaaatgttcaggttagctgggcacaatggcttttgcctgtaatcccagcactttgggagaccgaggcaggcgggtcacttgaggccaggagctcaaaaccagcctgaccaacatggtgaaaccctgtctctactgaaaatacaaaaattagctggccatggaggcacatgcctgttagtcagttacttgggaggctgagccaggggaatcatttgaacccggggggtggaggttgcagtgagccaagatcatgccactgcattccaggctgagtgacagagcaagactctgtctcaaaataaaataaatacatacaaataaaatgttcaggttataatttatatttccattttgggtcttttagtaaaaaaatgcattcctaatgaagcaacttcccaaggaagtatatacccaaataaataataagtgtactacacagttcttaaacctggctttataaggtctaaattgaaagacattttgaaataacaattatataattataattgtgttatatatgatgaaattaaaattttataattgtattgactgatatatatgagtatctgtgtgtgcgtgtgtatatatatatatatatatatgtttgtatgtgtatatgtgtgtgtgtacatatatacatatatagttaataaaagacccatcccacaggtttgctttttagcaagttctatttgtgacacttcatattttccttaaaatgaaaacaaaaaagtttcacataatatcatacagaatgaaattcacacatgcaagggtgacatgaagaagtcattcatctaagtaccaaaactaagactaaaatctagatctcttgtctccttattcagtattactggcataatgattttaatggtaagcccctctcctccagtacattgacttaatgagactgaaaagagaagtatgcttattaaagcactgcatggtgctgggaaaagtggaccactgaaacctctctttaagagaccctacttcagggagcatagctgactgtcagcctccagttgtgcactttcacatccaacacagtatctttgccaaggccggactttcccaggcttctttaagtgattgagcataggggtactagaactgagacatttcttattgtttggggtttcttctgatctttgctcaagaacttcctatcagccaggcaaagactgcctaagaactatactgcattttgaaggttttcttcaatcctccttcctctgtctctccttccacagacatcagatgagtataagtgcctaaagtctcttcctgtctgttctgctccatccctttcatctttcttgtttcccctataaatactgtaatcaaattctatattgataactgcttcttggaaaatctaaactgaaacactataaacaaatgatttaaaagtctgctgatcatcaactgtgactatctaatgccaggtgttgaggatattactatacataagaaaaacttccctaacttgaagagctcaatatttagtattggtaattgttgtttgtattaccttcagtacaatttgctaaatcctgtaatccagaggtctacaaaatgtataagaacttgagaggatgttatttcttctgctggaggagctataaaagatttcacaaatgagctgacatttgagattggccttcaagtatgagtaatatttttttaatggaaaatactgatgggaaagcaggttggaagagagcattccaaacagaaagattagcatgaatatagacaaagctgcttgaatataaatgacatgttaaaggcaaatccaacaagtttaacttattgtagaactgtaattgaacagccgtatataagatgtttccaagggcacatcatagtttttcttagttgtcttgacagataaatgtaccttctctgcagaatcccagactttatgggaaagggaagtttggggactgttgttagaaggagctttgagggaaagtcagagttttatatgccatatgcaagaataaaagaaacagagagtaagtttagcatagtgattcttctctgtgctcagtgaagtcagtagcaacaacagcaacattactggcaacaaagagggtgttcagactgcagaacgcagaagatatttgcaagtaggcagcagaaagacatttcgcaaaggaggtaccaaataaggtagctagagagaaagttggcagaatcaaaggaaaaatgtgcaagagcttttcacaggaaaaaacaaagaataagctccatgaactaagagagagtataatgaattatagctctgaaaaggaaatcacacatgagagaacagtaagtggttggggccagagtaaatgagcagagggttagtaagcttcatgcaatacactaagaatgacagaagaagatgattagataaaaaacatgttagttgtgtacaattcactcaaaattttaggtccataatattatagttttatcaggctaacttcagcacgtatcctgaaatgtttggttgatacttatgaaccatccggtcatagtactacctactgaatccaagttccagctctgaattcctgctgaattacttattagtttgtcaatcctggcaattatttacactttctatgtggtagtttcctaacctctacaggtggataaaaacaatgcttaccttatagggttattctaaggattaaatgagagaacatgaaaaagtgttttagctcagatatagcatataggacattctcaacaaatgttagctattattaatagtttaattatcactagtaagttacaaaaactctataaacctcaaacatcttatttttaaagccaggataaacaacactattttcatgctgtaaagatgagagacaatgagcataaagcaattggcctggcacctggaacatggcaggttatccatacatgcttttcttctttcttctaatccctcactcttccttcttcttcctcaattattgctattattattatcattattattttgtaactagattaatcttatatatgcaattattaaagaagagaccataatttgaatagtgtttagaataagagcaattaaattatgcagtctttctgttagttatatttccctttgctctaaagaactgtgagtaaagtgaagactgtgcataatagttcaacaaaatatgacataatccaagagctgaactctccaaacaatccattaaatatgaatacacctcttgtgactgacttcataaacttagcaattccttgtgcagagtctgaaaattgagaaacaataagggctgccttttcccaggagagctgtagaatggctgagcgataatgctgagaaaaaagctacacaaatggaaatggaattcattgagatgttaccatgcattaaatagggttttctaccattaaaattatatttactacttgaggtcaccaacatgggggagcgactagatgaaaaacattaaaatacatctaatattttattacatcagaacctgagttgaaaagcagtgtcttgtggaaattgttctcaagttactgtttggatgtttaagatgttgctcaggtctataacaaatgtagaggtgccaaacatccacatttatgttaagttgtcccgcacccaatgcaaataagatggtatataaaacctttgtatcactggtcaacttaaaggctacacaaatactatattcacccatataggggaaaatacaaatgctctattttggcattgcatgtctttattctttagatgtaatttactgtgaaatatagaaaatattataaaatgagtttccagatttaaaaatctagtaaacactagtttcagctttcaagatcatcaaagtagttagctattactcattctgtaatttgtcaaccctcaaatttgtaaaggaaatagatctttctctctagtagtagccactcttgttcatatgtaacttggaaaatatcatgtaacaaagtttacatcatttgccacctgttgatttgtcccagtcagctgaaatttaacatgccatttgccaacttccaacatgatttgtaaaacattaactataatcaagttttctacaagttttactctgttcataatttcttaatatccatagtctacttcccactcattctgttttcttccctactcaatctaagtggatctcattagagagtttatatctttaattatgatgcatcttggacattgcattaagtcatgactaaagtaatgcataccataagccattcaagaggggcagccccaggagaaaagaggactgggccagatgatatggtaccaatgctaaagtctcagtttaactacttactagatataaaacagaaaagctgacataacttcataattctaataggccttaagatactatccagactattctacctcattatataagctcaataaaatcagaaagctaatcactattaaaatctggtctcaatctgaggcttcccaattctcaatgtattaatgttagaatttcattgcgttctgtgttaagaatctactgcttcttttaaaacaggaatgataaattctcatagagtactttgagaattcaatgaggtaaaacatttagaagaactctgaaaactgtaatttttctgcaaaagattatcatcagtcttctgacaggatactccatggtatgctttgtgggatcttcattcaccactagagggaagtgatatccatattgttacttttctctcccttgaaagtcaaatgcttgctaatttttctcttcaaaagggggaaaacaccttggtcaattttctttttttcctttgcttcaaagacaatcttttaggatgtcaacattttaggtggccaatctcaaaatgggctgataatgtactttctccttttatcagagaagggatgctatgctttctagtgcttttctctttagctggaagagacttttctttatttagggtttatcttcattcttagcaagttaccagttgatatttcttccctctataaagctcagcctttaatatcaaaatttcttaaacttcaaaagtttatcagtaaacttcatatttttttcgccacatttctgtttaatttgtattagacttttttcctagaaaatatttattgaaacaacataggaaatatcctaacacagtattcaaaatatgtttagtattaaatgtttaatctcaattcttaatttatttgatcaattaaaccaagaatttagcatcagagcatctttgaatgctactcataacagatcactgaaaattcaaactaatctattttgctgttttcctgggctcagcctataagactttgagttgctctactttctttttcttttgtattgaatgcccaggaccaaaacaaacaaacaaactactctaaaccttaaaaatatttctttctaaacatgccatgttgaaacagacaatccaaacctggtatatttttttaggtataacattaataataataataatagcagctatcatgtcctggaccacaggccaagaagagtcctatattgatgcatgatctttattgatcttcaccacaaccccgttaggttaggcactgtttttatccttttttgaaggatacgtaactgagacttaaagaaattcagtggtagtagagccactattcaaattcaggcatgtctggctctagcacacaatcttaattactatgatacactttcttaacttacatgtatgattcatgtaatgatccttctcaccactctactccggagaatttaatcaatgcataaggaagagtttaatactctcacccatattcaaatcattctaaggattagaatagttttggttccttaagctaaaggaatgttaaactgatgttaaatgctgatctctttactctcatgagatgaatataaagggactcaacctagcaactctgtgccattctctagttgtagctgtgcttgaaaatatcataattaaatttcaaagccagaatatttttgaaagatgaacctttcaaaaggctcagttttatcagtaaattataaacttgtagagatcaagaaggttgggattttacctagaatttatgaacataaatttttcctttaatgtgcctaccaatgacacttcttttcaatcttcgcattctgtgtatttaatactttaggtgcctgcaggttaattcacacttgtagaaatggcactgtttaattctttgcaacagcttattaattggaaataattatacatattcttttagagcctatacttttaaaaatgtgttttcttcacaatgtttgatttaaaatcaacactgacttctgttgtatatctcagatagtgcttataaccttctgcttaaacaagaagagtcctttacaattattattactcatcctaggagatatttgtaaattgtatactgtttgcaattggtacacaaaaatctcaggagacaattgttagctgacatattaaatggaatcatctccttatctgcttcacagtgttattaaatttagatttaaaaacaattccctgagttctacactactactgttctaataagaattaaacaattattatgatcttatttaaacaatagtaaggccatcaagttaggaaggtcacttcaattttgaatgacttatagccagctctggattgcagataaaaacaaaacaagaaagggattaattcttaacctttactctttcttcaatatctattcttatatccataaatatatgcccattaggaagaatctttttcttatcatctaatgtgaaagtatattgtattttgtaaaagtaacgcatttgcacattcactttcaatagtttgtcaacagccagcttgatgcccactgtctcattttttcactgcaggaagacagtctccctattcaaatgataaattgcacttttggcacataataaaaatctcttattttattttccttttaaatatgtaattacgtttttgagctatgtactcattcttggaatgttctctcccaaaagccaaacaatgtagcaattattttcttacctctctgtgaaacctaatttactatgaagtacaactgatgtacttggaatttcagacttcttctcacttcttcaagtttactcatattaatcttatactctttcccacaagaagctagaaaatttcaatgtatctttcaaacccagctcagctgagtagatgtcaaatgtttgaaaacatcttcttgactttccatgctgtggtacctctgttctgagctcccaaaattgtgttgtctctcctcactgtatatatgtctttcgtccttgataaggaactcttaaatgcttggatgcattttattcgtatctatatcttgagtgactagtactatgggagtccaaagtaggcccttagaaatgttgtttgtttaatgattggctaatgaaaccataaattatcccctgcataagaagatagaggttaagaggttacattgcttgagagatatttctgttttatacatttctttctacaaagcaagtagatatagtaataaccaggcacacaataagacaactggtattatattgttcatgatacaagattgttatcttcaagtcatttgctgaagaacacagatgataaaagaaatagaagaaattcaaatgtagggctgtgtgacctaatgactggaccttgatcattagtgtcaagtggtaaaatgtaccgtgaatatcctttcatttctttcctacttttcctactctcttttcccaatcctcatttacttatttctttaattaatagcactaagaagtcatcgacctagaatctctaaatttaatagttaaaatattttagtaacagggaaaaatattggcatactagccacgtacacatgaatgaaaaattttaattccatttgtcatatatagctatattaatcacaacttgataagtagtcagaatacatccatccatacatgtcaaaactgtaccaaatgctgcacatattttctgaagaaagttaatttaaccccttcaattatcagttatttgtatttgtatgtgtgtgtacagacacttacttgtgtgtatatatgtttacttctatagaaaatatttagcataataattgtatacaggtatttgtgagcatctaggatctaatttacatgaaatcccttgataattgtaaaatgcatgaaaaacgcttactgataattagcgatgaattacatagaactgagcaaacatggctttaggtatctatatggaatggagatatttaattttaatgttccatttttattggaatagttgtttatcaatccataatgcacacagataatcacacaattttactttctgtcaacaaagaaatggtattcctaaacatatacttcaatttaattttgtttctatttattaatatatcaaatttctatgtctatgacattaacattttgattaaactttttatagaggcaagaaagtatacatttgataatgtacctgaatagctaatgattatgtataagaaaactagggccactaaactgctctttggaaataaatgacctgccactctcattagggaacataactaaataatttttgatatgtatgcaaaaattaacttacaatattgacataacatatatactatgtaatgttgaaagaacttcaacccattaactagtctgtgtttactctttagtttttatttcacatggattctgctacttattttttgtcattttgctggtttttgacactctgaaccatgtgtaaacagtggcttaattttatagtttttttttatgttggtaaaagttttacttatagtaaaggtttatataatgattcagtattgattaatccctaagcctacagatcatttgatgtgatccctaaaactcccatcatacctacaggatactgaatgcataatgttctagtaacattctccagataactagagatcacattgctcttccaactgattcatagagtattattaaatatgtacatatcatgagagtgtggattgattctttctccctaaagttttaggttccttttgatctcaacatcgtttctatgtggttaaaagttccatgaatagttccaaaagtaaatctttatcattatgaggcaatacctgatagtttatgctgagatcataatacacacacatacacacaaagggagaatgagagacagacagagagagaagagaaatttgtagcatcagatgcttacttcaactggtttttgttaatcccataataatctaaaatcttttcttagacttcaggatatgtttcttatgataataaacatccatagggtatgtgtatacttcattataaataactccctgatagagactgttttaattcattctagaatccctttttctctcatttacccttaccaaattcatacatttattttatgataaatttttcacaatgcatatcaaagtccacctttaaactgtgattacaaatgaggcagcaggcaacctaaaaagagcatcacaggagaaggtaaccttttgtaaggccattcatatcaactgtatctatcttgcctaggccatggggtagagggaaacagggtggattgatccaacacttgcagggacttttagcaccagttggcagtgccatcttcctctcacaaatcaatactcagaagcaaatgtctgttccctaaggtaacccaggcaattctccccgaagatctctacttatcactgagtatcaatactgttttatctcatataaaattatagtctttacttgttttatttgaagaaagtacatttataaaatagttttggaacattataaacattttatttaaatgggtgactcaagcatgttggtttaaattaaaccacatgcttgggatattcatagagctatgtaaggactatattttatgaaaatgcagggtgctgagcagcaaaatttaatctggagggcacttgtcctcagtcatgtgcgacaagatgtattagccatgaatgaattgcagcagtgctacttgagtttctttaattttctaaaccaagattgtaaaaagaatcagtggtattgaatcccactggctatggcaaaaaggcactgctcagagataaagaacaatttatcttctgctgtaaaaaagagcagttttggcagatagtaaaatacatcactgtataatatactctaggaacaacatcagaaaatatggattttttcttaaaattttaagagtactgattccacataccttcccaaataaaaggtaatgatagtgctaattgcaaagtataaatattaaaaatctaaattacagtctaggagggcatatgcacatgactttatgagatgtatttttagcaatgattcagtaagaataatatttcacttaggtaactgaaatactaattaagcttccaatattccatgtattaccactattatatcaaattgcatattgccagattagaatggtgggcttcttctagatgttattttacctaccaggttatagtttatggattatagagtttatcatatccagatatttataaatatcattaaatggtaggatggttcccctctttttgagatcctgctttttacagtttctttttctatgtgtaatacttataagcaattaggttattgatggcctgatcatgtcttatttgtttctttttcttattcagtacaccaataatatttaacacactttaaaagaaagcagcatttaattttgagctctgatttttgaataccaggacaaaggagagaaatactagtaaatgatggaaccactcactaatttgggttttaagtatataattaacttttctgctccttggataaaaggagcactacctccataagacaatagaaaaatcaatataattaatatttgtcagattttgcagatgattgaatgtgtacagctattgttttgtcgatgtcaccaaggtaacactgatgctttataattgaaaagcaaaacaagtgtttccttttctatctttgcaataatttcatacagaatgatcaagaaagttctagtccagaaaaaaatctattaatcagtactaatataatgtgcataaagtatcagtaaaacaagcacacaatcaggaatatctctttaatataattgatatgatagtgattcaaaatggaaaatttagggactatatgaatctgccaaatttgtggtcgtgcattataaagctaattataaaacaagattagagtgaatgttagctcctgatatcaacaccatcactcccttaagcatccatcttgctgggatgacttggaacaaagaattagaaacaaaggatccttaaaagatcaaaatatattttaaggccacagatattatttaattttctaactcagtataagaaatatatatatttttcatattatatattcatttttaattatatgctattattttctgtatacttttatacagatacatacaatctgtaggcattacatgtatatttttaaaaatataaaaagaatatttttaaagtgttcatttttaatcatattaaggtgtatcccagatcaaattataaccctgaaagcctgcctcccatacaccattttaattttgtaggacttagccctatagattaaccccaaggtttcacattcatagtatatacacacagttagagataaaatatagggatgatatgcaaattattaatgatcttgatctaaggtatcagatcattgctgtcattcaatgagcaacaactttatacaaaattttaaaaatactgaaggtaaattttttagaattattaaaatttaaagagcatatagttggcaaatctacaaaagtcacatgaaaattaaacaattgaatttacagaaaggatttgaacacaataaatggcattaatatttgaccaaatgtttgtcttacttctctgtgtatgtgaaaacagtgaccctgataatatatattatataatatctctctcagaatgataaagggaaaagggagctaatatttttgcaagtatactttgtataaggtactattcaggaggctgaaacaaatgagaagtttttatttttagtagtatcatggtgtattatataaatattttattttccatcaaactttgagtctcaaaagtaagaacatttttatcaggaagtaaccgctgttagagtgaaagtccacagcaaacatgctcaggaaagttgccaagattccctagctgtttctctcaaaaacatgaagatcaattatttcactcagaaataggcttaaacattttaccttctgggggatagtaaaaactgaaaataaccaggaagctccttaacctcacagtaaacactgttttccacagcacactggagatgatgataccatgaaagcatctaataaatgtgaagatctagaaaggattttgggaaattgaatttgcttttcacaaaggggattttatatttgtcttccttctgtctattcatctaaagattcttaattcatgaccacatgtcacatgaaaggcaaaagtagcttttcagagtttctaattggacattcatgttgtatcagatgttttcattggcctcagctcttctgcacatcttgaaaggccatgcaagatgggtttcaaatggggatgatgcctactgtgtcatctgccatgcacggtgacttacatatgcatacagcccaagcacagtatgtgcacagcatgttgtatcttgaacatgaaagaaggcttctccctcatgcatgtgtttgttggcatctttctgtcaatcttaccattatgcatcatgacaatgaggcacaaggatttatcaaagattgtcacatagctctacattcaatatccatgcttagccattgaaacaagccaataacctaactgaaggacgttcattattataatatttttaaacaaccacaacaaaagtacattagaaaagctagagttatcacttgaggataaagagctactgctcttagtgttgtttattactttcctaatagtttcaggttttaccactcatgactctaccaatgcattcttaatgggccgtacatagttcaaattaattgttttcctataaagtggtgggcctaaactgcttctacatttttgttgccaagcataaaattcttttaaaagtccacgttaattttaattgaaattattcttccgaaatgtaataattcagatttttttcttattacataatgtaatgtcttcatttaaaaaaaatagcaatttgacaatgatacaccaagatttttttcttagacataaacatgatgtattttcatagacatataaaaaaacacaaaatatttatttgtatgtttctgcaaagccctactggatatggtcaggaagttaagattttttttttttggcttaacagccatatagctttattactctatatcatatccagggaccatatccaatgtaaaattcctgaaagtacagacagatttaggaatgattgataccttttatatacaccttgtaagatactgcatgccttgtgtggccattacattataaggtgttatatatagtgtactaaaaattaacaccaagctgcaatttttcttgttgttattgtgatggtactgatgtaagtttggggaaaactgagagcagttttgtagactcaacccaaaggcattttctgcattaactaggtaaattagtgccttcctccctcaggttcactcactcccttcttttttcttcctttgaatgagttaggtattactagaatctatgcacaatctttaaaaaaatttgttttatgacaatgaaaggagcgtattgtggagaagtaaaaaggagattcctaataatgctaaataagttgaacatcccaaatctgaaaagccaaaatctgaaatgttccaactttcaaaactttttgagcaccaacatgatgctcaaagaaaatgctcactggaacattttggatttgggatttttaaattagggatgctcaacctgtatattgcaaaaatttcaaaatctgaaaaaactctaaataaaaaacatttctgtgccaagcatttcagataagagattttcaacatgaatttgttttaggtttcaacttcattttttatttgcttttgtcttaactcatgctaaaacgcttactaaaatatgcacctattagaacattataggaaaaaatgcaattttatacttagaaaaataatcgctggctgggcacagtggcccatgcctataatcccagcactttgggagtccgaggcaggcagatcacctgaggtcaggagttcaagaccagcctagtcaatatggtgaaactccatctctactaaaaataacaaaattagcgaggcgtagtggcacatgcctgtaatcccagttacaagtgatcaaggatgatcacttgaaccggggtggctgagattgtagtgagccaagatcatgccactgcacttcagccttggagtgcaaagagagactccattaaaaaaaaaaaaaaatcactacaagagaaaaaatgacttacatgtaactacaataaaaggatttctggcaaattgagataataaggcatagtgccacaaaaagtcattttaataattgagaatgaaattaaaattttaataaccattttctaattttcctgtgtgccatgttacagtggcaagtagatttaggacaacttatcatataattttggacaactaatcaggttgtccaaaattatctagcctctgatttctatttcagtagaatattccaaaataaaattatctgaaaatttttgtgatgttacctgagccacaggaaattgaagaatacacaaagagttatgtatcatggatttttatgttccactagaagtcaatgttttattgttcctacccccaaagtgatagatggcaaaatacaaataaataagtcctaaaagttaattttaatcactacagtgaccaactattagaaaatcatattctttagtatttaaaaatgagtatcggaacactgcttagatgcctctcatttattcagtcttaattttgcaaagcagaatggttgcaaatataggtttattaacagaagcactacttttgtcattttgcctttagacttcaatatattatattttatattttgaactttgcaaaaataactgttttagtctatcacgtaacttgatagccaatgagctatctctataataaatgaactagattattgtacactagagatcaaatatttaaaaatgagtttttaaaaggcaatcattcataaattgattaacaacatagaattataaacatgccactttattcactagcacaggcacaaccaacagtccaatgcttgacaatatatatttccaaatgctgaaacgtttctccattttcatctgcaaaataaattctctttcatataatattacaaccagcgaaagcatttagattcccaacctacagacctaaaaatagaagaccctagcaaaggaataaattaaaatatattgccaaaaaaatggagcaagccacttctacatttggtaagattctatgatttaaaaacaaaataagactttcattagccctgggttaagaaacagtcagtttagatttttcggatgaacccaattaaattttaattcagtattttcctttgcattttttgttgtatgtgtcaaggccactgtattgcacaactctgtcagtttttcagagagaaaaaggcttttgtcttggagaatataatgttccattgctctctcctggttgctgaaagatctataattggtgggagaataggcggaggctgctggtatttccccaagtagttttcttcctgtggaactgaaaaggtaccttcactttttagacggttgcccaaaataaataccatatttctagcctccttgatagctaggagcgtacatataactaaattctggccaaaagactggaggtagtggaaaggaaaaagaccgtttgtctggcaagcattttacaagaagactatatgactttgccttttccagttctctttcctattcctagtagctgacatgagatgtaatatgggaactgaaaagacttaagccatgagacaactttgaggatagggaagatgcacattgtcctagcaacaaggtggaaggagcctgactttgtgataggaaaaccatactagccctggattactaacctctggaaggtaatgtgtggaaaaaaaaatttctatgttattttaacaactgttatttagttgttttcttttttaacgtacagccatatctattcctgatacaaggagaatgctgaatttgattgtcctgatactgtttttttctgatttataatactcttctttgatctttttaaattgtatgctctctttgattataataacaactagaagaaattacacatcattccagtagagaaaataatctgataaatgtggagaaattgcgggtcagcaagagtaacagagaatgacatcttacacttaaacaagaatgtgatatgaattaaagattgcctcaaatatttatcttaaaataagttttccttatttttactttatttctttaattgacaaatatcaattgaatatatttaaaaattgattgtgatattttgttctatgtttaagttcctcttatattccttacccagtctcccctaatgttaacatcatatatcaccacagtacatttttaaaaattatgaaaacaacgttggtgcattactattaactaagcctcagaatttatctggatgtcacctgttttgccactaatgtccttttgcccttcaaggatccaatccagaatatcatatagtatttagtacattggagatctatctagatagacagacagagagagagagagagagagagagagagagagagactacataatatgtatcttgggggctgcataacatgtatactgtaaaggggctgcataacatgtatactgcgctactctggggggggtgccatgcacattgctgtgccaggtactatttatatgcttatctatcaacttgtttaattatcacaacatctctagaaggtagacaatataaatatccctattttaaaaatatgggcattgaggacaaagagcttaagtaaccttaaaagagcacaaagctaataagtggagaaattgagattgtagttacagggactgtgcaattagagacacttcaaattcgcaggtttcctatcccatttaaccagctatgagaacacaattcttatcccaacaaactgggtgattgacattaaataagtcaatctctctggacctctttttgtgcatccatgaaatcatagaagtggattacataatctataaatgtccctaccttaaaaacaaatctatgaaattgcaatatgcatttttaaatttaatttctagctcagagacctactgcattttttactattttcaatccactttttaaacataaaatgttcattaaaacagaaactacacatctaacaaatgtctaataccaaaaatctatgaggaacttaaataaaacagcacacaaaaaacaaccccattaaaaaatgggcaaaggacatgaacaggcacttctcagaaacacatacatggagccaacaaatatatgaaaaaatgctcatcattgctaatcattagagaagtgcaaatcaaaaccacaatgagacaccatctcacaccagtcagaatggttataatcaaaacatcaaaaagtgacagaggcaggtgaggtgccaagaaaatagaatgcttatacagtgctggtaggaatgtaaattagttcagtcactgtagaaaacaatgtggaagtttctcaaagaacttagaactataatttgacctagcaatcctactattgggtatttatgcaaaggaaaataaattgttccaccaaaaagtcacatgcactatgtgcatcacagtgctattcacaatatcaaagtcatagaatcaacctaggtgcccatcagcagtgggctcgataaagaaaatttattacatatacaccatgaaatactatgtagccataaaaaagaatgaaatcatgtcctctgaagctccatggatgttgctgggagccattatccaagcaaactagggcaggaacaggaaactaaagattgcatgttctcacttacaggtgggagctaaacattgaatacacatggacacaaagatggcaacaatagatattgtagactcattgagcagggaaggctacgtattgagcactatgctcactatctttgtgaagggatcattaatacaccaagcctcagggatatgaaatgtacccgtgtaaaaaacctgtacatgtacccccaaacctaaagtaaaagtagaaaagaaaagaaaagtgtctaaatatgacatgtagattttccttaaaaatacaattggaattttaataagcaatagtctcactccaaatatttagaaattagaagtagctaaggatttccactccaatgtaagattgagtgctactttgagttatgacacgttttcaacctaacttttcaataaagaatgtgttcagaaagagtgtattttattttagcacttatatgtatttgctagattatatactttactaataataagttgtctttaactgaaagatgcacctttatatatgataagtgacaaaaatcatgtactattagtgataaacattctccttatatactattataaaatgatttaacaaaagttgtatttgatatatgaatgggtaatgtagactctactcacttgaaaatctctctcatttactccaaaggattggaaaatttctaatgccttcattttacattgtgtggaaatgacagataattgtattacatacattttagcaacaaaacaacacatttcatttaaaagtatcttcctttgttaggtcttataaagtacttggttatagctttgaaataaagtatattaattcatccaatattaaatatttgcttcactagtataatataaaaaataatttttttatattttattttattttatatttattttattttacatcatatttacataaaactatagtgatacaaaatatcagtattttatttgtctcagagtttctgagagcataatattcataatttcacttttatatcacatattagtgtataatagttcaagatattttaatggcaagtaaattacatgcttgtactcttaacaatgcacgtaactcaagtaaaatgagaaaaatatggacagcttggacgaagtttgtacagacacatgcaaggacaactgtgttgtttctcttgcttacaaaccacaaaggttaaaatcacacgaattttaggatgtattataatttcaaagatgttaaaatgtggtggggggggtggaagtgtcttagaatcagtgaaattcagggtatgtgattttaccaaacagatgtcctatttcatgtctaaaagttgattaaatttatcttaatgaaacatgtaattttagtaaaaaggtatgagaatataaaattggaatggtcctaataactagatcaaccaaccttaatatgactctgccttgatcctaccaaatatttatacaagcacacagaattttattgtacttttctttgttatgctttgcagatattgcatttttcacaaattgaagttttgtggcatccttgctttgaataagtcttttggtaccatttttccaacatcacgtacttacttcatgtctctgggtcatgagttacctggattaccaaaattacccattttggtaattcctgcggtaagtcaaacattttaattatcattatatctgttacagtaatctgtaattagtgatattttatgttactattgtaacttctagagaatcatgaaccatgctcatatatgacagaaaacttaatcgataaatgatgtgtatgttctgcctgctccacttatcagccattcctccatacctatctttcccctcagtcttccctactccctgagacacaacaatattaaaattaggccagttaataacccaaaaacagcctctgagtgttaaagtaaaagaaatgatcacatacctctcacttcaaatcaaaagctagaaatgattaaccttaatgaggaagacatgtccaaaactgagactctaaagactagatctcttgagcaaaatagccaagttgtaatagaaaggataaattcctgaagaaaattaaaaatgctagctcactgaacacaagtgataaagtgcaatagctttattatggatataaagagtgttttagtggtctggatagaaggttaagccaaccacagcattcccttaaaccaaagcttaatccagagcaagggcttatctcttcaattcagtgaaggctaggagaggtgaagaatgctatctagaactttcatagctaaagaagagaagtcaatgccaggcaacaaagcttcaaaggacagggtgactctgttagcttggtggctaatgcagctggtgacattaagttgaagccaatgctcatttatcattctgaaaattttagagcctttaagaattatgctcaatcaactctgcttgtgtcctataaatagaacaaagcctggacgaaagcacatctgtttacagtatggtttactgaatatttaagcccacagttgagactacttctcagaaaaaaaaatcgttttaaatattactgctcaatgacaatacacttagtcaccccagagttctgatggagatgtacaaagagattaatattgtttacttgcctactaacacagcatccactctgcatcccatagatgaaagagtgattttgacattcaaatcttataatttaagaaatacattttgcaaggctatagatgtcatagacagtgattccactgatggatctgagtaaaggaaattgaaaactttctggaaaatattcaccatttcagctgtaattaaggacatttgtaattcattgggggaagtcaaaatatcagtgtgaacaggagtttggaagaagttgtctccaactcttatgggtgactttgagcagttcaaatctccactggaggaagtaaatgcagaagtggtggaaatcacaagataactagaaatagaagtggaggctgaaggtatgactgaattgctgcaatcttataataaaacttgaatgaatgataagttgcttcttatagatgagcaaagatagtggtttcttgagatggaatctactcctggtgatgatgtgtgaacattattgcaattacaataaaggttttagaatatttacataaaacttagttgatacaacagtggcacagtttgagaaaaatgactccaatggtgaagaaatgctagtgtgggtaaaatgctatcaaacaccatcacatgctgtggaaaaatatttggtgagaatcaattaatgtgtcaaacttcattatcctcttatttgaagaaatttccccagccatttctatattaagtaaccactaacctttttcaatcagcagccattaacatcaaggcaagaccctccaacagaaaaacgattatgacttattgaaggctcagaggattgttagcatctttttagcaataaagcaattaataaatattcaagtatttttaaattaagttgtgagctttttctagacataatgctattgtacacttaatagacttcagtgtagtataaacacaagttttgtgggcactgagaaaccaaaatgtcactagcagtattgcgatatttgctttattgtggtgatctagaaccatgcccacaatatttccaaggtaagcttctagagtgaaatgtttcaacaagaaccaaaatgctaggaacttgaaattgcatcaaacaaagttacaccgtgacaactttgtgatagcctgaattaaatgggtgactacataatacatttcttgactataatcacaaagattattcaattggttccttgtaatcatctttagatctactaaactccctaattaatgagaaaaaaatatccatttcctccttcctcaccattttttccctctccaacctgtgcaatccaaataagattaaaattgattttaggagtaaaagaatttttagagaggtaagccatcagccaataaatgctaacaaatacagccatttcagtcaatagtcatcgtatcagtagaacttctgtgtttctcagttccccaagcagtgatgtttgaaaagtcaagaatgctgagctttgagggagaaatactgttggtgctttgctctcattcacagcatgtgaaaacaatgcagtctgtttttcaaatatccagacaaattacatgctgacttccttcaagtattattatagtttgggttataaggacacacaaaaaaaactctattaaaataatcaaggcagtgttaatgagccttaaatataaataatatacatggatactcatgtttacttcaaatccattatacagaacaattaagaccttatgtttaatttccaaatgagaataaaatgttttgtaattaaatatgttaataggttaaagcctccaattctgaatcgtaagcaacactgaaattatttccagtctcccttccacaacttgtcatggcaaatctaaatcacattgttagatatggaagggcacacaacaatgcttaaaaaataaaatcatatgccctgtggaatatgatataaaacaaaaagcaaacatgaaactttactgatggaatcaaaactaagtgcttagaggtatgaaaaactgtattacattgcaaatgtaggatctcctgtcacaggattacaattggaaacaaaacaaaaaaaatcatcttatttcgggaaaaaagcaccttgattaaattgctaatatggaatttaaaagtggttttatattatccagggtcaacttgtagtgactaggttcttctgacttcctgttactcctccattcttacccaacccacatattaatatcagagagtctcttaactctatggccactacttgaagcttaaagtatggaaaaaccaaattgggttgacacagcaagactctaagagtcagaggagtaagggactgattctcaggcctttatctagagattgccttggtaatctctagattaccaagtaacatggaccaagcagaataaaactgcatattcaagcctacctatatttatattagactggaattagaacatgaaacttgttatagtcttctaagattttttccactcacaatgccttgctacattttttttttttttaatcaacttaaactttacactcaggtttaacaggtaatagataatttttgttaactaaaaaaaaatacttccactggacatgatggctcatgcctataatcctagcacactgggaggccgaggagtgtgcgtgagtggattgagcccaggagctcaagaccagcccgggcaaatggcaaaaccccatttctacaaaaaaaaaaaaaaaaaaaaaaaaaaaatacaaaaattagtcaggcatggtggtgcaagcctggtaggcctggctactcaggaggccaagttgggaggagtgcttgggccagggaggtcgaggctgcaatgagccaagattacaccaccacacttcagcttgggcgaaagagcaggactctgtctcaaaaaaaaaaaagaaaatacagataattacttagagaatatctagtatgtgtcaaacatgtagcaagtggctgaggatacagaaatgaataagatatctactatctggggtacatggtttggtggagaaagcaaagagatatacagctaactctaatataatgtaatgtgctaaatattatattagaaatttggttaaatatgatgtgagtacagatggcatgattaattatttggaagaggaaggtcaggaaattgtgtgaatgtgtatgggaaatgctatttttaaaaacatcaaatacacattattaccagatgattatatttgagccttggcacaaatatatttttgaaaatgtggcttactgtgagaagaaaacacaaataactttaacatttatgaaaatacctgaactaatagcaaacttgaatatccaagaaataccatgccctaaagttcattgtaagtattcagtgatattaattttgcacaggatgttaaagtgcttcataatttgatgctgctatttatacaacttgctatttttctacatttacaatcttgatcttatttaatggccacttcttccaatgagctaaccttgacattgtactttgttctcactctataaggtgatttttttcagaaaatagggatgactaataaattagagaccaaaaaggctgggttctcatagtcaagaccattaaacaaatgcagaaggaaacaagtcatgtttcattttatgacctcaagttgcatttcattttcacccatgaaagactatggctagagatgtagatttgctaaacatcaacataaaggtgaactctaaaatagctaaaatttcagaaagtcctaaagaaggctaaagatgggtatttgaggatatacctaattttattatagggagggagcagaaaaaacaaacagtacaaatatcaaagagattgcagtggtatgaaaagtaagagaaccagtagaattaatcacaaagactaacagagaagacaaatttacataagaaggggtactttttgaaagtataaatattagagacataagttattcctaacaagtggcaggcccatgaggaattggaaataagtgtttgaagaacatgtttaggatgaaaaaaaaaaaaagcactgaatgaaaaatactattctgatataacaggctacaaagaaagatgtaagtttgtgaaaaaagaaaagttaaaaaaaaacaaaagtcaatatatatgtacctcaaacatgtttatcgtaaagtagatatggaaacaattatttcaagaagcaaatatcagataaggaaaatcttatcttacttcataggattaagtgcatactcaaagaatttaacaccagataaacagaagaaaggggctagggcaaagatcaaacatacagtaaagaagtttagggcaatgtatgtgctctcactttgaacttctaattaaaataaaaaatgaaagtcttctttttatatatagaaagaatggagaaaaatttgggaacttggagaattaaaatttagaggagcctttgtggataaaacaataagaagtagcaaacaagttttcctgaaagcaaatcattgttaaactatagctagtaagaattcattactgttcatatcctatgtatactattttacacttatttaacaaacattacagatacatggagtctaacaaaagattaatcttttgtttgggaaagttgtttgttggaaaaacgttgagacatactggatttaatgtatcatcgtgctcagtatctggctatggtcatttttagataaatacttatttgaataaatgccaattaaaattcatgagattaaaaaacgcatttattagcaagtacaactagttagcttttactcaataatttacacatactcacattttagacaaatgttctaacaatttatagtacaaaaaagagcaatttgaacagtctgcttcataaaaatttttcaataattttgattatactgataaaggtgacgatttaacaaggcaatcaaaagaaagtgaactataagtaaactgacacaattccattccacatgattgtaagaataattctgcatattctagaaaaaaaaagttgatcggtttttcctcatttgtaaaagagagatcctgtcatctgggcatatagtacacattaaagaatgtatggctagcagtaatagaatagaatgaatatacatatacatgtgtgtgcattgtgcctgcatgcatgtgtgtgtgtcttcatgtgattaaataatgtggaaaactatgaaacagtgatataaatttcaaaaatcagtttatgcaatttaaatgccaaagtacagataaatcagagcaactataccattagttttatgccaatgcatttctgtcaaattatgaaaatattctgttattaactctctgaatagaaatgggactcagttttactgcacattagatttattcactcaactaataaaccagagttacatatttttggctctccaaagaaatctgcagatagtttttcttcccgtataattttttttttatgtagaagaacttaaatatctatactggcatctctaataaggcttctttaagtcaaaaatatagtgatttagacatgatcggtatattacaataaagtagattataattaaagcacacctataaaaacaaggctcacgttagcactgaggaaacatttttctctacggtctacactagtttcctaaaggcaactttatttcaaatacaaatatattattattatttccttttgataatgctgcaatgatttaaagagtttatttaggctactttgtttaaacatcttaacaaagtgctagacattttacattcaatgactctaggaaataatttggtacttttgattacagacagaaatcaaacagtcaagttacatctataaggaaatgtattgcaagaatttttaaaagaatgggtgattcatcagttaaaaaaatagaaaaaaatattgtaagtttcttgcttgtctcttcttttctagagtttttgcaaattttacctttgcatttatcttgtgaagatacaaagccaaacaaaaaacagatgtaattattttgaagtaactggacactttcaggcaagtatgtggagatactccttttcaacaccaagagatttagattttttttcttattattaaactcttttaattttactaataattatctagcattccatcgagacaatgtacaaaaattgtgaattagaaaaatagtatatgatctcatttataacagatacaaatgtttctatgaacctgtactcaaaacctgaaaatatatttgactctttatctcccaaatatttatcatatctttcagatctttgtcatatctccttgattcaccaaattatatttctaatatcagtgccatttttcagactccagcaatatgattctaattggtctcttgatttctctcttccttccaatacatttcttggataaatctactaaaattatgtcccatatcatggaaataccttaaacaagaaaaaaaattctagaactctgaacacctatcccactcattcagtgaagattcccttgaccacttcagccataatgtaagaaatattttctaaatttcgacaatttttatttttgtactaccgatatgacatttctatgataattatatgtgtacatttaaaaatcttaaaaatatggctaaatatttacttcttttaacattgtctttcaaagtaaatattgaattcatagactctggagatacacgcatgtatcttaatctaccacagtttatctgtaacaaacggacaactatggtactaactttataggtggtcataaggaatcaatgaattttatagcagctagatctatgtgacagacacacacactaaatagtaattatagctataaatacaataataacaactattatttcaggatattttcctatgctaattaaactacagacatttcatatttattgaattgcatttgattttttagactcattattcacttgtataaaataaaatgcggatgataaaggaataaactaggctttggaagatattcttgaaattacagtaacaaagtttattttctttagttttgcagttctccaactgtgctccatggtgtgacatctaggggtctctgaatttcatttactccataaataaaaactattttcataaatagtttgagatcttgtcttttttactattatggcatttgcactgacattgcagaagcagtggtggataaaacgtcaggaatttcagcaaaaaccaactcagtggcatagtgcgacatcactgagttgaaaagactactgaaagccttgagtacacatatttttaatattctaggtgttgaaataaaacaaacacataaaacacttctgttgcatttctaagtacagttgttgtctcaaataaaacacttgggtgattgaaacgcaagcagaatgagccacatttttcatggaaaaccattattactttaaggaataactgatggaaaaaatcaaagttaaacagaggcaggcatttggcagacatttgcttgaaaataaatcactcagacttcatgacaatttttgttgcaaagttgaagatttgaatttctgacatcttgattctgccgctgtgaacttgaaagctttctagttctcatagtatttttagagaatatgtgtggtgatactaagaaatgtgaatcttttatgatattgttaatggagttgtggaatatttgcataaccagtgaaccagtattttctaattcaaatcatacatggtgaaagatgtattcaaagtgcaatataaaccaacgtattttaatataacagagtaaaaaacaaggttcactgatacagtttgagattccatactgtaattaaccatttagacatcaccagttgtcaagttttggtgtagtacaaaagaagaatcgtggatgtgtttattaccttgatggtggtaatggtatcaagggtatatgtgtatctccaaactcatgaaattatatacaataaacatgcacagttttttgtacatcaattatacctccacaaagctgttttaaaaagaatattcacaattttctgaaaaagctattgacatgctcatcctctttcatcagtgccatttttcagactccatcaataggattctaatcagtctcttgctttctctcttccttccaatatatttgttgggtaaatctactaaaattatgtaccatatcatggtaataccttaaatgaacaacaacaacaaaaaaatctagcactctgaacacctatcccactcatttacatgcctcctttaaaaaggagcctttataaagcctttataaaggcttttttctaagacccatctgcaatgcaaagtggtaaatgaaccagattttggaaaatgtttttaatataaaatatgtaactgtagaatacaaaaacagagttatcagttatatatggtgagccaagattttctttccgtatctaaccaaatatatagtcacaggttgaatgcagagtcagaatacaagccagctgtcttctattaattcattcattaagtagatatgcaaaaaatgtaggacaatggcattcattttattttaaatatatatattatttttattatacattaatatgtaatgggtttgtcatttataaatgaactaataataaatgttttaaagttctccattctaatttccagtaagataaatattgatagacctaactacataaatagaatctgtttgatgttctaaatttttttttaagaatgtaaaggtgaagacacaaaaaatgcctgagaactgccactgtacctcactctataaaacagtcactctaggaagagataaaccatagactctgccttataaaaatatctcttagttcctcactgcctcctttacaaaggcttttttctaagactcatctgcaatgcaaagtggtaaatgaaccagattttggaaaatgtttttaatataaaatatgtaagtgtagaatacaaaaacagagttatcagatgaaatgcctactcctaaaggaatatgctcatgatagatgtgttctgattcctgccaatcaccttgtgattatattggcaaagatgtttatgctgttttgattcactcaacgttaggatttaagtaaactaaaagaatcaggtttagaattttgcagaaaaacaagataaattgtgttaaactttatcaattgatgttgtaaaattacaatcaattaactttattaaatgatctttttgcctatataatactgaaaaggtcatattctcctttgtcatgttatgctttgtaatcattttttctgtctttcttatatccagggtggcagatggctcattggttaagcgttatcctgaaatggacaggaccaaattaaaacattggctggaacttgtctcaggaagccaaggttggtggtgggcagcaggacaccaaatttatcaaaagcccaacaacaatcaaagccaagattacctataaaaacacaaatgtacaatttctgaggatattcttataatccagagcactgcttatattcacctttagatgtcacttacattttgataatttaattgttcataaactattctgtctaaccatgtggtaaaaagcaataaagaagtaataatccaaatagtaaccacatggaaactatgtggaagataacagtaggaatttagaaaagatcaaacagctattctaaaattttttctgcttattcaataggattgggaaacagaacttgccatgagctagataaaaagaaatataaaatactgcacttcataagccagcaacatttcaacagaaataaataagttgatgtaaaaatgcaaaaaaaaagtagtctttaaacaggagatcaccctatgtgtcaagtgtatgataaagatgaagtactatgagagagcagtcagagaagactatgtaagcaagacaagccatttgcggtaggtactcaggaaggttatggagtaggggtgagaagcagtggagggagggtatttgacatgaaaggcatagttaaaggcatgaaaataagcataaaataagcattatttttctgatgaaaaagaataaatattgcatctttcagattactctgctgaagaactcaaggacatataaaattctaaagttattaattttcatattgatataggagcagaagacaaggtgggcatattatgaatgcaaggtgtaatccgcagatacgaatgaggattaattcagtgttttacagccagatatatttttgtcctgttgatttttgtaaaacttttgcaaaatggactcagtctttccatatgcttagaagattttttttgttttactttttgttcttctcaacaaattccacatggatttgacatagtgataaattatgcagtttaaaaaatcttcaataaaaagtttcatattagatattatgaaaacattcatccaggtaatttataaaagaaacacttctactttcaatcatatcttcagtgattacgacctgttaaataaactttctaccagaaagtgtcagctatattatattatgaggagaaaggggatataaaaagtaaaatgtttcaaacaaaatgtggtcaacccagaagtcccaaaatattgctagttaccctcccaagactaaaccaggtaaagttaaatccctgaatacaagttctgaaattgaggctgtaattaatagactaccaaccaaaaaaagcccaagaccagacagattcacagctgaattctaccagagggacaaagaggagctggtagcattccttccgaaactatcccaacaatagaaaaagaggaacttctccctaattcattttatgaggccagcatcatcctgataccaaatcctggcagagacacaacaaaaaaagaaaatttcaggccaatatccctgatgaacatcgatgagaaaatcctcaataaaacactggcaaaatgaatctagcggcacatcaaaaagctgatccaccacaatcaagtcagcttcatccgtgggaggcaaggctggttcaacatacgcaaatcaataaacataatccatcacatgaacagaaacaatgacaaaaacaaaattattatctcagtagattcggaaaaagccttcaataaaattcaacaccccttcatgataaaaactctcaataaactatatattgatggaatgtatctcaaaatactaagagctatttatgacacacacacagccaatatcatactgaatgggcaaaagctggaaggattccttttgaaaaccggcacaagacaaggatgccctctctcaccactcctattcaacgtattactggaagttctggccagggcaatcaggcaagagaatgaaataaaggtattcaaataggaagagaggaagtcaaattatctctgcttgcagataacatgattgtatatttagaaaaaccccattgtctcagcacaaaaactccttaagctgataagcaacttcagcaaagtctcaggatacaaaattgatgtgcaaaaatcacaagcattcctatacaccaataatagacagagagccaaatcatgagggaactcccattcacaattgctacaaagagaataaaatacctaggaatacaacttacaaggcacatgaaggacctcttcaaggagtactacaagccactgctgaaggaaataagagaggacacaaacaaacagcaaaacattccatgcttataggaagaatcaatatcatgtaaatggccatactgcccaaagtaatttatagattcaatgctattcccatcaagctaccattgaatttcttctcagaattagcgaaaaaaaaaaaaatactaatgtaaatttcatatggaaccaaaaaagagtctgtatagccaatacaatcctaagcaaaaagaacaaaactggaggcatcatgctacctgaattcaaactacaatgttacagtaaccaaaacagcatggtactcgtaccaaaacagatacagagaccaatgaaactgaacagagacctcagaaataacaccacacatttaccaccaattgatcttcaacaaacctgacaaaaacaagtaatggggaaaggattccctatttaataaatggtgctgggaaaactggctagccatatgcagaaaatagaaactggaccccttccttagacctcatacaaaaattaactcaagatggattagagacttaaatgtaaaaccccaaaccataaaaatcctagaagaaaacctaggaaataccattcaggacataggcacgggcaaagacttcataactaaaacaccaaaagcaatggcaacaaaagccaaaattgaaaaatggtatctaattaaactaaagagcttctgcacagtaacagaaattattatcagagtggacaggcaacctacagattgggagaaaatttttgcaatctaaccatcagacaaaggtctagtatccagaatctacaaggaatttaaatttaaaagaaaaaaacaaacaacccgatcaaaaagtgggcaaaggatatgaatagacacttctcaaaagaagatatttatgtggccaacaaatgtgaaaaaagctcatcatcactggtcatttgagaaatacaaatcaaaaccacaatgagataccatctcacaccaatcagaatggccattattaaaaagtcaggaaataacagatgttggtgaggctgtggagaaataggaacacttttacactcttggtgggactgtaaattagttcaaccgttgtagaagacagtgtggtgattcctcaaggatctataaccagaaatactatttgaccaagcaatctcattactgggtatataccctaagtattataaatcattgtactataaagacccatgcacacgtatgtttattgcagcactgttgacaatagcaaagacttggaaccaacccaaatgcccatcaatgatagatgggattaggaaatgtggcacatatacaccactgaatactatgcagttataaaaaaggatgagttcatgtcgtttgcagggacatggatgaagctggaagccatcattctcagcaaactaacacaggaacagaaaagcaaacactgcatgttctcactcataattggaagtcgtacaacgagaatgcttggacacaggaaggtaacatcacccaccggggtatgtcaggggtggcaggcaaggggagggagagcattaggacaaatacctaatgcatgtggggcttaaaacctagatgatgggttgacaggttcagcaaaccaccgtgacacatgtatacctatgtaacaaacctgcaggttctgcacatatatatcctagaacttggaagttatatatatatacatatatatatatatatacatatatatatatatgtatatctatatacacacatatatatatatgtagctagtggaaatataaaatatattttcatttatgaataatcatttttaaagatgtaattattatttccaaatagataataatgacaaagtaacttgaatagttttatctaattatcaaatattgtggccaattaggatttaccacatataaattattaactttgaaaacataaagttaaaataaagttcaaaacaatttttacatttctgaaatttcagaatattctttgatcactatgccagtgagtcacagaatttctaaagcacttctgaataataaattaatgtgattattgagagggttaaatgaaaggtaatacatttagggtatttataatagtgtctagaacataataaaagttagttattattatgatgatgattatagaatctatcatatatataccttaaactgatttaaagtgctataaaaatattaaccagactttcctttagatagttcttgtcattctttatatacttaatttattcagtatttatatatttaatatttatatttacaattgatttttctaatgcagctttgttaaaacacttttattaagcctctttatctgtaaggtttcaactatatcttctataaattatattagtatccagattaaacaatagtatccccaattttaaaatcttgaatttacttagcttgtatttttctgaaagccattgttgagaacaatctttttaggcaccatggaattgagttatagtaagcgtatggcaaaaattaatacagccctttgtttataacaacagaataaattgttaggtgaaatatcagattatgatgtttcaattatgaaaataaacattttaaacccaaggcataataaaaaaatttcacatttaaaattgaactttttcaacaaaaatagttgtagtcttttcagagccttttataatatatcaatgttaaacaaatcaaccttttaatcttgagtggctttttttaagcaataaaatcaatttaataataagtaaggactttctgagataaggttaatgccaatatgatttcttctggcaaaaatattaatacttggtagcaatgggaaaaaacagcattacttggcaataactgtattagatattaagtgccaataaacagttaccacaaaatgtgaaataatcatatattctatataattaaggttacatcagaaataatcatgtatcttgtgtaacatattgagactgaggtagaaaagtatcaatttggttacatttaaataatgatttgtctttgtgcaaaacagtgaaacagccctaacagtggaagtaaatgacttgtggataagataaagtagttataaaacttttatgatttgataaacttgcaaaaaataagcacaaacttgattttataaagtgttagctaccaaagtacatataataagaaaagttttctcttaggccagtttagtcttctatatctccaactaagaaagatggtattataatagacaagataatatgtagttgggcatgttatcatttagctgagtaatttatagttttaattaataatattttaattgaagaaattctttatacagtaaaactttggatttttcctgttataattaggttaatatgcagtaatattactgctgccaatgtttcctttaaaatttttctttacctttaaaataaaaagggaaatctgagaatcctgtttttactaaaactacttaaattccataagttcactaggatgacctattgtgacacatttgaggctattgtcatgaatttgttcttatttggaagacataaattgtcattagccagatctatacatatgtataatatattgggtctaaaattaagttccaacgaggattttataaaatctttacttgtaggttatgacgtaactactttttattgaagtcaagtaagaaaaaaaagtaagattctcaaaatataaaataagctcaataaaattattttatgaacaactcactattgtgtttatggtatatgttgaccatcaaatgttttctacaccgtactattttatggtaaataaaaataatgtatctttcttaaatgtacaaaatgtgtgtagtaagcaaaaactgaattaacatataaattcaaatagaatcaatgaatatatgtttcttgagttatagggagttgtttttttttcctatgagacgatataacagagatcgagatgccagactcatcacaacacagagtactgattctcctctgacttttgaaggattaagagaatgaaaagaaaaatattaaaaagacaagtgtgaaagaagaagcttagtagtgggtaagataaggggaggatgtgacagttaaaagaatttaaaatataaagagagccctatttgttgcagtcttgaaatgcatgtgtaaagcccccaaaaacttccacaatctaccacaaaaagaaaaggttgctgtttgcagagaggaaatctagttgtaatgaccactgaattcacaaatgcacacaagaacaaatgttaggactgaccagggcactctctcctcagtgaagcttcatcttctccacacaatgacatgtccttcctcatacaaagcgcccagatactttttctaatacagtatccatcatactgaactgaagttgcctgagtataggtctgttttcttacaccatgatggccttgatggtgacattttgatttttctttggcagtaggtggttaacaactttttgttgatggatgcataacaagcattgctggctataaaatcataaccaaaaaatcatctcaaagcaaataaaatatatctagctttgacttgttgccatcaataataaacagtgatggtaaagggcttgccatttttgtatgttcttagagtattaattaaaattgatatttatcataatggtcacattatgcaatgttttgaaattgttatgtaattactcatatgtaacaataatgttatatataatgagtattttctttacagtgccaaggcaagcttggcattttagaactattttatttttagtttgaaattaatttaagcaattccactctgagttatatccatgtctgccatgggaaaaatactagcttatgatatatattcaaacatattaaaattttagaaagttgtctgtctataactaatacatgatttgatttattacacagcactattacctccaaacaccatacatgtacaatcaatagatatgtttataattaaattaaaaggatcttacatatagccacaatattatcaatcccaaatttgactgttgttatgattaggttaatgctgaaaatagtgcatggacataactatcttcaattttaaagtttacaaaccagctaacaatcacttttcacatagtgaagattgcatctattatgtatatagtttgcaacaagttatttattttggttgtacaaatagaaaataatattaatggttgttacctacagttccttgctctacagatacactatttttactatttcttcaggtaagatctacctactgtccaaaatttcactgaatatatacttactgaatccctgttgtgcacatagattcatcttggaaactatttcccatgttaatattaatagtcactttaactgcctactgattgattttactaataaactcacattattttaaaacatgtaacaactctctatagttacaattaccaattaaatctcagaaaaaaatgaatacaataattttgtgaaaaataatttttaagataaaaaaattccctactctacccagctgaattaaataaaattctctctctctctctccccctttttatgtgtgtgtgtaaaacacagggatatctctcagaatccaaaggcaggaatgtaaaactaagttttactgaagaatcagaatctcagtagttaccggggaccatatgaattgtcccctcccctcccctccctgtcctctcctcttctcttccctcttcctttctggcacaaagtaaatgtatttttctccattaattgaccaaaatcagtagattacttataacattgcttttctaattatttgtggtactgtaccaaagaaagaatgggaaaattctatgcatatcggtaatatgaattggcctgaattataaccaaatttgtgatatagtacttactaactgaatttctatataatttcaaatttttcaacattcctgtaacagaattaagatattcagaatataagggatattaaataataaattaaatgggccaattatttaggactttgtaggagctagtttggaaatgaactactatttaaactgtaaaagtaaaatactctgagcactgaaagaacacactaaaactaaagaataagcttaatttgttatagcacttcattgtaaaaagaatttttcttataattatcttttagattttgacaaaaagttacttctacctacctaaagtttttttttttttttttaataacaaagagcaatgcatttgtttgctagagctgacatataaaattaccataatctaggtggcttaaaacatgacaaatttatactctcagacttctggaagttagaaatgtgaaataaagatgtcagcatggttggttctttcttaagcctccaagaaataatctgttctacgccattctcatatcttcctatagttggcattccttggcctacagctataactcggtctcttatcatcatatggccttctttcctctatgtatcctctatattcctatgtccaaatttctcttttaaggattctaatcattgatattactgtacactttaatccaggacaaccttatcataatttgattactggaaagctcctatttccaaatgaggtcccattcaccagtttcaggtgaatgtgaatattggggagacactgttcaatcaagtagaataaattattgtatttatctaaatctcggatgattgtcaattaattttaattcaaataatataaaagtttatgtattaaatagacttcttcgggaagcatgagcaataacaaaatcacagaattttagaaattaaaggaaactcagtccagcatttcctaatttttttctgtggaactttaatattatcggatatgaagaagtgataatttaataaaatgtgccatgatgaaatacaattggtaaacatgacatacaataccaccccagaaagtagccttaaacattagttgactaaaatcctcaaaaaatcctgaagtcctattaattttttttacaccaagtcttctttattggatcattcagtccttttccatcacgtctataaatagttttctaaagcaccaattatgatacaagatttagtctgtggtgtttttaaatcatagccacaggatctttgatatttctcccacttagaggtagggtctaacatggcacaaccagcctcaagcttcaggctgctccaacataaagccaagacccacagatatatgttctaggcccacccccaagactcagtccctaggcccaccgaggagcaagggtggacccagtggccccagtctccagactgaccctgacactgggctggtagtcatcaggccagtacctgtgaacccaacctacaggctggcccctgtagacacagagaacaggtccatcccagcacctggatgacccttgcagatcaaaagccttccttagcaccatgtcagcccctatggaaataggcttcaggccagcccctgtggatacaggctgcaggctcatacttgcaaacccaggcttcaggcccacccctgcaaacctaaaaaacaggtctaccccagtgggcacctgcaaaaggccagcttgcatgaggactctagctgcaagcacgctcatggaccacattagccagcctactcaaaatctctgtgaagggctttcccaaacaagccagtctgcaaagactagaataaatctctacttcttcagatgcatggacaccaacagctagtcacaaagattaaaaacaatcagagtaacatgaaatcattgaagaaataaaataaaacatcagtaaccagtaaccaatcataaagacatggggatgtataaacttcctgaccaacaatgtaaaatcattgttttaaggaaactcagcaagcttctagaggtagtgaggttctctatccttacacctgaaatctggacaggtatgttaatggtggttaggttcactatgtgtccaataaggtatgctgagataatcctacgtgacttcagaagctgaggcaaaaaggtcaaacagtttctgcctggttctcttggaatgcatgctcttgaaaatcttcctagaattcagcttccatgctctaagaaaccataatgggaatgttgcatctacacacttacatcaacaatcccagttgttccagacttgagtcattcccaacccaggtgtcagacatgtgagtgaagatgtctctagattagtacagtttaaagagctccctatgatgttggaaatgttctctatatctaaactgtctacctgggagccactatgttgtgcctactggacatttaaaatatggctaatgtgactgaatgattcaattattaattgtatttcattttaattaatgtatatttaaagataaatagtgactactttattgagcagtgggcaaataattctagcccctaaccatcatttgcattaccctccgatgacttcccagaaaacatggagcaaaacacaagtcatcctgttttaccagttccacatttatgacctacagattccatgagcatttttgcattaactcaacaaaatttggagtaatttggtaggcagcaatataactggaaccaaattccaatcgcttaatataagcaaactgagcccccaaaattgtgctttgcacaaaattctgtgtctgatttgcagaaaagcttagagcataatacaggacaaagacttttgaaaatcctaccataaatggactctttggataatgttattatacttgataacctaaaaatctatgatgagtgagacagttctcttctacatgaagcattcttgaagtatgctgtttaagtggccgtgactataattccactagtcaagagaatgtcctgcctattttatattgtctctccttataaatgcaaaaagttgaaataaaattactctatacaagttataacactaaatagcaagtgatgctatttgctaaacactgaccaaaataaattacaataattctgataatccttcctcgtctcctctcaaaaaagatcatgattcggtgatcaaataacgcttaaatactatttattaagtcaaatatcttctttggatttttatgtattcagtatttatatttaaaatatcgagaataaattagcaacacaaatcagcaacatccccatctcccagcagcttgacagctttgttacggtttagattccccaaggaaagtctcagcaccaatatattgatttgcaccactgcacttttctgactaattattaccaatgcagtccctccagcttatcaactcatcttcacagtaagagtggccttcagtttaaattcattatgctgataagtgacaacatcacagttgcatgacaattgctttaattaaaaatatttttgaagattagaaaactattgtattctgaagtataccaaaatgactacagaagtgcctgtcccccaagaactcaggctttcattgatgtatgacattcaacatttactgtctaagttctaaaaagaagattcctctttattaaaatttatcttgagaactatgtcagtaaggatgacctgtaagaaaactgtttaggaaagctgtcagattctttgactttttttttttttctaatgcatgaccatattatttgagatgtgatgaggggagataggaaagtgaaggatgctattaaaaatggggttaggaaaattctttctgatgaagggccttgcatatttgtgggaaaagagttccatgcacaagacacacaaatgcaaatgcactaaattatttgctgtttacacgcaatattttatgtaattctcataacttccccatgaggtgggtgctattatgattcttattcattgtaagcttgcatgtcggaatgcatggccaagcttaaataactaacttgcatcttacccaaggttactcaggtagagtattgcagagtctggattttaaaaagtagcttttctttaacttttttttttaaatgacgtcatgttattagccacaaaacaatactacctccaattttggagtaaaactgagaaactcactagtttattcaaaatatacttgaatttttttgcctgatctatagtcagtttgtttctaggtttaagctagtgtaatacaagattagttaagcaaactgcattatgcaaagatacgcataattcttataattattaatttaattaacatcatgaattatgttataggttatagttatttcaatggctttacaaactatgcatttcaatgtattttggactttcctaatagtcttgaataaggaagtgaatgaagacatctgaacaccaagggagaactgattgcaaatctgagtctttttgctccttctgtcttcattagacctcaggaatctaacagacattaatggaatcagtgaatgcccatgttttttttccaacacatgtagctgaggccttcagaccagaatctatatcatatagcccagagaatcagagaagtaacttatcctagtgagtaaaaaaatgacaattttatttgaatacaagtcctcctgatttgagtatctgtaaattattacccacataacaatatccttcatttctcatcagatttgaattaaatgaggtaagatcatggtatatcttttataataaagttagttattgtcaaaaactaaaatataaaacaaacttttattttctttaaatatgagttttgtattataaaatatcttaatattcatattttacataaaaattatttttcaatgtatttaaaaggaataatgattttatgaagtattgactttataaatacttaccaaaattcttctagcattcataattgtgccattaatatagggctaatactaagaaaaatatatatttaaataactgagactattctaaatagatcctattcatgaatatgtatattaggcatatattcaacatcattaatgggcatttagtacatttttaactgatacctgaactaaattttaatagataatctatcctgataaataatttttatttatttttggaagtgatcatttctaaattagcttcatgtaagacagaaagagaaatcaaattaaactactttaggtaagactactattattcacaagaatcacaattacgtttggtacaaatctgtcacttttgatgaaagtgaattgattttttattatttttgaagataatgtttttgaagactaatggggtacattactatgtaaatataagttattaggaggtaacttagcaggaaaaagtatgtcgtagacaaaaaacttcagaagatgaagttcagaaataaataaatttatggtttaaatgcactgtaatcgaaatagccatatatattgttagggtggaagtgaaataataacattatcttcaaaaaatctactggcttaatcaagatctaaactttttggaaacatgtattacctatattgctaaaataaaattacacagtctggatttcttattgttaaagaggaaatttatttatagaaaagggaagtcataatcatattacacaatgttactttaataacacaggtcttttaaaatgtaagaatatcaagaatcaatgcctatatgagtgtgagatcaattagaaatcttattcaaaagttacgttttacaaatgacatatgtgtgccatctttgttttcaaagccagtaccttatagaggacatatacctactttctgaatcatcagtgtcacagggtattgactttatcaaatttctagagaatattgagaaaataattatcttctcaatggcaaatattatagccttcaattcctaactgtccaaggagaacttacatttgacttcatgtataaatatgtacattcaaaatttgcaagttacattaaaaatttgattcggccattggtgataaccatcacttacagctatcagaagtaaatatttaccagtatattcccagtatgttcctcaaatattattcattgataaaaatggtattcccatccataatgcttttttgaaactcagaaaagtgattcagaaaacaaattatttttatacgtatatttacttttatttttctgagcttcataggaaacaaagcaaaacattcttctttccattacacttctattctgcaactttaaaaatggtactaagaaatgtgatagttcaattattgtcatattagagtaggaaaaatgaccatccattccattttcacagcatagctaccaagctgatctctttcagaacaaaatggaacctatatacatgcaaaacatttaatcatcaaatactatgtttaaataatgaatttaagaatatccacaatctaaatgagaaagtgccattggaaaaatatggactttggaatcagagctgggatgtgctctcttgcatttaatgtctttgaatccacaaaaaatgagttaattttcttggaactcagtttcctcatctctaaaatggtaatgataaaaatctacctcatgggaaagtcatgagaattaaaagtaatgttatgaaacataatgcctcataaataatgagcatcaaataggcggtagggaaaggagtttaaaattgtatcatcctggctgctattcctagagtcctctagggtgggaagtgcttgcctgggaaaatactttaagagtaggtggactgagacaaaagatgtgatctaaaagcaagaatgatccatgaagaaaaactgctttgcaagagaagcagggggaaccattttgcctcaaagagggaagaactgagaaaatcaggatgataaaaaacagcagacggtgaggaggaacagggctgaatattaccaggagtaagagagtttaaaaaatctgagaatgggaatgtttatatttcattggaagtgtttggcttttactaagcttagactcttcctttaccatatatagaaacttttttgtaaagcagggtttttcccttctgaaaaccaacgaaaagacactggtttgatatggtatacataagtgattgcatgtttgcaaaggagtcaagatgaccataaaaaaagcatgattggcaattcataaagtattagagacagctttgaatttcacagaatgcggttctggaatttcagctagtgttacccagagcgcaagtgagtaatatttcaaacactggagccagactgcctgaaatagaacactgccttcttctattatggtgtttccctgggcaagttacttaccttctctgctcagtttcctcatcataataaagcaataatagcacctgactaataacgttattggtattaatgagttaatatatgaaatgcccttagaaagatgccttgcacacagagagatctttaaatacaggctactattaggaaagcctcccgctgagcctccatgtaatggtgaattttctgtgtcaacttgactttgccacagggtgcccagataaagcattatttctgggtgtgtttgtgagagtgtttctggacaaggtatgcatttaaattggtggactcggaaaaacagtttgacattcccaacatgggtgggcatcagcccatctgtttgagggccttaagagaacaaaagttggaggaaggagcaatgagttccttttgcttcccgcatacctgcttgagctggatcatcagtctttttctgccttggactgagagttacaccattatctcccctggttttcacaccttcagcctcaaactgcaatcacaccactagctttcctgtgtttccagctaacagaaggtggattgtgggacttctcaggcccaataactgaatgagtcaatttcctcataataaatctcttcacatatatctcctattggttctgtttctatggagaaccctaatcagtacagattttggcacaaagaatggtagcttttattatgacctaagtaagatatactaagtggcctggagctctctgatacatcaaaaggaagtatggatacatctatagaccaaaagatgaccagggacttttgaatggtaatgtgctcatgttttcattcagctgtacttctttgaggaaaatgaaagttaaatagtctaattctgtggcattttaatacaaagttttgcttcttacaatttagcttcttaaggagggaggtcagaattagagcaatggaaaatagagcaagagaatcatgacaaaaattcattttcctaggaatactgctatcactatgttactaataaccatctctactaccagaatttttaaaaatgtcaaagaagggtctgagtattatttagctttaatccatcctgttccatgcctctctctctcacaagtcacaatgcaggcattcagtaaaattaaattccaaattggatgaaaaaatgttggagctggcattccgttatatgtaggttactaaatcatcaattttacagtattagaaaccattactaaaattagtttcccaactccatttgtaaacaagtctatggagtcttgacacaaatagtaacatcacattctactacaatgattaggttgatcctggaatccatatattacctctaattgacatttttggtttacagtaatgtaattacacacagataagtacaaattatattatattaaaatataatataatatttaagatagaatgtaataaaatataatattttgattttaaatgatattttaggtatcaatagcacattctatcatttaaatttttaaataataattatataataaaattcaaaattttctaaagttaatctaatttaaatatttatacattatgttttaaatttttattgcaaaaacagcattcaagtcttggcaatatatataatatataattttccagattataatctggaaaatatacttaaaataattgttaagtccttgagtgtcatgcttatggtaatcaatatatctttctattctgttttctttttttggtaagttgatttataaagagatctaatgaacaaagtttccaatatatttccaaaagtctgtaaaattaaacttttttagagaattagattcactctctgatttcaaaggtgttctctcctaataagaaaatctgttccaacaagtaattaaaattacatttctaaattccacattctgcttttatcaaaaagcagagttagtacaatgaacagtgcaatgtataatttttccactcaatccctttaagaagttagtaaaatgaacaatcaatccacatgatctttacacagttgctcagtacattagaatatatcatacagataatcactggttcagtgggagttctctgattgcacaggatttaactgtttaggcaaccacattgggtaggatactttgcagattctactgctggaaatatcacatgaatcatctgccaatgtaattctagcaagcaagcagtccaaagttcatgccaaaagttaaatgctgctccttcagaatggagttacctatctccctcacaaattctaaattcaccaagtacatgctacattttaatccacttaagttagtacattctccttccttaaaaagaaggttagatagaaaaattatctttggtctaatataataattgattataaaattattttcaactaatatctaacttttgaaaaagttgtgctgattagtacaaatggaatctataaagttatttttacagctttgttgctagaaactgatttactgatataagataaacctggacaggtttcaaattcatttcacaagtcctccaaaatgtaaatcaaattatgctgttcctcattacaaacagaaaactagactttgctgaatgaatataaagaaagcactatgccctttagctagtccttggatctcaaatgtccttctcaaatactgcacttagccagcaactttccatcttttaatttctcttataaccaaagtacactctgaattggtcttatgcagctaatataaatctgaatatttctctgatttgtcaaagttaatttgaattctaatcctattatatccaaaattctaccaaccatgtccaacatcctgtcaaccaaaacttaataagcacgctcttgttttagcctcccaaataataaattatatgaaataatactgattctggaactacatcctgccattcatgattcaacatggcattttaagtcaacactgagtcattcacaaatatatattactaagctcttcaaaaaagatgtgcacttttctaacaatcatcagtatttctaaaaacttttatgtgatttctaaaggtcatggaaggactccaaaggtgtccaggagtgtccacatcaatgattcatgtcctgcctagattaacatggcaagtgcatgataaatgaatgcatgaaagttgttggctagagaagcaacatgagaaagtaggcagatggaagaaagtgatagattgtcactgtacttttactcgtttcacatcaactccttcagactgactcctgaagattgctgtcaacagcttccatagcttctttgccacaacacttgcctctccatttgtcttttttcattctgtgaaatgatttttcctcctctttacaaccttttaaaagttgcctcctctattaattattttgattaagaggacaaactctgaatcaagaatgcctggatatgaaccttactccaccattcaagaaccatgatctgggacaagtaagtgacattgttttgtatcagattcctcatatttacatggggacaatgatagtacctatctcagaattgctctgaatattagataagttaatgtaagaagtgtacttacaactatagtattatgtgtttgatattaattttcttataattattgatgtcatgatttatctaacccacgttgacatgtgattaatttatcattatttttccccaatgactttgtaatgatccattccagaatatacacctttataataattttgttcattaatttgtgaggttctctatactgcaaataacttgaaaacaggagccatgttacattatcacatgattttccgagtgtagatggtgcttacataattagttaattttacttttgggaaaaatggcaaatagaagaaatgaagaaatgaatagggtagagcttcacaaagaaagtaagattttggttttgcttttagcataaatttggtaaggtcttcagaaaattcgccaatatacagtcttactcatatagatgcagaggaaatatacaacatattggtttacaaattgcctgcatttagctcatatggggacatttttaaaaattcaactcacagctactgaattaggatttcttagagtagccttggaatctttattttaagaagctttggggccgggcacagtagctcacaaatgtaatcccagcactttgggaggctgaggcgggcggatcacaaggtcaggaattcgagaccagcttggccgatatggtgaaaccccatctctaccaaaaatacaaaaaaaattatctgggcgtggtggtgcgtgcctgtaatcccagctactcggaaggctaaggcaggagaatcacttgaacccgggaggcggaggttgcagtgagctgagatcacaccactgactccagcctgggtgacagagccagattctgtcaaaaaaaaaaaagcagcagcagctttgactggtaagttaatttacaatcaagcatacaaaccaagtatatgctacattttaatccatttaagttagtatattctccttccttaaagaggttagatagaaaaatatcctcaggtagcagaatgagccaagttagcaactattaccatggacataacttgctatagtctggccttgataaacaatgctaaaaaaactatgttgtgacaggttaagcaatattttttttcttttagtgtaatagcaatcattttaattgtatcatagggccctttttttcacttttatcaagtgtttttttgtttatctggaaggacgggtaaaatgcactccattctgttgccttgggcagaggataattatagagaaaataggtgattaaaacaatataggtcattagccatccttgtatttccaagaattttattgttaccacataagtttgagttaattatgtaacctcctcagagcctcttttttgtcctctagagaaaacaacagaaggacatgagacatctaaaacggtaggaagatgaaagtaaacggaaagatgtacacagtaaagtcttgaaaaatagccaactggctagagagctgtattttcatctcacaatccagacagttattgggtaaagatacctctgtcctattttttcactcaattttagcaagcacttataatctgactacatacagaaaaatgtaaatacactgaaatacagagaaaggtaatacagcttctatacccaaggaaatgaaaacacacaataagaaaacacacatacacacctatatatcaaggtgtggttcctgttaagaacaatacataaaagctaagacagtcttgagtagggagtagcaatccactatggctgcccttaccagggaaactttattaattttttaaattttataattacaacttttattttagattaacagggtgcatatgcaggtttgtttcaaggttatattgcataacactgaggttttgggtgtgaatgatactgtcaatcaggtagtgagcatagtacacaataggaagtttttcagccctgtccttctctccctccatccttctggagtccccagtgtctattgttcctgtctttatgctatgtgtacccaacacttacctcatgcttataagtaaaaaaatgtggtatttagttttctgtttctgctttagttcatttaggataatggcctccagctgcaagtatgttgctgcgaaggacaagatttcattcttttcatggctacatagtattctaggatgtatacataccacattttctatatccaatccattattgatgagcacctaggttgattttgtgtctttgctattgtaaatagcacttcaatgaccatataaatgtgagtgtctttttggtagaatgatttagttccctttgggtatatacccagtaatagtattgctgggctaaatggtatttctggttttagtggtttgagaaatctccaaactgcctgccaaagtggctgaactaatttacattcccaccaactgtgtataagctttcccttttctctgtagccacagcttccccaaaagctgttatttttttaccttaaaaaaaattatcttttattttaagttcaggggtacatgtgcaggtttgttgcataggtaaacttgtgtcatgggggtttgttatacaaagtattcgcttacccaggtattaagcctagtacccattagttatttttcctgatcctctctcacctttcaacctccacactctgatagacaccagtgtgtgttgttctcctccatgcgttcatgtattctcatcatttagctcccactagtaagcgagaacatggggtatttggttttctgttcctgtgttagtttgctaaagataatggtctctggctccatccatgttcctgcaaaggatatagtcttgttcttttttatggctatatagtattccattctggacacgtgaactggcaaaaatttcatgagcagatgccaaaagcaattgcaacaatatcaaaaatttagaaatgggatctgggacctaattaaaccaaggagcttctttacagcaaagaaaactatcaacaaagtgaaccgccaacttacagatgggagaaaatttttgcaagctatgcatctgacaaaggtctaatatccagtatctataaggaacttaaacaaattgacaagaaaaaaacaaacaaccccactaaaaactgggcaaaggcaaaggacatgaacagatacttttcaaaataagacacacatctggccaactatcatattaataaaagatcaatattaccgatcattagagaaatgcaaaccaaaaccacaatgagataccatctcacacccatcagaatggttattactaaaaagtcaaaaaaatagatgctggtcaggttgtatagaaaaaggaaaacttatacactattagtgggagtttaaattagttcaaccattgtggaagacagagtggcaattcctcagatacttaaaatcagaaatcccattactgggtatatacccaaaggaatataattcagtctattatgaagacacatgtatgtgtatgttcactgcaacactatttaaattagcaaagacatggaattaacctgcccaataatgacagactggataaagaaaatatgttatatatacaccatgggagatactatgcaggaaaagttttataaaggagggtgagtttcctcttggcctaaaacaacatgttgaatatgaaagaacatggaaaataaatagtgggagaaaggtatcaccgcaaatttcagaagacagaagattgtgagttaacgtgcaagcgtcaggaaagcacagacgtccttgggatagaataacatataatgtggttacaacacagagcgcttgtgaagagtggtgggtgaagattaacctggaggggcattttgagggaaattgtggtagaactttgaaacttcacagtaagaaatcaggcaatggaaattcactgatagttttcgaatggggaaaagggcggaaagatttgcattctcaaatccaggtaagtagaatacaggatgaacttgagggtagcaaggggatatgaaattaaatcatacttgtaaaagtattttgtaaaataggaaatataaacaatgtgtaaaacaattctaaaattttcagtaagaagaaacaaaaatgagtaaaatctggaaggaggaaacatgttatttaaaatagtaaggaaaagtacttattgaaaatagaattgacttaataaagaacaatgggaaaagtgaaaaaagtgagttctaaagtgtccactactaattttattgttaataggaagccattctagggtcttgtgcaggaagtaacatgatttaaattgtgtgttgagatgtaacatttgaaacagttaagaatttggagaattatcaaaaaattagggttgttagcaaggcatacgattttaagagaatgtaaaccaacataatcttaagcaaaatgtatttatgaaagtgaattttttaaagtgaggtagtaaaactcaaaaagcccaaaggattataaatcattctactataaaggcacatgcaaatgtatgtttattgcagcactgttcacaatagcaaagacatggaaccaacccaaatgcccatcaatgatagactgggtaaagaaaatgtggcacatatacaccatggaatactatgcagccataaaaaggatgagttcatgccatttgcaggaacatggatgaagctggaaaccatccttctcagcaaactaacataggaacagaaaaccaaacaccacatattctcactcattagtgggatttgaacaatgagaacacatggacacagggaggggaacatcacacactggggacttttgaggggtggggagatagaggagggatacctttaggagaaatacctaatgtagataacaagttgataggtgcagcaaaccacatggcacttgtacacctgtgtaacaaacctgcgcgttctgcacatgtatcccagaacttaaagtataataaaaaaaagaagaagaagaaaaaaatgcaaaaagccaaatgtgaaaactttgaatcgaaacaattttgaagtgcctgtactaatgtctagttcatcattggaaataaacaatagttggtcctcctttgtgactcaatcatgtgtaaattattatttttatcatttcagtattgcctactagttgtgggctatttcttattgtaaaggtactttccattctgtaaaagaggaataactggaataaagggcattaacacctttatatttggggtctcttttattgaaatacttgaatgtctgaacaaatcactttagttgtcttggctgtttttgatgatataattcatttttcctgtagtttacagtaaaattttagtttagatatataaaataatctatagagatttctgttaggcagatagagctgttaagagtcaagtgactgtgtgtgctaggattctaaaccagggttaaaatattttgcgttaattccattttgtattattgaggatagttagaaaacattttcaatactatgctgatttttcaaataaaaaatacattcttgagtttaattaaaaagtgaaaaatgtctgccttaattatcggaattttatttattatttaacatattatctttcaagaatttttaaaaatatgttcacaaattctaaaggttaaagtagagaaaagttcctatcaccatataggtttactagaggcctattagaggtatatcccagaattacaaatcatacaaagcaagtgtaatttaataatttactttcttaaaatagtggagtaccctactacatttgaagttcatttatagattagcaggaacctgataggattcttaaaccagagaatcatatattttaaatcaaaactaattgtcttagtcaataatacaaaacctcaaacaccataaactgggtagcttataaaaacacttatttctcacagttctggagcctgagaagtccaacataaaggcaccaacagatttgttgtttggttgggggtttgtttcctagttcgtaggccattacttctcccaaaatgctccaccttctactaccgtcaccttcaggcttaagatttcaacataagaattttggacaggacacaaatattcagatcatagccaattaaatatcaaaaattaaatgtcaactggatgaaataaatttgatgtgcacatattccagagcattataaaatgagaggcatctgtaactcagtttccaataactaaaagttggataacaaaatgtctgtgattttcttttattagaccctttctttgcagaatattttattagggaagctgggtggtatagaaaaattttggaggcctacagaactgtgctctcattttagttttgacataaactagtcacatggccttagacaagttacatcacaaataatgcatatgtacaattgagttaataacagccttatgcagggtttttgtgaacattaaatgagataacttagcaaagttgcaatacagcaggaggtgcatagtgggttttcactaaatattgttctccctacttctttctttccctcccaccttgaaaaccatatttcatttcttgtcttactacataagtttttatgtgatttaaatgtctgataatctgtaattgattaactttcatcaatttctatgacaaatataaaatccctacctttactatacaacccatccagtaagaacactatggggattttcttgtatcttcctctttcctcctttatcaaacaataatgattcccttggcactgtgatgagtgttaacaataccaagccctgccctgaagaatctcagtttctagaaggagagataggaatataaataaataaaatatgattgaataatggtaataattaaaatacatgtaaagtttaaaatcttccttaattttacagtgtattctgtaaactatataaaacatgtatatcgaattgattcaggaaatatttacttattaccttcaatgtgttaggcttatgacattttttttaaaagacacagtccctacaaggccattaggtttcagggaccttaatgacagcccactgctctaatagtcattaattcaaacctccttgactgaatgcagtacttgactcagaaatgtgagtaccatcctcctgaggcaccttcaacctggcactggaaatctagcaaggtgacttgtgatagaaatccttggatcctactgtcctctttcctttgtgcaattctattatataaccctattgtatttcaactggaataatcactcatgggcttctcctcccactcttcctaaaaagcttcatgctagtgcagttcagaaagatacttggtttcccaaaactacagaaaatgcaaagaaggcatagaagaggaatttaaagtaccaaaattggacaatatcaaagctgtggcacagaagaactttcaatgtgcctcataccagggaaccggggatcatacttatggaataaaagacacatcacaataagatgctttttctgagagtcttcattgtatttttccttcctgagcatttttcatgggtgtcacattctacactcatggtcttccaaactattgagagatatcttacttcacatgacttttgggtcaaagaagtggtccattcaagaataattgtcccatttttcaaataagaaaaaaataaaaacaataaattcaaagatgccaatgtcaaccagccactttttgaaacagaaactacagttttgatataaggagaatagacttctgaaatttttgtattttttcatgatcaaagatgctttatccctaagtatatcaaactgcaaataaaggcaatcaactctctgcgtcaggaaaacaagacataatcttcaattaatcatcaaattctgtttagttgatatttttcctaaaattatttcttcaaacaaccactgtgctgattttgtttgtattttacttgttttgtttgaatacataaaaataatataaacagtgttttaagtatttcaacagaatgatttattaatcatttgtttaatgctacttagttttgttgctcacagaatatttattgtttggggtagtgacataatattctgaaactgaaatctaaaaatgcaatttgaagtgaaactacaaaattttcatttcaagaaaattgcaaagtttctcaatataacgataaaaaatatattacaggataaaccatttaaattaaggatagtatttacctgaaaattgcctaacagctttccatcattttgtgccttctagaaggaatactagaaaggaattagaatttacttttcattcagtaaaacttccaaaaaaaattgaatgagaaaaatctgactccttctgcacataaatactgtattaaaagaattgaaatgaaaattgaactccgatgattttatttaaaaattgattttaatatgagaaatattctatgaaatggtacaaagtgtcctcaaaaaggtcatggaaaatgtgtattatgaaaaaactacacaaaacccccaaaatttttgcaccaaagtaatcatactctgaacaaggtctagtgtgaggcagtaagaaggttaagacttcaccttgaaaagagcccctctcatggcaacatgaattctgctaaacttgaagcaagaacaaacattaaaattgagtggaataatggtgacatcgctaatgcttaaaaaatgtttatgggcaaaattatccaaagaaatcagcagtttacagataaacaacttgggttaagaagggatgagacaatgttgaagatgaagtccataacagcagaccatccacatcaatttgcaatgaaaagaaagtatctagtttgtgccctaattaaagaggaccaaagattaacagcataaacaatagctaacaccttagacatctcaaatggttcagctttcagagttttgactgaaaagttaaataagcaaacttcccatttaatgggtgccaaaactactgcatccagatcagctacagacaagagcagagatctcaatgaaaattttaaacaagatcccaagcatttcttcaaagaattgtaacaggagataaaacttggctacaccagtatgaccctaaagacaaagcacaatcaaaacaatggctaccaagaggtggaagtggcccaatcaaagcaaactggaccagtcaagagcaatgatcatgacaacagtgttttgagatgctcaagtgttttgcctgttgatatttcaaagggccaaaaaatggtaacatctgtttggttttgagaaagttagccaaagcttttgtagaaaaactcctgggatggcttcaccagagagttcttttccaacatgaccatgctcctgatcattattctcattaaacaagggcaactgtgtgagttttgatgataaatctgtaggtattaatcttatagtactgattagcctccttctgatttcttattgtttcctaactttaaacagtctttaaaagacacctgcttttcttcagttaataatgtaaaaataaaattagataaaaaaactgcattgacaggattaaagtcccaggatgctcagttctttagagatggactaaatggctggtatcattgtttacaaaagtggtttaacttgatggagcttatgttgacaagtttgtattttaatttttatcgctaatgtcatttttcaatggtatttctgaagtctccttgtagttttatttggaagttagataataatttattgctacatttaaggaatcattatgaatacagctttggaaataagaacttctcttatttgttttgagagacaaaaaagcagtcccagagattaagtgaattcattaaatttaaatagcaaatattcagaagggtccagatttgtggatacctgatattccctgtccactatagttgctaacatggttttaattagttaattctctgtgagaactttagaaagggctttgtttttttcttttgaccattagaggtcaaaagaaaatggtcaatgacctctaatggtcaaaagaaaatggtaatgttagtaccataaactaactactcatgttttgtaaaaagtatgcaacagagtccacaaatccttttattcttacacagtaactgtgactaatggctagagtctgcctaggtgttgtgttgcgaaagaccctgaaaccatcctttggttagacaatcagcaaacaatagttgcatgatcacatgaagaagtgcagtgatattatatattccaggtatatattccttcaacttcttttttttttctgagcagttacctagaaatcacccaaattacaaatcactttcatcataaactggaaaaaaaagtaacaacacagatgtaacataattttagattttatattaatacttgtatataactgttgaattaactaatgaatagccagtataataacttctaaacctgcaagataagtctatctagtgaaaattacttaaacgatctgtgaaatgggtgaatgagtgtttaccataccctacagtttgaaacctgtatctgctttcctttcccaaaagacaaagaaggatggaaacaataattatgtgtttttctaacacaaactattaataaggaggtgatgacaaatacattaatggtgaaattatggtgtcattatcatagaatatccttgatgctaaattattattcttgttatgttgcattcatatttttcaaagtgaattacaaattaaattattatcctcttgaatatcattgctctgaaaacaacttctacactttgatttggcagtataatgagttgggatgctaaaaatttgacctgtaatgagaaaaaattaagctataaaaaatttattaagtcacataaatgtaatttttgcatgtatatgtgtgtgtctgtgtatatttcattttattttcattaatagaattttagtactcatatttaaatggcagagaccatatctaccctgttcactgagctattttcaggcctcagttatgcatagcgactcaataaatatctcttgactgattttaggtccctatgctagataagagctttcattcatttattcatttaacagaggtttagtgaacatctgaggggtttaacaaattctgttactataaaccaataatttactcatgatattatatataaagtatacttatattaataataattgctaacatttatcaggcacttatgtgccagagacttagttctttacatgtgttctttaatttaatcccaccacaaagctatgtactactttattataattttcatttgtctgatgagtaaatcaaagtacagatggcttaatcatattatgcaaagtcactaattaataaatgagaaagctgagatttgagttgtctcattgttgagtcggccctgcactatagcatagtgttataggtgcagagaagagggaaaaacttgctttttattaatttcatatttggaaatcatgtaatatgtttaataaaagtaatattaattgtactcatattatgtctttataacagatacattcattgaagacagaataataaaaagtaaataaaatctgctatcatttctgtattatttatttaacttaaaatattttaataacatgttctaaatctttttaattatggtcttcataatatttagagtaaatatttaataattcaattgtattaatgagggtaagtcatacaactcttttaaataattatttgtacaccatgaaggtacacttctcatctcaattaaaatcactgaatgtgttcatacaaatactaaacttaaaagggctacttcagttccttagaaggataagcctcttaggtaggaggataaataatcttcaatttcctcttctgtataaatgagaagcaaaaatcgttatctatctcataggtttgttttgaggattaaatagtacataatcaggaattttaagaatggtttatcccctgtgacacgcaatttacccatgtgacaaatctgcacatgtaccccttgaatctaaaataaaagttggaaataaaaagaatgatttatatgtctgtttttaccactggactttgcagcagagtctgtcacagtcacatttctgtgctcctgtccaaccagtcttgatattgagtatatttaagttcattaataaagttttttccctataatgagtgaaaaaacaaaaactacaaattgattacaattataacaaattataaaaccaaagtctgtgatgtgaatacatttgctggattatatcaactataattattaactctcattacctgattatatgcattaagagcctcatatgcattacctatagtgcctgttttatgacacttcaaattatttctaaaaataagtatattaatttctttatggcatgaggttttgatacatagcaatctgctattagaatatacttgatcaaggtcttaaatttaaacatgaaaattaaattatttttgttttaggttaataggtgatttatagagaaagctagatttatcctttcaggtttatctaagtatagcatcttaatctgattttctagtacaccgtatttagttcctgatccacagttaattctgcctcattatttatttattttattcagcattcttcttttgttctgttttgacgatatatggtagagaacatctttcagtatacatgtgatttcatatattccatcataaaaaagtattactggatctaggctgctattaatgccttagctttttatttattaattgtaagatatacaccttttggaattttcgtctcttaaataacttatttaaggtcaactatcgaagaaattaagaaatgttagatctgttagattttgtaaatctttcctatctatacaggatggtacataattcaggatatttctacccaacaatattaactcatacatgtttttcaatatgtacatacatatgtatgtttacatacacatatacacatatatgtaagtgtatgcaaatgttgaaaaacatgtatatatgtatgtaaacacacacatatatacatattgtttatgcatcttttatttcgtattaccaagactcccatttggtaattgtaaatacagtcaattcttattatttgtggtagttatgctctatgaagtcactgcaacactgcatcagtgaatactacaccattgttccccgggggacatatagagttagagtcctgtatctcctgttaggctcctatgagtctctggtcacatatttgtcaatcaataaatatataacattattctatatgtctttctatttaaagatatcttatttaatatatcgaattgttcattaacattgaaagtaatggtcaacagcactacaactcaggcctaaagcttatctaacacatgcattttctctgttaagatacatcaaagcctttttgttctgaggaacaccacatagtgcttctgtataatgtttggggccattgtaaatagtgaaatcaccgacgaaaagcacaaaaatacaaaaacatagcactagttagaccgtaaagagcatgtatttatagtacgagagttgaaacaagaagagagagcattgccttttttgacctaagacaggacaaccgtattggtcaacgtaaaatttttgctgctctttatatttccatgaaattgtcagagatacagatttgggtgatcacaaaaaattatagtgacttcaccaatatgaaacctacaaagaatgaggactggctacatgttgtgagcatttccatgctggactgatcatttagcccaacaaaatgtaattggttgagacattattagactaaattttaaataatttattcagtatgtcaactaatatcaattaaagaaatgtataggtccaaaagatttataatactatttctattgaagtagtctaagtaccctcaggaagagtttcttccacttgcatattctattcaacttctgagtcagtggcatggtcagggcacaattagtgattcctgaaagcatgcagtacacgttaagatactatggcatcaactcatgttttaataattcagatatattttgcaaattctcaactaggcatcaacttttaaatcacatcatttcaaactaatatagaagaataatatttttggctgtaagaaaataaaaatgtttggctattcatttagaagattcaaacactaattttaaacataagagaaatgtatttaaatgagagaaacatttcaactttgcataaaattctttccataaacagtaatgaaatataataatgatttatttcaatgaaattactaagtaaatattccattaatccaaaaccaactacatatttcacacttctaatacatgcttcaaaaattgttttgcaatctagtactcttaacaaaagtttcaaaaatttaatgacataaaactgtatgtgacaactaactcctaagtgcagataattcaataggccatgtgaattaaatacaacatttaaaaaatatctaaatattaattatttaatactctactaatattcttaccagtatttgtcttctcttgaattttttgagttccattgttagaatgagttgaattacagttaccttactgcagaaagttttcatcccattcaaaaaaacaaaaggcattttatctgttcattgcctgcttgcaataacctaaactaataattttacttccagtctttttctctctctttccatcactttcctgactagatggttgaaacaatttacagccagccaacaaaataaaatccaaattatcgccatttatattgtattcccattgtattgtataaatgaatcttaaacatccttttatgataacatcgtgtctagttttcaatccttacctcctgatttgcctcctctatgcactgtgctctaacaataatgtagcaaatttaattcactccaaatcatgctagtttttatgcctccatgccatgcatccactttagaattccttgtcctttagcctgcctaaagatagcccatttaaaaatcagcttaagcattttcttctctgtaaactttgaccaccttaagaaatatgttgatcatctttcacttcagaacttttaacatctatttgccattgccttttttatataggaatacatttccaaatgacttaagagtatcttattgcaataagtcttgcaagctgctgatggctctacaattctgcaattgggagggcagcagtcccattcctacagctccactaggtagtggcccactggggactctgtgtgggagctccaacctcccatttccccttggcactgccctagtacgcagccatctatgagggctctgcccttacaaaggcttctttctggacaaacaggctttctcatatatcctctgaaatctaggcagaggctgccaagtgttcttaattcttacattctgcacacatacagggttaacatcacttggaagccgccaaggcttatgtcttgcattctccaaagtagcagcccgagctgtacctgggcttctgtgagccgtggatagaatgggaatagccaggatgtagggagcagtgtctcaaggctgcatagggcagaaggaccctggggctggcctacaaaaccattctgtcttcctaggcctctgggcctgtgatgagaggggctgtcattaaggtctctaaaatgcctttgaggcctttccccattctctttggtattcacaccttgctcccttttggttatgtgaatatctctgaaggtggttgctccaaagccagtttaaatttctttaaagaaaaagaaagctttttctttccttgacacgtggccaggctgctaattttccaaacgtttatgctttgctttctgtttaaatacaaaatccaaatttaagtcacttgtttgctcctgcatttgagcataggttgttggaagcagccaagtcacatctcaaaccctttactgctagaaatttctttcaccagatactttaaatcatcactctgaccttcaaacatccacagatctctagggcaggggcacagtgcagccaagttctttgctaaggctaacacacatgacctttactccagttcccaataacttcctcatttctgagacctcaccatcttggtcttcatgtccatatttctatcagcattttggtcataaccatgtaacaagtctctaagaagttccatattttcccttcttcctgtcttcttctgagccctccaaactcttccaacctctgcccattccacgttttcaggtatctttacattattgtcccacctacagtaccaattttctgtattaggccattcttgtgttgctagaaagaaatacctgagactgagtaatttataaagaggaggggcttaatcggctcacagttctgcaggctttttaagaagcatggtgccaacatccgcttggattctggggaggcatcgggaagcttacaatcatggtggaaggcaaaaagtagcaggtgcatcacgtggtgaaagcaggagcgagagtgtgcgtcggcagggagaggtaccacagacttaaatgactagcttttgtgagaagttgctcactgctgtgaagacagcaccaagccatgagggatccgcctgcatgacccaaacacctctcaccagccccacttccagcactgaggattataattcagtatgagatttgggcaggaacaaacatacaaactatatctcaataagagaactaattaaccaatagatactcagtctttgactttctcatctaagacttgtatttcatttattttttgacatggagtctcactctgtcccctaggctagtgtgcagtggcatgatctcagcacactgcaacctccgccttccgggttcaagcaattctcctccctcagcctcccgagtagctaggattattggcgcttgtcaccacgcctggctaatatttgtatttttaagatagatggggtttcgccatgttggccaggctggtcccgatctcctgacctcaggtgatccacccatctcagcctctcaaagtgctgggattacaggcgtgagccaccacgcccagcctgagacttctatttttatttattattattattattattattattattattattattattttagacagagtctcgctctgttgccaggctgcagtatagtggtgcaatcttggcccactgcaacgtctgcttcctgggttctcagcctccctagtagctgggactacaggtgagcaccaacacacctggctaatttttctatttttagtagaaacatggtttcgccatgttggccaggctggtcttgaacttctgacctcaggtgatccacccgccttgacctcccaaagtgctgggataacaggcatgaaccacttattattattacataaccctacaagagtttaaatgcattattgtattctataattttaaccatattatctgtaaagttagacttgattgctactccattattcatttttacatcttcaaattaaatatgacatattgctagggtcttaatgattgtgtcccccaaaattcatatgttgaaacccatcacctatgtgagggtatcaggaagttgaaccattgggaggtaattatgtcatgggagcagagccctcatgaatgacatcagtgcctttataaaaaaaaggcccatgagaaaccctttgtcccttccaccatgtgagaacacagctagaaggtatcaattatgaatgagaaaatgtatcatcactagacactctgatctgctggaaccttgatagtgaacttctcagcttctaaaactgttagaaataaatttctgctatttaaaacctacccagttcacggtatttttgttatagcagcacagatgggctaaaatatgtttattcttcttatgatttgtctcatcagcctcagtagatatgtaaaaatatgatgtgaaataagtaattccacaaatatttcctggtagctaattatgagcttaacatgagcaaggaactatatatatgggctagagaggaaatatgaagtcaagcttctgacccaaagaaatttagatgctaacacatgaaaggcaagataagaaacaaagcaagtgacaattaaatacttatccatgtggccaagattataggtactaaaggatttcacaaaaagggagatgaatgtgagaatagaatattaaataaaacttgacatttgttatgaaatttaaactggattgagtttttgaaaggagaaagagggaggagagatgcagttcccggcaaagaagaacagggaaagaaaagggaataatacacatattgcctggaaggaagttattctgatatctttctcaacgaatataaagcaactattattttgcacatgactcatttttgttacaaatgcctcagatcttcaagcaacatttgatagctctgtatttgtaccagtaatgacaaaaacctccctttcactatatggaatggctagttttatgttttaacttggctaggcagtctagattttgctgtgaagatacttttaggatgtgattaacatttaaatcaataaaatgtgcgtaaagtataatgtgggtaggtcacattggcctcttccacagttccatcaattgaagactatcagagcaattattgagttttcccaaagaagaagaaatccttctcaatactgcaacatacaaacccagcctgagtctctagtcccacagtatcataagacaattccttaaattgttctcacttcttctctcccttcccaacagcaccccccaagccccacccacatcttcaattgattctcttcccctggggaactctgactaatatactacccttacctttctagcattactgttttccctacctagtcagagaaaactattttaagcttaacatatacaagcatattatgatataatatgttaggaaaaaaatgactgtttgtaaatgcagctgctaatttgtttaactaggaacaaacaatgaaatagttattgccttcaaatagtaaataatggaatttaaaagaaatatgaaaaacaattaagtcaatctactttcatttgccactgtggctaagaatagagcatacatggcatagcatattgtttaaaaatcccagaatcctgtaatatcttcatacattaaaggggctttaataagaaaatgatagttaaccgtgaaattcttttctttgtccatttttatcaatatcttaagggtgattacatgtgctctttttgacataattaaaatctcagccactgaaatatattcaaagcaatatggaaaccaagaagaatgtgattttccctgccagcagcaatccgcaatagggctgtatctatacagcctaaacagctcacccccactgggaaatagcaacctccccattatggagatggcattatttttcaagatgatctgctctatgtactactgcccagcatgctatccataactctccagataaactgaagggactgaaaaatttatgaactcatgaattcttttcttgtagggaacccccagtcgaattcaccagaggatttcttatgcctatgtgaagatcctttggcaaaatagaaaatgtgtggggagagtaatgggatattgaaactgactcctgtttactagaaattctcttgtgactgtgtatgataaaaagtagactatgacatagtacagctttctaggctgtagtgcaccttaaagatatcatataatatagttaatccaccatgtatttttctttagtagttttacactgatttttgaagtaactactttaaacaaaatatgcttaatgtattatgtagatatttttccaacgaatcatatccattacaaaaattaaattagtataaacattaatagataataattacaaagtatttcagaaacagacttactcaaaaccacataaaggacaaacacaaattatgtcatccctcggtatccatacggggttagtttcagaaactcctggagatagcaaaatctgatgctcaagtctcttatataaaacggcataatattcgcatataacctaccctcatccttccatgtacttcatctctagatttcttataatacctaatccaatgtaaatgctatgtcaatcattgttatactgtattgtttagggaataatggcaaggaaaaaagtctgtacatactcagtacatacataatcattgttttttttccagatattttggatccatggttgaatttgccaatgaggaacccacaaaggactgattgtacacattattttgtttgatttcattatacctttataataaaatatttttcttatgatatttcttcaaggcaatttttatttgttctacagggcacattttggccaaacttacttgtttactccctcagaaaaaccactgatcagagaagacagttttctttagaaaactttcagcacattactttttaatgtatggctatcatagcatcttggttacaagtaattgactatataagagtacatttcttcattaatcagattttatttattttatttgaatcttcctaaagcatccatttgtgaattttttacatgaaaatgtatgcaacctaactttttttttctttttttagacagagttttgctcttgttttccaggctggagtgcaatggggcgatgtagctgggattataggcatgtgccaccatgctcggctaattttgtattttgagtagagacaggatttctccatgtgggtcaggctggtctcaaacgtctgacctaacgtgatccacccacctcagcctcccaaagtgctaggattacaggcatgagccattgcgcccagccttcagccttacttcttaaaggtttgtctagggaagtcagggagtttattcaagaaataatattttatgcctctgtggacttaatgttaaattcctcccaaagctcaaaaatatttcaaactatagcatatcaagtcctaaaaccacaaatttggtttgataaactcacatctcaatattctagtacatatctgtaacacagttgttgatatctcttcctctacaactaagttatattacttgagtggactctatagtacatatattaactttagaaacatttgcaaagaaggtgaggaatatttgtatgcgcacgtttacatgagggagagagagacggagagagtaagagagagagaagatagtttcaatgtagtgtttcttgggcattccaaattcattaggacccatgtccatttgggggtacagactctctgaaagcagtatatgatttatactatttaacatataaatttatggatctaatagtatatatctccatatcattctgttcacacctctgaacagggcaaggtgaaattttcgaagtttagaaagcaattacattgcgaaggaaaaatgaattgatgttgcttactaagagagatataaatttgcaggttgttttgttggtgctgctgctgttttcatttaaaggatcttttgcctcaagaaatagtttgataagtatagacactgagaagacttcctttagttgggtgcattggctcttttagacctgaagatgttgaaattgttcaaattatttgataacatggcttcagaatttgcactgatttgatggacagagggtttttttaagatactggacaacataatgttccattgcctcatttgtcatctcttcctattgtcaacaaagaatctctaatagttctattttcattctctctcttttggaaatagttgaagaattgaaaagttcacattaagatgcttttgggactctctaggaaatctttccatctcattaggctagatgcccagaagctcaggcagggaagtcagacagtgaatttcagatcaaatcacagaatcacaatacttttatggagtggcaataagcctgaagagggattaaataataaatcaacactcatcattgcttcaatatattattatttctgctatatcttggaacatagccaattatgggtcttttccattcaactgcagaaaaagagagtatgaagaaagaaacaggaaaataagctaggaataagtaagtgttcatgcagaaagtgataaatgctggaatactgttaccaatagaaatgaaaatgaggaatctacaagacatttccaaggcaatgctaatcaaataggtataagaaataaagtataggaaaaactaatccaatgatggatgcatttaattgaaatcaataaaaatattatttgaattacaagatattagaagagattagcaatagtgcatcaatgatattgaaatggagatttcaaggaactgaaattggatcttggatgtgttgttggaggaaaagataatcagtaaatagacactaactgaagctgaaacgcaagattaacttaataagtcatataattttttaaatcccaccaacttacaggtaataaaataaaatgtgaagtgattacaaatgattttccccaggtcaatgaatacattttccaaagcagagctggatgacatcctctaacagtaactagaatggcctacattacctcctaacccaaattctatacataacccaagacccaattcaaatttcacacttctctgtttctatatcacatgtactacttgtctgaagtattatgtattgtctttgtaatgtgcttattatgtagtacactaatatctttcgtaggtgtatttatggctgctacaatttgtcctagtagaactgtatgtatttagaagatgctctaaaaatgcttgcagcctagatgcaataaatgaaggagaagctttgctgcctttgaagtcaagttaaagttctggaagatcgttgtgctttcaaaaatgacaccatcgctcccacttcatgtacacattaagaaaaagcatattaggccaggcgtggtggctcacgcctgtgatcccagcactttaggaggccgaggcgggcggatcacgaggtcaggatatcgtgaccatcctgactaacacgatgaaaccccatctctactaaaaatacaaaaaattagctgggtgtggtggtgggtgtctgtagtcccagctactcaggaggctgaggcaggagaatggtgtgaacccaggaggaggagcttgaagtgagctgagatagcgccactgcactccagcctgggcaacacagcgagactctgtctaaaaaaaaaaaaaaaaaaagcattttatttattatatggttcaatatttttcaatagccaggacaacgttgacattttacatgaaatgcttttctttccatatacttccaagataagttatatccattctttgtttaaaaacttgtctctttcatattatttatagctgattttttttccagaaaccttacagctgttcttatttctttatatacccccttagaatatttacacacccagctcaatagatgtattaaaaatttatatatgtctatctacatttcaatatatttgttctttatgtgttttccacccattatccacattagattttctattttctcaaatgctcagacaatatttcattaagtcagtctgtcaattctatttatggttcatcactattagcatgccctgaaatgaagttgatgtattatgaaaaatgaacctgtgaacagggacattttttactaggaagtacagataagttaaatgctctctttgtgtgttaatctattatgcacaccattactagtagactttcatttactgcagagtattttattttacttacaaatagttgaaataaaaataataaatagcacaaatcttaattcagaattcatgaacacctattattttatgccaagcaacactaaatgatagttgacacaactggtatatagtagttgttgaatagatatttactgaatgaatgtatattcagaatgcaagaaagcacaacagtatcttcattcatcctgggtgttgatatactctgacccttgtgtggtacttaagatttacttatttaagaatgcctactatggtttatcaaaaatacttctttttttttttttttttttgagatggagtcttgctctgtttgcccaggctggagtgcagtggcatgatctcagctcactgcaacctccgccctcccgggttcaagcaattcccagcctcagcctccctgggtagctgggactacaggcatgcaccaccacacccagcaattcttttgtattttagtagagacggggtttcaccatgttggccaggatggtctctatctcctgacctcgtgatccacacgccttggcctcccaaagtgctgggattacaggcatgagccactatggccagccaatacatcttaattttaaaccactaaagcttacatggaaatgtagaaaacattacatttgctccaaattaaataatagcttaaaatgatattgaagtcccaatctagaagtttgtatgtcatgttttatatggtaattgtacaataaaaggatcagcaacaaatagagctaaattatttaatgcactcattaataaaaatattaaaaattggaatccaattgcctggtaacatatactttatagaacaatacacagcatctgtttcctttacacctacatgattgccaaaaattaagtcttagtagcttgcagtttaggttgacaactgagcatgcattgcacatactgaatagattttcaccttttcaactgaagagagttcaccagatgataattaatatctgctaagtgctcttcagactaacaggatatcatcaagaaatatcacaaaagtgttgacacaatgctcatccagctggagattccaaacaagtctgttttcactgccatttattgaaaattgtatctatgcaccagctggccagatcgttttcctctacccaactctcaacagaagaaaacaagattgtgctttttgtttatttgtgtatcaagtttatctagtttaaattgatgaggtggtagaaaatacacatttgaaattaaaattgaattatgaattataatcaccctaaccatgtaagttcattactttatatatatcaaacttaatttgtttcctaacatgtaattcattattgcagttcagagaaggagaagaaaattaatgagctaaaatatatgtaaaaactagaatatataatctgtgcataaacaaaaatgttagtgctatttgctgttatcaaattttgtttaccttattagagaatacagcttaactatataaatttgaatctttattaaatgagaaataaaaatggaatgtgcatataaaatccatgtaatgacatggtaaacagaatagcttctaaagtaacacaaatactaatttaaaccaaaattaagatctgtggtttaacttggaatgtgcatataaaatccatgtaacggcatggttaacagaatagtttctagaagtaacacaaacactcatttaaactcaaattaagatctgtggtttgacttcttaatctgcattttctttggccaaactgttaagaatagcacataggccgggcgcggtggctcacgcctgtaatcccagcactttgggaggccgaggcgggcggatcacgaggtcaggagattgagaccatcccggctaaaacggtgaaaccccgtctctactaaaaatacaaaatattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaagaatagcacataacatttcttatctaacaaggttagatgagaactgagggagaaaaaaatgtgtgagttgatttacactcttcttagcaaataggaagcacttaaaaaatggtagcttattattgtcatcactgatttttatagaaatatacatacgtaacatgttgatatgtgtgtcctctgtctcaaatgcccctcctccatatatttaaagatctacttatatttatttcctttttataattagtaattttctccaacatgaataaagtgaaggggcaaaaggagaaggtaacttaatgaccacctctaccggagtatttactttttattcactgctttggcggtacacgtctcttttgtgacctattttatcttcccagtcctgagaaatgttaaccataatctgaggctacatcaattacttacctgatcattcttcccttggaatcaaaccctgtgaagatcagatatcttaaattcataaagaatgaaaatccaaatattacatacttaagaatctcttcccccagataaatctctgaacattctgtgaaaaataaatgcatctaaacttctctaacttggaaaaagtttattttagtcattgttttatggcaaagatgagataagaagtgtgaagtgtcctaagttgaggatggcaatagatctattgccaaaaggatcacagatattccctaatattatcaatccttccctaatctccattcatgccggtattcttaatttgtgttccatgaatcaagggccactgggctatgactcagtagttctcaactcagggtgattttgtctacctggggacatttgacaatacctagatttcttttttggttttcaaaactcaaggaggtggtaggtgctactgataccaagtggatagaggctaaggatactgctaaacatcatcaacacacaggacagatcccacaactaagaattatatggctagaaatatcaatagccctgaaattcagaaaccatggaatgggcttttagaggtacatgattgtcgtgtgtgtgagtgatcattcagtaaaccctagaagggcattgtttcattaaggttattgagaataaatatgtcccccaaatgtttaattatcgctgacttagagtgaaaaaagctgtagaaaatagagcagagacaaagaagaaaagaagaaatacattatacataaataagctattgacatttagaaaataaaattagctagacactggattccacggggcaattaaataactaaattattatatatgtttgtaatgaatgtaatgcatatatacagaatgtaagccctcaactgttttgaaactctaccttaaaaattcaaaatgataatgagtactgagaaatagcttacaattgaaaactaatctatttataaattttctataaatctacctataaatatactaatgtatttttacaaactaaaattcaccaattgcttttttattttcatgaaaggaacaatatataggagccaataaaatcttcttttagtttgcttactaaatagctacatgacgttggtcatcttttaatttataattctccacataccttcattaagcaattcattaagaacaggaagaaaaaagtatggaaggtctttaaaaaggcacctcaatataaaatatggttttctgctgacttccaagccttttactcttacacattttaaaattatttttgttcttctgtttgcatcatgtgatctgaactatgacaagaccaaacaaaatgttttatgacctggtactatcaggctaaagtttgcagtgtaggatatgtcagtagttaccaagtatatagtatcaatattagaaaattacattaaaaacaaggagctatagattgtaactcaattcaattcagtcgacattaattcaggcactgtgctaggtgccaagcacacaacaagcttcctgaagagatggttaacggataaggataaatcgagtatgagtctaggtgccatctaaggtggataatctcctttatatgctgttttactcctcttctccttctatacattgatatttattatatgttcttcaaactccctttctcctgtacacaataacgactctttgtgacatctgaagaaatatttttttggttatcaagccatcatctaaattatgatagtggtttttagtatttaaaagctacatctcaaaatcagagggaaagttttttccatctgtaattagagaaaaaagttttactagtgtattatattccacagcaatgcagtgcatgttctcaatgaatcaaagctattatggaaagggagcttatacatggagaaaatacatctcattatatccttctaaagggtatcatgtctagttaatagatccttacaagagtatgaacatggggaagacgaataattgttctttgacaataatgaggtacacataaaactattcttgtatatggttctatcgcaggcaaaatcgctatgcaggtagagtttatcttttgttaatgctcaccttttcttttactattcttattcctctatttcagtagtaattactccaatttttatcagatgatttttgttgtgtttatttttctcatttaaagtgatttctaaaataatcagctgaaatataactttaaaacagtaacaaaaacttaatcatttactatgtactgtgcactgcactaagtgctttatacaaatttcctttctgctccttagagtaaccctaagaagtatggagtcattctcattttatcattttgaaccatggctttgagaggtaaagttgcctaaagtcacattagaaagtgaaagaatctagattactctgactttgaaatctgtgaacttaaaaattttagcttcccgcaaagggtttttatatagtataaagacatcctccatccttggtttcagccaaaatcaggattttattctctattgataagcccaatttttacaaaggatatttctgaacagaaactttcttctcattcattaaattatacaatctatatttgtaaacaacataaaataatttactcgtgcttactaagcgcttactatgagtcaggcactgtttttagaatacacacattttataaaaataagtcctcaaaccattctataaaatatgcactattggcacatagggttaagcactttgtccgaaaggtggtagcaagattgtgatttaaaatgaagcagttaactctagagatgacactacacataagtatgttccactattactctgtcagatacttttcaaactgactaacttgccccagtaaaatgggctatgaatgaaatacaaattttctaaatagttgctcaaattggaatataatattttaaatgaatcccagttgaaattcaatacaaattcacacttgattcagtatttcatcctacataaggaaaccaaattcttaaaagctgacatttacatgcagattgcataattacatttctttctgaaaagtgaacgaattacaaaaattagtctaggagcaaaatataaacaattgttgaagattaacaaaataagcagaaatgtaaacataaaatgtctgtccatattaatatagatatttctgaaatattctagatatagttatggcttttgtttatattatacagttagttgaattttagaaggatcacaaatgagcatgttataaaaaatcattttaacatttttgttctaggaggaaaaaatcatgttttacagtaatagcagaagtaaacaagtcagaatatgagcctaaacagatggccacagaataacctgacattaagttggtactataaatgatgagaccataaaaatgtatagctttttcactaccctttcacatatttacatttattgtcacttaagttcataaccaatttggagaccaacagtgtggttttaacacctaacataatgtattataaatattttcaattctgtcacattttaaaatagaaatttaataggcaaatcttctaataaatgtataagcatgtttctcaaacttcattatgcagaacactggtttaaagaaatacttctcagaaaaaaatccaaaatagttttattaaaactatatatttgttaacactatagatttgccaaaatggatatttaacattgtcatattaaatactgaaaggccttgtaattaaaaaaatgtttataaaacttttttttccatgaacaaaatttcattgagcacaaattgtggtgtccggcaccactttggcaacgcttggcataaagcatgcaaggtccctgttcttacacagaggtagtgggatactactcagccacagaaagaatgaaatcaagtctttacaacatggatgaaactggaggccattatcctaggtgaaataattcagaaacagaaagttaaataccacatgttctcacttagaagtgacagttaaacaatgtgtaacatgaacatacagagtggaatgatagacattggagatcccaaaaggtgtaagggtaggaccaggtgagggataaaaaattacctattaggtacaatgtactttatttgggtgatgtatacactaaatgcctagactttgccattacacagtatctctatgtaacaaaattgcacttgcaccccctaaatctatttgttttaaaaagaagggaagaaagacaataaatacagtatcatgaaagagcatatcacgtgggggaaaatgggcatcttagcatttcactgggaagctatcctagattggataactgggtggcagggcctgcttgctgagaaggaaccttttactcggaaacgtgagtggccaacaaagccagaatggtatttcccttacttacataaggtttggaaagtgaagtggaataatatatgtagaaattatgatttctataaagggagtgcattgggagatgaagctgtgccctgcctgagttctggaagccttctcctgaagtgaaagctcaaatagcactggtttcctttatagtgacaaaagaaatctaattggaacacaatgggagaagaatacacagggttcattacttttgtccttattaaaaactattttcttctgttgttgtctgtttttcctgtttccacttgtttacctgacgtatataataagcttttgaggacaagagatttttcgtttttgttttttctagtggatctcagtcatctaatagactactctcatatactaaatgctcaagcactattagttgtatcaatgaataaatcattattatctccttcactcaaaaagcaaagaggtttataaatatcaaattatcatttaaatgtatctccatgaatgtgcaataaaggtacatatatgcttaattagtggtacattatttgaagatatttgtcttctaaaattattcgcaacagcatataatgctttttaaagcaatctcttataaaaaaaatctgaagatcatgttggtcagttaaccaaaaagtaatttattatgtgcataccataaatattttatttttacttaaaatatgtaagtgtatatttatgtaccagtcttaaaacgtcaggtcagcatcttttgttagcaagtaactaagggactaaaattccacactgtatttcttctatcacatacagcttccactaagattaccatattttcagtttcttgttcttcaaagaggaatgactatttaaagacatttgtgaagcattctgagtgtagaagtcatctaggttttaattattttcctccaaattttttagttaccccatctacatatacttaaatattattaaaaatagttatttttaaaaattacctttatctagtattttcaaagaattcaactttgtagaaacaaaagtctttctcaacacattcatattaaacagactctgctaatctcaaaaggcaattaacaagtttatagtcatattaaagagaagtttacttacatgctgtaggcatcagatttttttaaaagagtgctgatcatatataagtcagctgagggagatttcttaaatatttttattaacatcatgtagatggataagcattcccattagcagtccccaagaaacatcatttggaaaaatgttcatcaagagtgatcaaagagctctatttcgtcattctttgaaattacctatgcaagttggatgttttagttctctggagtgaataaaatctgctgttatagttaaatatacgcttaataaaagcgaccttaaaattgcttcttaaaagttgtgatgaatgtagtcagtccaaacaaaacaaagagaatttttagaatctaaagttatctatacttgaatagttgctgttctaactttcttgaattactgctatgtaggcatatcttttggcacacacacacaaaaaaactctctcttacctcttatgtcccaaattaagtgaagtgataaacaaacaaaaaaaattaaaaatgacaatgaaaaaagatgttgatggtatgtggtgggaaaagattaattttcaatatatcatactttccctgattttcttatccctatgtagattcatttccccttagatgtttccatcatttatgtaatacatatattcactggaaagagtaaaatatgatggggaatggagcacaaaaggggaaacggtgttctctggaaattagaggtatcactaactatgacaggcatattcaatatggaggctaaaataaaatcaaaagctgttctggagtccactgaaaatgaaataaaatctgtaactctgagtagtttatatctgtgtaatcattaatatggagacaagtatacagaataagaaatcagattgagttccaatccaagctttgatgtttacaagacatttattattcataacaaaaaagaggtctttcaccatctaagcctgtgtttattcatttgtaaaactggaattttaacacttgttctccttccctcataaggctgttgtgatatttaagataatatataaacaatacaacattttaagatacaaatattatttcaaagatatgaaagaaatatgtttaaatttaaatttaaaatttgtaataaatatttacaattatatcttgatgctattttaatgggattatttagtcgcattaaatagctagatattctatatttaagttttaaatatagaaattagtcactataaatgattatattttgaacaataaagtcatatttctttgttgatatcttatgctacaatgtcttctattatttgttatccaaattaaaataacatatatatggaaactaaataattttagagtagtattttagttcttaaaaactttttaaatattttatgatatttaaatgaattacttttaatgacagaaaatacagcccctactaactcgtacaaaacgtttaataatgcatagactttctcagtaataatcatcatttaaaatgataatgttttatttcttcgtagaaaactacctttttgaacataaagagaaatctaaaataatgtaccaaagtttaagttttctacagatggaaaacacattaacaataaattattttatttatgtcattttgaagattatgttaatataataaatttataattattataaattactgtactgaataaatttccggttatttatttaactgtcatttcttcataagatagttcaatggttgcaaataatttaacattttctaattaatcaaagttgaataactatatcacactactaatttctgtataccttacgtagcagattttttttctctagcctacacttacactaaactcttggacaatctttttgttttaattatgcataactgatgatagctgtttgcctgtttaaccaccaacctatctgatgatgccaaatgaaaatcattcaaaatttataatagattgactctttcattaggaagatagttttgttagcctttaattttaattaattttgtgatagtaaggtcaatcagtttcaatatttctattaatctttgagtacatcaaacttcctcttttacattttttctccaagaaaaataactgaaatgtaaacacccaatttaattaaataactaagaattaatttgagcctaaagtatgtaactaatatactacagaataacaagtcaattgttaagtgtattttaagctttcaagaaaatgaaatatatgcaatcaataaactatttattgaattccccactaaatggtaatataccctgtaggcaccagaaactaaaagtttttacctttaaaaccaaactaagaattatttgtttcttaaatctctaaggcatgcactattaagcatacctgctaagaacttaaaagatatttgaaaaatcttcaatgagcttcctatttttataaattttaaaaataattttcttaataggttatacaaatcataggactgtcatcattatcataacagaatattcaaaataattttccaactctgaagtttatttgattagtcctactagataggacttaattcttcttcctcacttgtgatgtcctattttatactcccctattcaaaaaaatactacagtatgtactctagaattgaagtgattttattaagtaaaattccaaaaataatcttactttgagatagcattaaatttttaaaatatagcaccttactaaactcctaagatcatcgtttgtgagaatatttcccatccatgttattacatcatcataatgttattgatattaacattttctgggagtatggcagttatatttacagaaaagtgtgcccttggcctcacaaaacttctggtgagtaattgacataacattgtaatgaactctaagaaggagatgccaatacatatttacctcaacatatattccaaatggatctatgtaaactatgttaactaataacaaattttaataacttaataaattaaaaatgcatatgtaccataagtacatacactgtcaaactaaacagtagtttaatcctcagtactaatagtagtactaatcctcagtaaaggattctactgagagaaacaagttttttatagattcacttactcatttctacacaccaagcctgttcaaggccttaagagatacaaaggcaattaaggtaacagcaccaggtctatggctgggtagaagtcttttataaaatatgtatataattaactaaaatacaagaaaggaacttctttatattgaccaaacacattttatcaaatcctgtattaaatgcaaggtaaataaattcactaggtaaatacattcacaaatgtgtgtatgtatatacatacataaaaatctaaaaaatgtaccaagtgtgtgtgtatatatatatagacagataaacacacacacacacacacacacacacacacacacacacaccaatttggaaatgagaaaaaaacaccattgagctaaattcagagaataaatagaacttgaaaattattaaaacccttttttttgaaaatcaattgatgaggaggaaaatgtcccacacaagacagggcaatagcaaaaagtcctatctgaaataaagaataattaataagtccctaaagcataccggagggtaaagaagtaatcatgttatcagaaaactttgatgttgattgctatcagctaattccttataatatcgatgaaggtttattgttaatatttctaaaaatcttactggcaacatttgtttattttgtaccaggcatgatgttgaggagcttccaacgtttaccttttttaattcttagaacctataggttaggcattatcattaacccattttacagtgaggtaaccaatcggaatcagtttcctgacccaatttttaaaataattcatagaaatatgccactatttgcaaggaccccatcttacatacaatgcatatgtaattttaagtagaaaaatgatgaggctattaaagggttttatgagaaatttgaaatagcaagaataatatattcttatataggagaagaaaggtgaacaggaattttaatgtgaaaaaagaatattatcaagaattttcattttagggatttccccatactaaaattatatacattgtgccctacttaaagctagataatacggaaaagtccagatattgtctgtaagaaaatagttatatgtatcaaatattaagataatttttgaatgccacaagaatattcagaaaatcaactcaccaattattgaaattgctagagagaagtgtcatccattccattgtgcataggcatgttaaaataattgataaaataaaatcacagaagcatgaaagtgctatttcaatgaagaattatttgcaaaagaattaaaaatatcgtttgctttgttggtaaaataaagcatcagatgtcccttacacatatttcaaccaagaaaaaaggaaaacacaagtctattgaaaaaagcgtagtatagtaggagaaacacataatgatggtaagaagattatgatgctaacagaagaaatgatgaagaaaataaaccttcatagactttcagaatatgtcaaaaactgatgataaatttagaggaaaatccatgtataaaagtattacagagaaaacagtatgaaagaaaagcatcccagatggaaaaaaaaataagtccaagaagtagaaacaatatgtgtgaggtcgccatgtcttcagacatactctactcttcacggtatcagaaagctgtcttgaatttaaaagaggtgaacctgagacgttattagggagcaaacagaatacaccaaatacaatataacatgtaacaaattctttaactaaatttttctggccataaattatagctatattaaaggaagaggaggaaggcagcataagaaagaaaactgataatgaaagaacatgaactgtgtctgacactgcttttggcacattcacgtatattattatagtgttcacaataagtatgggagtagctctcagtatttccattttacagacaagaaaactgagtctcagaaaaaccaaataacttgctgtggccgctgagctaagagttagtgaagcagaaatccgcacgtaagttttttgtaacacacaacagtgtttaagaatatagactgaattacaatgtaaattcaatagatgggaacttatctcttatcatcattggatcttaaactcacagaaagtggatagcatactacagggactcaatgcataaatgctgaaattgggtgaatgaactcctgaaataacagattacctataggaaaaactgtacaatgaatggaaaaatataaatttacaaagaaagaaaaattaaaaatcaattcaaggattctagaatttagtaaacatattctatacaaatatacaggattaataattttaaataatataaatcaatgctgttgactatgtctgttacattcttatgtatagccaaatgagataacagactaatataaaattgatagaacaatataaaatggaagggtttaagaacgcgaagaaggagctagaaatgggttataaaggtttgaaagccttttttaacaatatgagagaaaaatagtactgcactggaaaagctttggatatgtaaagcagccacagccatcataaaatttacacttctcttgggtacacatgcaaagtctctagaagacggatatataagcacattttaaaagattcttaaattatgtgctattggatacaaacaagttttcactcaattaggctataaactatataaactacttctaccagctagcagaaaaaggcaacatatctaatatgtttgattttattcattgatggcaattaaacttaagactctataacttactactgacatgttattgaaattggagtacaaggaacttttataggtctctgaatctttggatcttcctatcttgggaaataatggtgcttaaaattattggctgcctaacccctttcaaaggagtgaatcaaggtgattcagctgttcagggttatatcaggatgggcattcagatgattaaactagggacttggaatactataacaaggaactactgattttcatttcttttaaggactagagtgcacaaaaaagcttcaggacatattgcggcttttgaaaggaaatgagtctgagctttggagacacacaggcctaggatcaaatcatggttatgcattaatagctgtaataaagttcggaaaattactcagcttctatgaggttgtttccccatttgtaaagtagaaaaagtatagtttgttgtgaggattcattgcagtgaccaatacattatacctaactctaagtgatgttcaatagctgtttatttttttctgttatcaatagcttgtaatcattagggatggaatcatttatggatgagaggtttttttcagaatatctatagtagttttaaaaattcaaaattttcctatctagtaaatgcatgtgaccttttaatatatatgcatatataatatatagcatgtacatttaatatgccaaatatgtaatctcatttaaacaatttcacgtttcttcaactatagaacatactttctcgatgtttttaatcactgtagacttagaagctaaaaggcagttggtgccgagtaaatgcgtaataaatgaatagccaataaatctatcaattgttttgatctcttttagtaagagttacaagataatgagaaaggcactgggcttgggataaaggacttggattgtaattgtggctcagccactgcctaactgttccacctgggtcaagttaccttcccttgccaaactacttggctataagagtgggaaagaaatagcttattgtacacagctgtgaatgtatgtcatatatggtagatgttctgggactgtggattcaatctgaatcatgatcttgatgatggctccatcatcatgactataaaacactatgctatgcattttgcaaatatgcagaattaggacaagcattcatacataattccgagcttttattcagtatattgcctaggcaacaatggcaatgtatagggaaagttcttgcccatacctactgcttctgaactgcattgccttcagcataacctacagatgctccaaggaaccataagaacatatctaatcctcaataattatttgctacactatccagaatccagagtttgctaagtttttaatgctagtcctcttatcaactattccaatattatcaccagctgtcgtatcttccattctaaactgccacaaatgttcatcttcatcctctgactctttcactgtcattacatatttctaattagtcttacttcctctcttctgtttctttccatttctcacttatgtcctcaatgtttcatgtgaccacccaattatagtgatctctcacttcaagtaagtgaatcaaatcaccatcagtctgctgagcataaaatttgtgattccatttcttttgagtgctctgggtctgcaccccaacagctaaaacacgttttagtgtgtttctacttccaaatgtgaagccaagtgccaataaatttcaaagtgagattagcagaaaaaaagcagcataaaattattagttaatgtacttttagtacttactatatgttatgtactgttagcattttacatgtaatgtctcatttaatccgtgtacttctgttgtggagacaaggcttttgttcaaggtcacatagccagtaagtagagaagcaggaactcaagctctggttacttccattctggatgcctcaaagcatgaacaatttcaataaaactaagcaatcatgatagatgataaactttgcaaataagcaaaagcaacttcacgtctagaattaataattgttgaacaaaaataagtaacataagctcaagaaagagatgcagaagatttttcaaagatgtattataatccctcaacgatgtgaataggttcttggaagctgcaactttaagtgaaacaatgtacaacaggtgattgaataacatcattttgttccatgttgcttccttataatgctgaggagggaagaaaggttattttcattatacatcattttgcttaagtcagagtttctaaaaacttatcaacaacattaaatgagcacttactgtatatataatatccttctgtgaacttattccaaaaaatggcccctgacccaattgcaggccaaggtataaagctgctatctatgttctaaaataaatatagactagtaactaagaaggaagatatacacttggatgaaaaatataattttcaaacttcaatacgtacagtgtatatcacttcatcatggaaaggttatatggtttggctgtgcatccacccaaatttcaactggagttgtatatcccagaattcccacgtgttgtcccagaattcccacgtgttgtgggagggacctaggggaagtaactgaatcatgagaggcggtctttcccatgctattctcatgataatgaataagtatcacaacatctgacgggtttatcagggccttctgcttttgcttcttcctcattttctcttcctgccaccatgtaagaagtgctttttgcctcctgccatgattctgaggcttcaccagccatgtggaactgtaagtccaattaaacctctttttcttcccagtctcgtgtatgtctttaccagcagtatgaaaacagactaatacagaaaattatgggtttagaatttttcagttatgtaataaattataagaaactaaatatattttctcttattatagttctaaataatgaaatttctgggcttaattctatgtcatcccaagtgatctaaagtttaaggtaatttgatgagaagtcactaatacagcttaaaatgctttcctccctccctttcttcctcttcccttcctccccatctctactctgattctttcactcaacattcaggttttgaacgctaataacctaccaagcactaactaagtagtctacatgtcattttctattcaactgatcaatgaccaaatatattaatttgaaaatactttcaaatcaaatattatgtatctaaatatattctactgtaagaaatattctatttattaaattagaaaaactttatgatctgtttattagatacccttatataacaggataaatgttattagagaaaatacataaaatatcttctgattatagctcttatattcacaatatctcttaaattcattaatacctctaaatttaacttagttgcatgaaaagaaaggggtttctgaagacaatggaacacatattttccatggccctttaagttatctaaaacctttacatattttatggcagtagccacagctttaaacatacgctaatacacacacaaactctatcaacagcatgagcatgagcactggacctatgtccaaatgacttagaaaaattcagtaaagaacaactttgttctggactgaaaagggttataagcatcttccctaaattgagtaaattaccagctatttggaaagtacaatatattggcttttattcaaaagagcaacatttaattctggcaacactgccaaattcctcctttcctctattctccttttcttagagaaagtgattaagagaccaattcccatgccagctgaatgcttataagagcatcaaaggtcctctgtcagaattcagaacctgatatggcttagaaaccactacaccaatagataacatcctcaacattataaatcaaagccatatgaccacattaaaattctatcagctagtatcaatacactgtggtttataaagtactgctgacctacctctaggagatggttaaaatgatacaaaagttatgctctggtttggggcatgtagctactttttacaattgagttattcatccatattaacagcaaattctttctacctctatatccttattgattttgtttaattaaagctttaggagaaaggaagagaaggctccataagtcgaggtagaaacagaaataaatgttaggaggtcacaatagacattttgctattttgaactgttcctgttatctgttgattataattgtcaagggcaaaagccttcccatataatttaaaatctgggatcttcttaaaattataaccacatttcaaaatcttacaacaactaggtcattgcacttcaaacttttctgcttaaaccgacagtaagaatacccttgaaatcttaacatagcacatacacacacacacgcaagtacacacaaaatagaagttaatcaaagaatactttacctttattatgtaaaatgccttatattttagtacattttatttaataatacctttagcaaaaagtacattttcttcaaagtagactgtgtcctgtaatttaaataatttaaataatatttccaatgtatatctcttaaaccactaagactgcaggaattatttaaggcagggactgttgatatatggatttaaaaaaaaaaacacttaaatacattcatttcttcacttacccttccattgattcattaattcaaaaattagtagatattggcctgatacatgaaagcttctgtgctaaggccctagggatagctgaatgagcattttaccactacaaacccacgtgttgttctttttttttttttttagtttccagaatttggctttattttgcagtatagaaatcatttggagccattttgagacagaagtagaggctctgtcaagtcaatactgcattgcagcttggtccactgaagaagccatgcctgagatacaaaagatgtgctacactttacccgctttatgttcgattcctctccccttttctctcatcaactttattaggttaaaacaccacatacaggctttctccaaatgactccctattgtctggagtttggttagaattttatgcccacataaaccaaacttgtggctaggctatttgggccctgccataacatttgacataacacaaaatataaagtcatagggaaaacttctggatgccatcccaaaccgtggactattcaatttagaatctcctgaacctcaagaggacagatggcacacaactgtatggatccagctcttgagcagcagaagcacatagctacactgattaaaagataaactgtctcaagttgtctgtatcggtatcccaatgtttgtttaaaactgatccaattaaactttacagtgagtctttggcaagatatggcgaaagcccatacctttaaccactctatggccttggagaactgccccaaggatttgcaaggctaagtgctatttatggaggtacctatatgctgaaaaaacccattgaagaaatcattgtgcagaatggaaaagtaattggagtaaaatcggaaggagaaattgcttgctgtaagcagttcatctgtgaccccagctgtgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacgatgtagcagcacaagggaagtacattgccatagttagtacgactgtggaaaccaaggagcctgagaaggaaatcagaccagctttggagctcttggaaccaactgagcagaaatttgttagcaccagtgacctcctgataccgaaagacttgggaacagaaagccagatctttatttcccgcacgtacgatgccacccatgtgtttttctaattgaaattaaaatgacaaagaaaaacagaaaatacatcttcacaaaatatcaaaaaatttctattatttattcataatgatcttaaaagttataccacatttttttctgtaatagatacagcagagtaattaaaactcaatttgataatgattatgactgtagaaaaatctgagattttagtctctagtcatacggtaatttttgtttctactggttaatctgaaacacataaaatacctgacaaaataaaatgtgaaccaatttaacatttcctttagaaaagcaaaaagacaggtaataggatactcctagggaaaaaaaacaataaattttatttttttatatgcacagaaagtgccaatgacaatctttaatctatcagcaagcttccagagaaatgtaatgaatgatatcaagaaatttaacttccttccaaattcagaaatcctctctagagcatccctgagagagtcatttaacgacagtcttaaattatcatttctcctgaataattacagaaaaatgtaccaatagtaggactcaatgacaatcgcttatttatatatgagccagacacaaacataagtgtcttttagaaattgttttacagaagtaaacgagaaggtcaccacatcatctgatatacagttaagagggagaggtggcttttatctataactctggctacttgagagcttgaggcataaggatggcttgaggccaggagtttgagaccagtctgggcaacacagtaagacaccatctctaaaaataaaaataaattagccaggtatgttagcacacacctgtagtcccagctactcagagggctaaggcaagaggatcacttgagcccaaggatctagaggctgcactgagctatgattgtgccacttcgctccagcttgggggacagagtgagactccatctcagaaaaagaaaagaaaagaaaagtgtaagtcatgtgatgtctatactgttctaatttctgcaattttgaaacaagatatggtagaaaaatgatctgatttttaatcaaaagattccactggtttgagagactaattcctacaacagtcaaatggttcaattagggatattgttatggtcacatacttcataaaaactagaaactttcattatcacctcagatgttactctatataaagaaagatctttaatttttattaaattcaataggcaacactgtatgaattgtcttagcattctgatcacacatctacaagcagggtttaatcatagttatttttggctcagtcaaaaatataacactgttattgaatctcatcaataaatgttcatcaatttattttccacacataagaacgttatatattttcctactgaaattattaaatgatatatgaattcaatattccatttattcatttggtttattaacataatctgtgtatggattataaagcctcttcttttttctttgtaatatgcctcaatattcttatggtttaacttctatgcgtgtttccttaaaaaactattacatccagtgctggcgagcaacacttatggtgccactggcaaagcagtcactcaatcaaatataattaaatcacaaaaactaccacttttcactatgcatctatcaaggttctacaaacaacacttaaaccgttttggatatttaaaatgggagaatttaatgcaggaaatgtattttaaaggagatggaatacctgggaagccaaatagaaggtggtaagataacccagtggttagtaacatcaggaagccactactactcctaggttgaaggaataaagggataaagcagtaaagagaaacacaggagctagttatcagttggaagttggaacaaaaaaggttccagtgggagatgaatacagtgatatacactgcccaaaacaatgaaagaagggagaaatgccctagcccctcaattcatgatgttgtcccttcaccaaagactactttccattggctaacgacagcctgaagatacttggcaaggaagactgggaaatgtagcttgagggattagctccagcctccacccgcagacccccctccacccccataacacagaatagcagatggacaaagtatgggtctggccaatcaggcctagaactgacacagaccatgatgtgaacatttctgtaaattctttagaagtcaggtattgcagtattaacttattccacggagtgatttaattgcaaagtctatctatttaaaacaagtagtgcattaacacgcttgtgttcaaagatctatacaactacatgggcttttgaattcttctgaactaaaaagatcgggcaaaatacattcatctagaaaattaaaaacattatacttttattaatagttgtgtactaatgtatcaagtaatatatcttgccaatagaacagttctgcaaatcaatataggtaacatttagcatttattacatatcctagaacatatttttccagattgaccattctgataattcattatccctgctctttttaaaaagagaaaaaactcaggattttaaaactatttcttcataatactatttaataaacatataggttttaaaatagtgccttaatgtcctaaattgaaaatatcggtaaagttgaactgtgtatttggaaggtataatgcatcaatgtgtaggaataactcaacagaaaatgtgagtcttgaatattattccaaaagtacaccataattgatttttactgctattggtaattctgtattctcatacagaaatcatttattttattgtaactaacagcatgcatttcaaatcataactagttaatgtagtctaataaaaaggcaaatgttgtgaacaaataggataagcaataataaatacttgtcatattcattcataaatttacttgtaaaagttttgcagtttccaatagtgtagaaatacgccctaagcaaaaggcttcttccgtattagagtatcatagtaggatatcacataacttccattcaaatctattgcattaaaatgacaagagttgtgtttaactctgctaaagtaaaagaagatatcacaattaaggaaagaatctttcttcctttcttcgattaaagcatgacaagcagataatagcatattttgaattcatatcagaaaggcggctaaaaaagtacaaacttcatagagaagggctgaataagaaacagattgaaaaaattagcttaaaaataaccgtgttttaaaaatgtgcaggcactgggagaatgtaaatgagaatgttcgtagtattgtttccaaggggtattaaacatttttgatatgtttacataacagtatttgttaataaggtaagaataaagcaactggttcatattaaagtgactgcaaaatgatttttttaagtctcctgaaatttatgtattgttctagagcagagttatattcccctgaattctccagttctagaaacactgggtactgaagcataaccaatgtggttctagcacttcctgttctctactagatcagcccatgacacattaactcagatcttccatgttcacaaaatgcaactcaaaacatggaaaaaaagtaaatgtctccatacaagattaacaagttctgttaagaataaaatactgtatatattaaatgtagtagcaattaaagtctatatttaataagttaatggcaacagtttgtgtttatagcaaattacaatgtattttagacatcatatattttttaaatacaaagcttaagaaagggaaatatcaaacattactatattgaatatctgtatcattaaatactttatcaagaaggtccaaataattcaagtgaatcattcagaaatttagcacagaataacattattaaaagtaagaaacatctttacacttcatatatatggcttcactaaccctaaaagacaaagttaaaatgataaaaatattaaaattattaagtggaatgtcatcataaatcctgtatttaagctaaacagaaaagatgatttacaaaatgatagatacagttagataacagaatgaatttcccttgggtattataactccacttaaggaaagttttgtttttcatgatcctcttctcaaaaacagatattctggcacttaggagacagaaatgtatcatttgacctttaaacttctgttttattagtgtaaccacaagcaacagagtcactgactggcatgtttgcactttatggcctttagcacttaaaattatttgataactgttatgccactatttgttttttattaaagacactgtgaggaatatgttacattaaaaatagaatatattgggctaagcttgatgaatgatatgtaatttggttaagtgttctcttgagcacttcattcatgtattttgatgggacaagggcatatgtttgaagggtagaattttgttttgttttctagtgagttagagaataacaacagatatggttttaagtatacaaagaaaaaacaaaatataactgtaacattactcttgattaaaaaacgatgcatcacctgagttgcctatactcaattagtccttaagctctatctgtaatggtctatgatcagaggaaattaccagctgtagagaagagtcaagaaaaaaataactgacaatatttaacattttctaatggagagagaatttcttataaatggatacgttaaattagtttaaaacctacagacaatgtaagaagttcaacaactggataattcttagagaatttcagaattactgtaagcaaattgctttgagtaaaagtaatgcagttcaaatttctatttcatatgataaaaaaatttaaaaactaaaatctaatttgttagaaacattattgagaagacacagagactctgttctctttaagaagtttgaaagtcaagttccctcagtatcacaaaatgcgggatatagcatcaaaatggatgaggtacagagcacacaaagtaaacaaggactgcaccaaaccaacaacactggaaatatatggtccccacatattagggaagctccactgttggaagcaatgagtgaactaaacatgggtctcctggaagcagaatgtgggtccagctatcttcactaaccatagtatttattaaattgttgtttgtttgggaaaccaaatgccaggatacattattgaaagaaaagcagtctcctaaaccctttagggtggaaatggtaatgctcactacaaataagcaatatgttgcttgctacaaaaatacatattgcagctcccatgatatgtgtttgcaatctctgaagatagtgtcttgcccttaccactgttgttcaaacttctaaaacaaacttaacataaagagaaaatacaggcttaatttatatcctctctgtgacaaagaatttatcactgttaccaacaatgaaaagtttttttttactgtgtaatatcaaagatattagttacttttgtatatagtggcatttgttattcaaaacagaaattattaaaaacatatgtattagtgtatattaaaaaatacgatagtattccaaatttgaactcataggcatgttccaaaaggtgtaagtcatataccacacccacatcattaaatttaaatatgttgcatgtttcaaacagaaacatttcccactctctttcaccttagacatgtcatgtacactgatgttgtgcaagccagacttacaagccaactaccacccagtggagaaaaagaagatctttcagggaaatgtgaggtggggtggcagggggagaagggagggtgatgggaaagaaatgaaggaatagggcgtttagctttgtttagatctaagctttgctgatcatccatttatattttcataggaaataaaatattcccagactcccactctgcagtgttgcttaggggtaaaatcagggtatggatgtttattaatgacaaaccacctcagagctcaagctcagaggaaagaagggaaaatgagaaaaataagtaaaagtgaagactgatggagggaggaaggtaggaataaaaaggggatagaaagacacagaaagagaaaaagagagaagcagagacagagtgagagcagcgagtgagacaggcagtgtgtacacatgtgtgagtgacaatgtggaacagagaaggagagtatgccttttaaaaacagtgagagacaatctgaatgtggaagtggttcttacagcatggaagtgccagtgcatgtgaggatgtgagagtatgtgagttagtatgtttatggaaataagatttatgagggtgagtaaatggtactggaggggaacagtgaccatgcctgtgtgtgccacaggggtgggaaacggtatggggagagggatgagaaatgggagtcaaaagagggaagacagggcacaggatagggacattaaggaggaataaaaaaaatagacaaaaagaaaaaagggtaaaagagaggaggaaaggggattaaatgtgaggaacagaaattagagtcgtggagataaaaatgagaaaatatgagaagaaattttaaaaaggagggaaaaaacagaaaatagaaaaggtatgaaaagagatattggagggaaaaagagttacaaggaggtggggaaaatggtataagagaatgaggaaggagaaaagaaagaaaacagaaagcggtaaaaggaaagaaagataaagagcaagaaatcgagcctaagtgtccaagtgagagggaaaataaatgggagcagagaacagcagtttgaaagagtcgcttatgctggagtaaaatagaaacaaacctgataaacttgtcagactctccaggagtaccccatgacagtaaaacagagaccttgtgcattgagtttcaaagtggcacctgcccctccttctaaacctgacagttcactcatccccaggctacttggcgttccggcaaagtgctttagcatcacgagtccagcttgctacctgccccagcataaacgggccggggctccgggaagaatctgcacctggaattcttgggatgtggtctttccatgatgagcaccaccagcattattgcttgtgttataaagaaggcaaagagggttcaaagagagacagaaagatagaccgaaacaagtacgaaaagcacgccgttcttcctacctaagcaccgccgtgtccccttttctgaccatcatgttgtccacggccgcccaggggaagtccacactctgtccagccgggaggcaggagggtagcaggcagcacaggctgaggagcaccgccgccagccactggttcgagcaacaagcaccctgcaccaacagcatcatgtccatccctgctagggctgctcactctccagcagctttcagctcgcactcccccaccccctggtgctggcgagtcttcccgggaaccaggcggcgcgccacaggatttttttttttttttttttttttttttttttttggtgggtgggtgggtttcttttctttctttcttccccccaccccagttgttgggtgttgtttctctctttttgtttttcggtgtttttgcctcccctcctcctcttcgctttccctccctccctcccctccctccccctggcaccacactacacctcctctcggttgcttttggccgcgtccggagtgtgtctaattctcgggcggctcgcacaccatctagcgaggaggcgagcgcgccggcgagtgagggaggaggcgcggcggcgggggaggaggcagggcgagcggcggcggcggcggctgcaatcccagcagcagcagcagcaacagcaacagcagcagcagaagcagcgcggagcgctgcgccggccgccggctcccgggctcgcgcgcgttgccaagcggccgtttccttagcaaccccgccaggggactggggatggagaagggagggggattaaaaaaataataaaaaaagaaagaaaaaagatagcaagaaaaaaaaaagaaaagcaagacaacgaaaaaaaaaataggaggaactgtatcacaattatgcaaactaagggggaaagagaggcaccttagaatgaaggctctccttactgtcgtaagcgctagagggattctttgctagaaaagtctccgtgtcagggctggggtgaagagagctgaggggcgctttgccttccctcaccggtgcgttttacctctcgaggcaccgtaagtttgaagtcctccaagttgtggtcggcgccatcatgacgccggcgactgtgagttgtttttttgtttattttcttctaatcttgcctgggtggctacgctgcagttagcgagcagccaactagttctctctgcgttttctcgggaataggtagggacggtggcggggcgctgcttttttgcggggacacgaggaggtgcaaggccttgcggcagagcagcttgcgtgtttgtggcggtcggcccgtatggattgcaggacgcccctcttttatctgtgggtgttgacactaagttgtgtgtgtgagtaggggattgtttatggtcaacatggagtgtgtgtgtgatagagagcgtgtcgtgcgcgcgggggcctgtgcacgcgcggcacgcaggcgcgctgggagggacggggcgggtcatgctgggatgtagagtcgggaaaagactgcaatcaagtgttttaattgtgtagagcccaggcggtccagttatgtaagaggcagtttaacccatttgagcctatcaggccgaataatcggcgcatccgagtcaaggcagggcagagttaaggggtttaacgagtcgcagggttgtatttcttaacagcctccacaccgcgttaacaggcttgctcctccgcggtgcagagcggtaacctccgcttccccacgcagcagcccctccgcagctcgccgggctgttttcagccctgccctggcccaaggcagaaggagatactaggcgtggggccacccctactcttttttcttctttccttcttgaactcatttccagattcaagatccttaagcttttccgggccatttgcaaatcaatgcgagaaccgaggctgagtcgttagcagttacaccaatcaatcttgttcagcgaggagtttgggaagcagagcggggaagtgaaaatggaaaataagtaattaaaaaataagctccctccccctcacacactttttcccttcctccaccccatccccctttagcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctagggaaataattgtgaaatgacagactctcactaatatcgatgccaaatacctaagtaacactgtcatcttgttaactgcatttttctatcttgcgtggcacgctgatggataaagcgtaaaattatctagggcaaacgggggattagaagacttgacatgtcacatacatgggcaaagctatgcagtattatttagcatttcagtagaaacgagctagattctattgaagagacacagaaggtatagcttcctgcattgtgactcagtttagtgctattttaagcagggatgggggtgccagtgttttctagtacaagctatgaaaagcatccttttctgactgctgtttcccagagatctgacatcttcagtgtccacgggggtgggttgggggtggtaggaggagggttttctttgaccagggatggagctatgctgcagttttaatatgtacaacaacccttcaggcttgtaaacggaaactggagccacttcttttaaagacagtttcctttccttatttctagttttttatctcaactaccattcacagatcacacttaactcttggagaacccatctaaagaaagcaatgactgaacttagtgtatagatgtctggattatgggggaaagtatttacaggtacgtcactattatttacagcaagtgcaagaatgtcaggtagggcagcctctccagacccttatacttctagtcttctgactaaagaaaatgaatttaaaagcttttatgacttcctattccctaaacctttctaagggcaaaacatctgacaggcttttacgtggtttctaatatttgcttttgaagtcctggaattcttacaaacagagacttaaattcggattgtcttggctctttttgagggaaaatcgaaacaaaaccaaacaacaaccaaatgagaaaaaaaagcttaaatagcaaatagttccttagtagaattttttgaaatagaagaattagtaatagcattgtttagaacattttagaggcaaatagtggagtgggtataatgggttactcctttggttagaattttaaggaagtgacattggaattaattattatttctttataatgatgtaccttttttcgctttaaaagctcaacttctagtatttcaagaaatgtaataatcagtagggagttagtataaaaggagaaaggtggagcctgattatgattgcagattatttcattatctagattgattccactcctgcctttcatgccctatgacctgtattttgaatccctaaggatgttggaaagagtaatgttatataaggaagcttcttaagattgcttactttaataaactcgatttttattcaacagtgtaactgtgattgttagaatggaaaaaaatagaagtttacatttgtttattagtagtgaatgagtaaagccagcttcatctttcatgttattttgttttaatactttgagatctagggtacatgtgcacaacgcgcaggtttgttacatatgtatacatgtgccatgttggtgtgctgcacccattaactcattatttacattaggtatatctcctaatgctatccctcccccctcccccctcccccaccccacgacagaccatgttattactgtgtgagcatgagaagttttagccaagacgggtcccaggacctaatggaaagagctaatgagatcactttgtatttcctgaaggaggcagtcaggaagcccttataaactgtacctctgaataatagcgctctaacttggtccataattgattctctatttgaattaagctgccttaagcttggagtaccttgccaactaaaactgacgtatactgatgaatttcaggtcagggtgagaaatatagagttccagaaatttgttggtggaggggaatcttccactacagaagtgtttctcaatctaggcccttttgacattttggtgcaggtaatttgtgtgtgtgtgtgtgtgtgtgtgtgtgtgtgtggagcatggggacttctgtgtgccttggaaaatgtttatcagcatccctggcctctatccagtagatgccaatagttgtgatacccagaatttctccaggcattgttaaatgtcctgtggattggaaaggggattactccaagttgagaaccacttcattgtaagttatatttctaaaatatataccatcttgtgtttttcaaataaaataataaagcagatttttttgtcaaaagtatctcatttggattctatagctacaaaaagagctccttctcatcagttcaatctctacatttacttgccatgtggttgagtagcccaggttaccacagatgcaatgaatttaatggctgacggcaacaaaatactttctaggatttcttcctaaattgtaggagacttgctcaaataacattacaattatacactaacaaaggtcttctatattgttgtaatgtatagtttggttataaatgttattgtaaagtaggcgagagggggtcttttatttaagcaagtattgaactaatagttctttgaaaggaaattgtcattttatgttgttttttccaaaataaaagtgtaagtaaatggtgagcttattttgggcaataacccatgtaaatatttgccttctttatattgtgacagctacatattattcactctggaaatggctattgcataaagaagaagaaaaaagcaaaaagttatttgcctattgggtcattctatttaaatatcatatatttattcagttataatttatttagcatcttatctattcaccatcagcattgggggtaagcaaagaagttagaagcgtatatgtgtgtttgtatgtttggaggagtgcggagatacctactctactttcagagctcttcaagccatttccatagaatggccctgaaaatttcacctaagtacttaaacaagaaagaacagtgttacaatagatatgggtagaaatcattttcaaataactgaagtttctacctttctacttgtaagaaaacaagtacagctttaactatatttcattatataatttacagtgggttccaggaaaaccaataattattatttaagattttttctcacatatttctaagaaactcaaacacctctgttcaaaaataaacatcaaattttatactttatactgaactatgatgaatgtaagatcttttttttttcaggattgagaaggtggcattttattttaattttcttttttattattattatactttaagttttagggtacatgtgcacattgtgcaggttagttacatatgtatagcattgggagatatacctaatgctagatgacgagttagtgggtgcagcgtaccagcatggcacatgtatacatatgaatgtaagatcttaccctccaaaagaattattctgttttattttattatgtaatttatttaatttcctaaaaggttctgatttttattgcagaggtgtttatcttgtatattttcagactctactatgacttgttaattttgtccctttagcattttatatttttttctataattgatatatgtgtgtctgtgtatatgtgtgtgcctgtataaatgggaagtacctcactgtgtaaacttatgaagacatcttgactagaatttgtaatttttaatttgtgataatttttactgttaatatagttttcttaacacaagattgtgaaaacatagctttaaaacatagccctaaggagaaagaaaactattgccacttcactccatgttcacttctagcaactattgagatttttattgctcttgttgtaagttatgatattcatgggtaagtaaatcattggtttttcttaagatgagaaaaagtcagccgggtttgaagtggaataattttaaaggactatatcaaatacctttccaaatttataacagtcacccatgtttatgacatttaattttttttgttctgaaatacacatttttaacaatatacttttagaaaagtgcatagaatgtgaaggtacagattagtgaagcactattttaaagttaacatccatttcattccacagtgattaagaaacagaaaattaccaacactccaaatgccttctgcaagcctttttaaaattataacccccattttcttccttaaaagtaaccactgtaattatttcaccatcatcatttcctcattttccttatatttttactatttagctttgaatccctctgaaagaatgactggcttttatatgtactcatacaaagccacaatacatcatacaacatgtaattataacatacacttttttgtttctggcttcttttgcttaacatcatatgttagaattcctctgtgctgttgtgcagctgttgttccttcatttcttgaatccatgtagcatttcatagtatatctatagaattatatatttattcattatatttttggaagatatgttttatgttacttgtctattaaagacagtgatgctataaacattcttggatatcagtactgaaaacttctcctagattacacaatgctgagctgcaagtttttgagaacactgactgtatcagtcagagtttgccacagaaacaaccaatagaaaggaagtatgtctgtgcgcatatatatgtatacgtacattttgtatattatatccattatatatatacacatacacgcacacacacacacacacacacacacacacagagagagagagagagagagagagattgttttaaagaattctctcatatagctgtagaagctgacaagtccaaaagtccgaaatcagcagggtgggctgggagactagagacccagggtaaagttgattttacagctggtgtctgaaggcagtccagggttagaattctctcttcctcaggagaccacaatctttttttcagttaagatcgtctactgattaaatgagccccacccacattatggagggtaatctactttactcaatgtctacagatttaaatgttactctcgtctagtaagtattctgcatagcaacatctacactggtatttgaccaaaaatctgagtagcatagcctagtcaagttggcagataaaatcaaccttcacattggtttagttccagttcaccagtatgcatgatgggtgtgtctacctcatctcagcttaaaggttttttaagataccaagccttgggtgtccctgtactgtattttttgtcacctcaactctttgataaaatttcagatcatggttatactataaattgtcttttatttagatagaaccacatgcagaacattaataagcctttttttcttaaatcatgagagcaaaaactgtagaaaagtcttgcttttgttgctgttgataatattgtttgtatttgttttcatcatagaccttgaaaaattttgctatttgaaactatatgaaaactatactgtggggaaaaccagtctggaattaggacagattacaatgttgaagcattcctacttagaatcaacgtctgctagagccagttgaatcctatgaactgagtgtaatgctcacgaactgttgagaaatattgttggttcaaatctaggactcttgcccagcaagttttctgagttcaggttttatttttgaattggccttataatcttatcaataccagtctgtctctcaaaagaaaaaaaaaaagcagcctttcagtcacctctaggattcgaacaaccactaatttgttcttcatcactattattttgtcattttgataatgttaaataaatgaaatcatatagtatataacattttgaagttggcttttattcactcagcatattgcccttgagatccatgtaggttatttcttatatcaatatattttagatttttttctctttttattgttgagtggtccatggaatggatgtatgatagtttgtttaaccatgtacctatttaggacattttgatatttccagtttggggcacctacaaataaagctgctatgaacaacaatgtataggtttttgtgtgtacctgtttttatttgtctggaatagatacaccgaggtatgattgtgatattgtatgataaatgcatgtttactttttttttaaaaaaactgccaagctattttgccatgggtgtaccatgttacatcccaacagcaatgcatgagaaatctggcttctccacatcctcgcagcttttcctattgtaactagtttttattttatctcttctaataggtttgtagtggttcttaattgtgattttcatttgcatttccctaatgactagtaatgttgaacatcttttttctgtgcttttttataatccatgtatccttgtcagtgaagtgtctctttgttttgccattttctaattggattgttattttttcttactgttcagttttgaaattttttttgatatatattatagctctgagtcctctttcagatatgtggttgtaaatatattcatccagtctgtaacttttcttttcatcttcttaacaatatctttcataaagcagaggttttaaatttcagtgaagtctagtttacttttttttccttttatgaattatgcttttggtatcatatctaaaaagtttcactaggcactagtttctgaagattttctatgatttttttttctaaaggtttttatagttttctgtttaaatctatgattcattttgagtcaaattttttacaagatatgaagttcaggtaaagttgctttttatttatttattttgactatggatattcaattgctccaacaccattttagcaccatttcttttgaaatggccatatttcctccattgaattgcttttgcatctttgtcaaaagttagttatgtagggctatttctaggttctctattctgttcaattaatctatgtgtctatccctccaccattcctggttattttaactatatataagtcttcaaatgaggcagtatagttcctcccactttactctttaatcaaaattattttagatcttcaagttcctttgtatctctatatacatacagttagaataagtttgtgtatgtctaaaatattgctaggattttgataggaattttgttcaaaatatatatcaattttgggataattgggataatatttattgagactttcaatccatgagcatggcacgtttcctatttactttggacttctttaatttcttgaaacaacattgtatagttttcaacatacacgtttaagttttataagatttatacctatttcaattttttaaccattcctaatatatggaaatagaatagcttgttatatgttactcttgaattgtcttaactaaaatcatttattctatgttaacttttatatttcttgagatttttgacatatatcattgtttcatatatgcgtaagattagtattcagttttattttttcctattcagttgatacatcttttatttcctcatttcttttttttaaaatttatatggctttattgtatggctagaacttctggtactatgttggatagctgtagtgagtatagccacccttgctttttttttcctgatcttcaaggaaaagcattccatctttcatcattaattatggtattagctgtggaggttttgttgttgtggtggtggtggttgttgttttgtaagtgttctttataaaat

SEQ ID NO: 1297 - DNA, 252099 bp, Homo sapiens
tcatctcccacccaaaactgcactcaggaggagacagagcagcccagtaataatgatcacattgataattaagtatctaagtatccgctatgtggcaccaagctagatgctttatatatatttttgcaaaggtatattatctctattaatggggatatcagcgctcagagtggttaacttgcccaaaaggctagaacgagcccaaatctatctggctctgtaactcatgtctttctatgccatattgccagtccttaactcttaccttctacagagtgtcattatctgatcctgaaattaaatgaagtcagcccaagaaaacacctcggggacagtggaaaggatggggccaagagattagtgactagtgtcattcatacttcaatgtgttaaccagtgagtgaggaaccaggcagagggagagatcagctgggatactctggagaaccagaatttgcatcctatcaagcactagggagggaaggggagaggagagtgaagaggggagtgagtgttcaaagcgatcagataaggccaaggtaatttaacactataaactttgctttttccctcctaaaacctgctcctcctctctgttcctgccaaggaaaactcatttaattcttgtaagattaaccaataatcatgggaatgccaataagtcaaaggcagggaatagatttctagtttcatggctgcaacttgagaagactgatcaggaagttggtgagaaaaagaggcagagagggaaggaggagtgtggtttggggtcaaaggtgtaataagaggaaaaacaaacaaacaaacaaaaaatccaaagttaaattttactctgtgctgagattccactctttttggccctagccagaaaaacaacctttgtcccatggcagccaactggagggccagcgcctacattttaggttaagccaagaagtgaaaaacctaacttttagttcgagcgtgcaacattcccaagattgggttaaattcttccctggtctcctcttctctcatgcaaacaaggggaggtgggtgctcgtgctgacagaagttgggatttcatctctccctggagaccatatctgcacactgcttcttaggtccctcctttggcataatcaaaaggcaactgcaggaagccagtggtcagacggactttcccacaataccaagttagcaccatgtcaggtcagaagagttctctgaaagccaatacaaacagagccaggcttatttcccagagggacatccccttttctcgggcaatgtgatatccagattgtttctcagattggccgctgcccacacatccaggctggcaagccaagccctagggttgattttcaaatctccccaaatgacaagcctcctccctcagcagggactgagaatgacggtgatcttgggaatcagaaaaggggaaaccctccctgtcctctatccctctatccctgttgcgcaaagaaagagaaaactaatgcagtgtgatgtggaggtgatgcctgatgaaggtgcactggaggaaggaaggctggaatatggtgctaatcagagaggagtgtgagaattttaagaagctgatgtctgtttttatccccttggaagttagaaccttaggggcactaagtgtggcctcaatctatagggctgcccataaattcatctataaaaaggtcaagaggagagagatccaaaactgatcacgacaatgtctagcatcctttctggtctactacgtaccaggcataatttttttctttcttttatttatttatttatttttttttgagaccaagttttgctctaattgcccaggctggagtgcaatggcctgatcttggctcaccacaacctccgcctcccaggttcaagtgattctcctgcctcagcctctcgagtagctgggattacaggcatgcgccaccatgcccagctaattttttatttttagtagagatggggtttctccatgttggtcaggctggtctcaaactcccgacctcaggtgatccgcccaccttggcctcccaaagtgctgggattacaagcgtgagccaccatgtccgactgtaccaggcataatatatgatctcatttaattccccacaacaaactttaaggtgggtcttattgtttccttttcatagatgaagatactgaggtctcgagagtcttagtaattcacccacaaatgttggcactccttggggcatttgtcatcacttgcctcatttatttctattgaactcgtattgctctcagattctacttaaccaggaaacactcattagaagccctgccctgagccaaggaaaaagaaagcttgggccgattttgcttactcttgtgtccccagtgcaaatcctggtgctggcatagttgttgttaataagattttatcagaaaatgaaaatggtccatcttggctcctgcttaaaagtgaactatcttccctaagttggaattcaagaagcctgaaaaactgatgtccaagacactgtgtagtgccagattatatgagattcgtaagtgtttcataaacgatctttctctcaagagtgtttcaaagcaagactggactacactcctataccctgcccctttctagttggctggatgtatttccatgtctgtggcctctgcttataagcttttgatttgcaaaagtgtcaagtctgaagatgaagcttagccatgtgaaataaggcacttaacaattcctcattgaaaaatcacagaaatgtttttttcaaagatacattttaccctcttatctatatttatttcctcagaaaacaaaaaagaaagaaataggctgagtgtggtggctcacgcctgtaatcccagcactttgggaggttgaagcgggcagatcatgaggtcaagagatggagaacatcctggccaacatggtgaaaccccgcctctactacaaatacaaaaattacctgggcgtggtggtgtgtgcctgtagtcccagctactcagaaagctgaggcaggacaatcacttgaactgcaaggcggaggttgaagtgagccaagatggcaccactgccgtccagcctgggcaacagagtgagactccatctcaaaaaagaaagaaagaaaggaagaaatccaaagatgttcatgggattccttttcctcttttgcaggaaaggcaattcagatataccctctttaaaatagtaaaatacatgtaattttccacctttaagacaaacagttctccatttgtggagagacttctgaaaatagatgcatctgccccaatgccagagctttgacgctggtgtatctgtccgaactcacagatcagtttttcaatatattgtaggtagtctgctctccagcgtggccatgattaattctgtcagctctgaggaggaggccatttgagatcctgaacccccacctgggtacgcctcactgttgacttccatacctgcctagagcaatatgcgttggctttggcatgtgcagggccaggcattgccatcaatggagttcattgttttgcagcaggcacctgcacctgcacggcaggctcaaacaataagtccataccccaaacccctcctttctcctcagggcacctactgtgaaagaaaacttgttgaggcctggaagcccactttcatcataattaggcttctgggccaacagttaaccaccaacgtctcttggtgaacacatgaagctacttccaaatcttgggtacctgcaaagccatggggcaaggcagagttagtgttggctctgtgctcctcttgcctctgaagaatgttaggcttgaagaatgcagagcactgcacatgctataattctgtcctgtgacttctggatgctttagttttcacaagggcacagagcaatcttaggcattctcacaatcctcagatctgtgagaacaccatgagtaagagacctggtcacctacctgaaccaggtcttaaccagagccacaagatagcatcccacactgcagttcatggctttcatattcaggtacacctgggtttgaatcttggggccaccatattcataatgcatgaatttggagtaaattgcttcatctctgaatctctcttttttcatctgtaaaatggaaatgattatgcttatttttgagaatttaatttaaaatactggctgtaaaatattaagcacaggtcctaacccacagtaatgagtccttaataaattatagctattactctgctgtttcactaaaagcccaatgatgaattaagtttaaaaatatggtggtagaataactgacaatatattaagttttgaatgtccagccttcaccaaaatgtacggaaggtgtataattttgaaattgaaattggtgaccaaactattacacatcacgcaaatcccagaaaacagagatcaatggttgctttggtttgtaatcaaaatgtgggattaagagtattccgaaatcttcaagttctataatattaaaaaaaaaaaaagcacgtacttcattggaccaaattttaagacaaacgttaagcagtttaggtctgctagtcagatgctatttaaacctattatttcctgctatttgttgggacaaatcacttcgtctctctgtgcctcagttttctcatctgtaaaataagagtattatcagtatacttctcttttatcagtcttatgaggattaaataagataatacaagtgaaagacttagcccagggcatgactcagtaataattcaacaaatggcaactccatttactcttacattgctgccaacaaaactgtttccctcttatttgaactgtttcctgccctctagcatcctctgtgatggaccttcgttactgttaataggaaaatcttgacattggcggcttggtgatttctaacatgtgctattaatttgacttatttctcctcacaaccttcctttaaactcaacagaaaatgtgcactgaggcttctcaccagaggggcagcctgtgggaatggcactgcatcaacagagagcaagaaggggagacgcaccaaagccagggcggcccacatggatggcactggctcaggtaacacgctcacgatttgatcagtattcccagaaaggacataagctagaacctagtttgatttcaggctacccaggcaagagatcaatgtgaatattaatgtgatctctaccagaccaatgggtttgtgtcttcacaggtgagattccagaactttctggatttggtggtataccttttattccaaacctcaaaacatatttgggtatttttctgcttaaataataatcttctatgctaaatttttataaggacataaaattaaatgtgcttacaagtttaattaagttaattttacagataagagtagatataattggaacttctcaggaaaactgaagatatacgtatatgttgtatttgggaaggacacaaatgtatcagaaaaaaagtcaagaacatttaagaattgtttcatctctactgtattctgtctaatcagttattcaattagttaagagctagctataattctgtgatgattgtggagctacaactaaaatgtaaaattgataggtttataaaaaaatttgtggtcttaattatttcctactacccaagaatgttatttacatctttttttatcttttgggttttcccccctaattttaatatgattcttgctttttccaggttttgttgcacacattagaatattaatatttgggttcattaaagggggttgattaccttctagtttgtatatgtttcttccaaaagaagaaagcaaaggcgactattacttcctttcccttcatttaccctgcctatgatgtcaataggatagaaagtacaattaaaattaggtttaaccctacacttcttaatatgtgcgtttttctgaaaactctggaatggaaaagagtgcttatgtttacaaatagggcgagatatgtttaagttatcattatctaatctgaacactaatttggaactgattactttgctgggttatgaaacaatctcagcagtttcacaaataaaagtccacaataaacccatatactcccacttctgcactttcttgaaatccagtttacattgtcttgcctagaatatgctttaatagaagtcaacattttttggcatagaaaaatcaacgattctcgattcagtcagtcttctgtttaataaatcaagcaataattacaaggcagttaagaaatggggatatttaaatctactggataatttggtaaggtactggaaacaccaggttgtttatgtgatttttacaaataagacaaagaagtgaggtagaaatggatattgtgctgaaattttattttcaaatgttttaatttgaatttattatgccaaagttccaacatcgtcattcttttttttttttttttttttttttttgagacagggtcttactctgtcacccaggctggagtgcagtggtagtgaaatcttggctcactgcagtctcaacttcccaaagctcatctcccaccacagcctcctgagtagctgggactacaggcacatgtcaccacaaccagctaagttttgcattttttgtagagatggggtttccccatattgcccaggctggtcttgaaatcctgggctgaagtgatccacctgccttggcctcccaaagtgctgggactgcaggcatgagccactgctccaggcctgtcatttctgttatttctctgaataggtgtaaaggcttataagttttgcactaacatagaaaattttgattctgcaatattggataaaaatctgagaaagagtaattgggagaaacatgtgtgataagtacatggtggattcccttaaaattctgtctctttctggaaagaatctcttttccctctgtaccttgtggggtgcaggtacaggacactggtagaggtggtggggatggatccaatagagccatgggccataaaacaatgcagatcccatgcattttcctcaacagtcacatgtacgagcggcagtgagggcgttctgtaaaataacaagcctcgtatgtaaaggcagctcatgagctgcctacagctccagctgttcttgtttaacataaatgtccctttccaggtcatcacagcctctaccctcccattgttaacgctgcctgtttaacccagttatgtggcgtgccccacctcgtctgtatccaattgtgtttctaactcctacagcaaacaaaaacaacaacaaaaaaacaagcaagcaccaagaagtcttcttcatacgtacacagaggaatcatctgtcttaaaaaaatgatagtggcaataacttcatgcaaggttccccaccaccactatgcccttaagtctattattcagaccctagtgtgagtgatttcaatccaatcaaaatccaccagtacaggtaccccagagtggacattttgttgatgtggaggaaaggaccacttcggaacaagagatagtgtgagcatcatcgtagatgccaactcagagtgaaaatggcaattttggacaaaggactaaggatggaatagtggcatttgtgacctgatgaaagaggagtgaaagacaatgcagaagaggggattccacagagggaggtatcctgaaagaaacaaacaaacaaaaaaagttttgtttcctttctcggtgggaacagctggtgtgtcctgtaaagactcggtggggctccttggtgtgaagtttggaaagttcatatctcagcttatccagtctctcccagtccattgtagattccacatccttatccagtcctcaccttggaggggagaatggagtgtcagggaagggaagggaggtgagccactgccctcttgccttgcaattcctcttccccagctgcttcggtttaatacccatgactttctccatttgaatacacgtctattccttgcaaatcctaagtgtctcctataaaataaaactacttggagaattaatacacttgagaaatcaatgcttttctctcttcacaaagaaaaatactgacaacatctgaagggaaagaagggaaagtaagaccacgtatgggcatgcagtttcagaaacggtgtcttggaagaagtctgctggaatacctgtcaggaaaattctgctggctgacacagagttaaagctaaaagggaaaggaagtcatgatctctgaacagtagccattcaattattttttaatcacagtaaaacaaaacaaaacaaaaatggccaataaaaataattcatgcctttatgttcttacccccaaaaaaaacgaatgaatccattcattcctgactcatatatgtatcacattgcctaataacatgtaccagacactgtgataaaggctttacatgtgcaatcttatttatcctcttaatagtctaatgagacaggtactgtcattaatatctaattttacagatgagagaactgaggtaaagtttatttatttgctacacagctagtcagggtattttcagaatttgaaatcaggcagtttaacttaaggcatgggccttcaattgttcctgtgtattcttcctttgtaactgccatctttctttgatccctaaatatcttttttttttttttttttttttttttttttttttttttttttgagacaaggtcttgctctgtcacccaggcgctggagtgcagcggcaagatcatggctcactgcagcctcaacctcccaggctcaggtgatcctttcacctcagcctcctgagtagctggaaaaacagacatgtaccaccatgcctggctaatttttgtatgttttgtagagatgggagtgtcaccatgttgcccaggctggtcttgaactcctgggctcaagcaatccatccgcctcagcctaaatcttgatctctgccaatagagccaaacgtttttaaaaaggcaaaaatctctctataggtaaaagttttatttcaatgataatattctcaaacatttcttaagaaatgtcttcattttctaagaaatccaattactgtctcatacttccaggattctccaattttttttttccaggatattatagtccatcaatttccatacgactccacacacagtggtggaaaccagggtggtttggggacatgaaagaaacctcagccacaaatcagagttggtcggatcaggcagtcagatctgtctcagcaagtctttggttgggatagtcaaattccaggcatttttatctctattttcaatgaagcttgcattatttttgcttcatttatgcacatcactcagatggatcacaaaaccatttaagctcattccttttcaattagctattattgaactccagctgactccattcagaaatgctgctttcagtgaggctggatttgggacccggtcctcggttttagcccttgtgtatgtctccctgtgaaaagggaacatcacccctgcttgtgttgaaaagtagcactgcttcttggaaacacaagatgctgctccttttcaggcatttgcaggaagaaattgctctcctgcagtattcatgtaaccactaaacccacagccacagggtgtccccggggcttaccttttctgttcagtgtttgatgccctgtggtttttctctcacagagaccacagtccagtcatcatggcacacatcgtcttcaacgtattgctcaaaggcctttctcagagagtgaggtctgcgattctataactgcactttctttttttttttttttactgtcattgtttagaaagcttgggatgactgtatttattaggaactgcaaggaaggattatatagatatacacagatatacggttaaatattgaactgaaatattaactatcccagatgctaataattaaatcagtgctacaaaacccccaaagttaagggccaagatcaatttctgggacactactgacccaacattaatgtaggcagaacagcaaggagacgatgaggagaaaaataaaacatgaggccagagtctgtagcatagctcattttattgtttaaacagtttttgcataggaaatatatccgcttccagtaattgactgcagtatgagcagctgctagcagtataggctggatataacagtaacaatcacattaagtcaagcttgatttacaccagtttaaaacttgtggcaattgagttcatttgcaacccacaaaaagtacccaaagaacgttatcctccaaccgggcacaataaaaccttcactaacattctggcccagtctggggttgatcccagaggcctgaactctagaaattaagtaactgtcgtataatacatcctactgctaaaggtttgttacatggagattgtgcatgtgcctccttttgtaaaaaaatttaattaaaatacaaggttctgtatttatggcccatgaggacaaaatgccaaaagttttaaaatggatcaaccctggtgtgtagctagcaagcaataactgactactcgtcacctacagttgtactaaatgtatctaaagaaacacacagtcctacaaaagttgttctcagagaaatatcattgaggtgggggcagctcttcccaggatgctaaaagttctatatgatataagcacaaattaacagcttgatgaagacataatctactgcagctttgagaaacctatgcctgggatgtagttacccctcacattctacaatgttgtagagattttttttcccaagaaaatgtcatttgaaacatatttacaactgaactcaacagagactgtgaaattgaacaggcactgctcatttgtttgagttttttggtaaacattttgctggttttttttttttgtttgtttctttcttgttttgcatcaacttttatcagtccatgcaacttcaatgccctcgatgaaggatgcataaaaagccatacttcttaaaaaaaaaaaaaagaaaaaaaaagacttccttctgcataaagagatatatttgccacatcagtccctgtagcacagttttcaaaaccattctgtcaaaaatacagtaatacaagactggctttagtgtcactagcttacactgcttttcatgtatttaggccacctgttgttcctggtactgtatcatgcaataagtcatcaagggcttagtctagtgtaccggtaagctagtggcactgaagcgcttttcacaatctcaacatacatttgaattgcaacacacagatatttctagagtattaactagtgaacccttttattattaaaaaaaaaaaaaaactacttacaaccattgaagaaaaaattgcaacaaaaaatgtaaaaattgaccgtctccaacttgtcccctttactattaacaatgtgaccaacagatctgtggcacggacacagtacaaagagttgtcatggcaatgagtttggctgatgcaaaggtcattgtgcagggtcaaagggcaaaatcagtggtccatgttaccccccaactgcagggctccactccacccacacaattttagggaattagaaaaaacaggggaactaccagaaagtgcaaaatatgaagaaggcagctttcagctccttcagcatggagtagaacattcatttttgagcttttactattgaacttgaatagcctgcacattaaaaaaaaaaaaaaaaaaaaagttttctatagaaacccaatttcttaaagtccagaaagcatgcagctggttaatgttaacaaaagaccttgacaggaacatgtaaactatattgaatgtcatgcttggggcctatctgccagcaatattgtagagttgtttcattaaaaatgaatactgtacactgaatatgggataactttctgcagccttcatcatttcacacagtacatagaatttgaatctaggtaaagaacatgtcctgctgtcacaccgctgaagatgtccctgtgcaatctctttcgttgagtccttatgaagctacaagtcacaaatccaagattctgctccctgaggacacgttatgtgagacatagcactgttttagttttctgcctatcctgaatgctctgtgaaacttaaccttaaataccatcacgtaacaatcacaaaaacttttgctaaaggccgtatatactaataaaaagacagtggtgcttcgacattctgaaatgctctggaaaccaacttttccaatactaaatacaacaaaataaccttcataaaatataacttttctccatttacacttttttaaaggattagtatcctatgcttttcaagcacaggaatctgtgaaataactcctaacatggacagattttctttttaatacataacttaagagactggagagttttaactcaagtccagtctctaaacaaggaatattcttgtttactttaaaaatggaaacaacatatagttccattataattgttaaaaagttagctttacaaacatgggaattttaatttaaaaaaaattcttaacaaaactatacagtgtacaaattactgtctacaaggtaggcggttcattaagaagacctttcgctcttctcgctacttgcagcttcacagattcattcacatattttttaatggagctgcccacccgaacattacccgataactatattgctataattaagatttttgccatgtctttatgtacagtctccttcactgccttttatttttttccttagacaagcctcaaatgctcacgtcactccaggggtaacacgcttcagaggcactgtgagtggtgggtggcagggcagcacacaaaggctgaacagtgccacggaactgatggttggagacaccactccctactcatgcccttgggtgaccttcgccatcctgaagctctgcagttctgggtaagggaggggcgtgcaagacctgcaaaagtggggcccttcgtcagaatatacttcctggtacacgaggaggaggccgaaaagttgatttgagattttatatatatagtagtacttttaatagttttatctcaaaaaggaaagaagaaaaaattgatttgaaataaaaaaagcaacacttgaactaggcctttgtattcaagaggcaggcaggaatacccacagtgtgtaacttggttagctagaactgctcactggcaaaaaagagagcgagtctgcctttaaaaaatactgtgtgtcctgtgaggttcatttgttcacctaataggtcaaagatacatgaagagcttggctgagatgatctgtttgctaccagggcgagtatcacagaaatgattggacttacttttgaacttgcactgctaggatcccgctgtgctgttcagcatttgggctatcaaactgaatgggctaatcaaatacaattctccagcccataagcattgttctaaagtattcattattaaatgatatgctgtgagaacaattgacagtttattttattaggccatggcctaggggaagggggccaggggactccttaagacagcctaccatgtgtcaccaattctgaaagattttccttctagtaatgaatacactcaatgggactgggcggtgagggaaaggcaaaataaaaccagcctccattcagcctctagccctcaggggaaacgaaatcaaatatatagttaaggtaccattccttaaaaaaatcccatcagcatctaatgggtttaattcatccacaggaagattaattgcttaaaattctatatttcccttctgctctggttctcagttttaaaaggggagataaaatgaaaacaggatttacttttttgttccttaaaaattgaactttgattttaatctatcagtccaaatacattcaacaatagcaaccctctgttcaatcttctggatattaaaaaaaaatccaagtgcactgccatccatttgaagtagtaagtcacaggtaaatcatatcctatcattaatgaaatgaaatggggacgaaaagtggcagaaaaggaatacgggagactccctccaacaggtctaatgtgttttctaggagaaagaatattcatgtgttaaactctcaaaagtgttaaacatccaacatcccctatgtggacatttcaacaaatatttttgccaaatatgagacaggctcactctccactgtggatctggaactttcaagaaaaactatcaccaagccaagtctgcctttttaagccaagtctgcctccaggagaatttgttgtgtttgcttgttcttactattgtgttgttatgaaaaccagtaatgagttcagcttgcaacccaggtgggaagttagagaggggaacctgtgtaagttgaagtttgtcacagtaggcagaacagtcgctttgcagcccaggcccatctcagggtgcactgcttcacagctacactgcaaagtgttaaaaatcctcccacccaccccagaatatatatatatgtatattaaaaaaaatcccctgtccatctctcagtacacaaaaggacctcatcacactgcaaaaatagcagtacccactttggtcaattaaaacaaacaaacaaacaaaaaagcatacattattttttttttaaatctgtgtacttacctataataaccaatacagctaaaagcactacctacataggcaaaacttggtattgcataattcgtataaatttgaaacccctcccccccaaatattaattggaagatgaaaaacatgaaaggttaatagaaaaaaacaccaaaatactgaaaatattgctggtcgattacaatttttaagcggcaactatacacagccatgatatgctttataaatgtgagataaaggtataactgtctaaaaaatccatgatgtcacacatttttcttcgtctggagtacaaaatattttgtcataaaaatggtaaagatttaaaatgataataaatgcagcaaaacaagtgtagtgatgtcactttgttgtatttttttgtttttttttttttgttttttgttttttagatttcaaggcaaggcacgtaatgtggacattatatcttcgtgcaaattaggattactggaaagagtatttttaattaaaattttaagagacatagaggcaaaatgtgtctgcccatgcacactatggatctgtcaatacaagaaatttgttgaacaaggctaatgtctgaaagcaccatgcaagttttcagcaccctgattacatttgttttctcaagagtgcgtttttatatcctacaccctggcgttcccagtttgtaaactgtaagctttacccttgtgacatggatttgcctgcctctttgtctctataatgcagattttatagaaccttttgtacaccctatgggttcttgatgcaaccagtaattttaaataaataaattctacctccaaggaggctgcagctaaaccaacataagtgctgtgttttcattaattttatttttctcaagcacatgatttgtcttgatttaatgcctttttaatgccctcaaaaactgaggggaaaataaattcgttcaaaattattttaaattctttttaatcccctcaatttagagtccaagggctgaaggacttataatcatgattcccctttagatataaatttataaattgcacttgcctctgttaagtgtttcttttgtggggaaaatattatattaatttttactgttgcatgcagagagaacacttcacctacatagaggcatttcttccatagagcctttgtgttcaaactgtttttttccttttttctttttttcctttttttttcattttttctttttttaagatttcaaactgggttacacactggaaaaggctgggttaagggccgaaatttaataaatctgtactgataactaaaggctacagagatttcatatattttttttaacttttagaaatcagagtgcttataaaatggctggctcatggctctgtcacccagcacctctgacgccgcctcctagccttcgttggtgagataaccaggaatagtgattccatgcgtaaacaacaagaatactaaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctggtctattatcttctttcttcagtttctttcctttctgcctttgtgttgttttgtccagtcttcctcttttcctttttttttatttaaaaaaaaaatttcttaaactattgttgtgtttctttttccctcagttgcttgtttctgcttgaaggaaaggttctccaattatgttcaaaccgtaattttggacattggccggtaagatgggtgtcctatttgacacttggaaaggaaccaagctagcccaggtaccaggactgttgagaggagagaggcagcagggagggaagaaaaaagaaaaaaatacaatgttaaaatctacaacaatatgagaaatataaattccagatgcatcaaattattgctatccctattttcaaaattacagtctaatatgagataaatgtgccaaattatacatgttacacctatctaaactctatagtctattttttaaatgaaaattaagactaaagtgaggcagaaaaatccagagtaagatatataaacaattattgaattctaaccgattgaggatattctaaaatattttacattaatcaatataaatgcaatatcattcttttttgtacaggaaaaaaaagaaaaagaaaagcagcaatctgttggtaccaatatactttgccagttacattctaatcttattttacctttaattcacaagcaattcagtggtcagatgggtttcaatttcttacctgcctattgggttgaatacaattgaaaagtacggtgaaagatatttcttttctccttacaacaggaaaaaaaactacatgtttaaggtaggcccatgcataacatacaatttgaaatgcccaattatcaaacataccttaatcagagttttttagtaaagaccgaacaaataagaatcatagaaccaaaatggaacacagctttttttgttctctacagaatacccatcgtgaggaaaaacatttacaggaggccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacttgaggagtttggagtgatagatggcgggttgggggttgggggtgttggaggcagtaaatgataagattccagccttactctcatcagttcaactttcgcctatgctgaattacaggctgttaaaaaaaaaaaaaaaagactggaaaacaattctctaattgctactagcataatctccctttaaaaagtatcatatggaggataaaaaaaatcagatctacatatcatgaaacaactctacagcacacattttgggtacacttaatctaatgtattgcctgttccaacactcaaatccgaatgaatgtcagttaagtaacagctgcataaataatcatgaaccaagaaaacatcaaactgacaattcagtactcatattagtcatggcctagcatggaaacatactttcgaggttttaaatttcactgaacatcctttgctttacttttgaaaccatgaagtgagatagcactattgttgtagctatcaatctagatatgctcatttgttcatatttgaattccaaaagtacaaaaacctttacagaatatcaacctaaaggaacaattctgaattttttttaaaacttgatacatactgtttttactctggtgatacctcgatacaaaatgttgcttgttgctacacatacatatttctgagttaacatttcaaaacaatatcacaacgaccatttgtgctcaagggattttataattagactacaaactcaatgacagcaaagtccgtctctagtaaagtacctagcacatggaagatgctcaatacctttttagacaaacaaatcaattaattgtttcaaatcacacccagctatatattttcaaaagctgtcacccaagattacatatactcatgaatatgttgtgatttgatcccctataaaaagaaaataggtatctctgaatttaaaattagatctacttagcattaacaaaaattgattaagcaggaataatcacattcaaactaaaaagacacgtcctcaaaatctgatgaaaaatcgtaactcttaagaatacttgttattgaaacttttactaagcagcttaactgttttcacatatttatcttcccacacacatcttcaacaattatttttgtgctttgcaccattgattgggaacaatgttacataatgaatcatgaaacttattttaccctcaactgtgtttccactgcactttgtacatggtcctgttacagcatttattacttcataaatatctctatctgggattatcttactaactgaaaggtgaacttcacagagaaaacgacctagtcacatctatctttatagagtctgagcatagctggtgctatttcttaacaaataaaataaattacaaaaatggttatacattatttttaacttgaagtaagaagcatgtaccaaaagcaaaaggactaggtaaagcagataatccttgacagtaaaatacaatgtcaacaagcagcaaattgctttgcaaaattaacaagagtgccaaattaagtgagctcaagaaagtcatttggagattgcatgctttagggatataaagtatattttaatgattgaaaatagatgtggctccttacatggacaagtctaccaactaatggcagaaaactcagggtttattttgcaatagctctcttactcagttctttagaagagacatatgtcattattctttggaaaatgttcaataaaaataaattgatgctagtaactaacaggactcttgctgcagaatgcctaccaaatttaatttaaatgtttatttaaatctttcaaaccgcccatcctacattatgaccatatcaaaattgcagagtgcaatatatttgtcaatactgtttatgaacctttgggggaaaataaatctcaaacattaacactatgcagaccccatatatgagttttacaagtctcttattgccaatttaagttcagaactataaggcacagacattttttagagctatttttggtagtcctgttaaaaaaaaaaacttgataaaactaattcaatgactgagataacaatgtaaataaatatatttaattaaagtaatacagattatttaatttcaaaaatgcaatgtctaaaattgcatacttactcaggtaaaaatgtaatagtgctttttatacatctaactctatataaaaatcaataatcacatgtatggataaaataaacacacaaaaacaaattagttacatgtaaaatgcttaatagttttaattcatagtgagaattactatatggataatcttatgttcattccaactatctgcattccaataaaagaaatgagaatataactgaaaggatttcaaaatattcaagctcaaattcagctacttcagcaatatatctttataagtgtgcatttcctttgttttaatcaaatttttcattaccaaatcacatttgtttaggcaaagagaagatgagcatagctgaaagttgaaagcacatctttagaaaatataaagtagatataaccatttaaaaaagaaaagatataattactttgcaaaaaaatcaagcagaaaaaaacacaaaagaatttgatagtaccttaacacaaagtacagctcatcctaatgactattactatgcatataatgagatagttcattataaaatgaatacataagagctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaagggtagacagggaagatatagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgatttccctggccatttcactatattatattgcctacacaggaagtcagatgacttaacataagaaagaacttttgaacagagtggtctgaaggcaaaattaattggcttcaggagacagtgaacttttcatgcaccatacaagctggattataacctagctaatgttgcgaaagagactagtgcacagaatatgtagctggtctaagtggtcaaatgatctgaaattctatgtattcatctcctctgaaacaaatctagttgaagttctactagggtgagttctacagcgtgaggattaaggcggaagaagatacccacttcttccttttaaaaagatgcactatttctatatgtcttatcctggataaactgggcaaaatagttcatcttcgcatctacctacaaagagtaaagagctatacctttcagtgaaagaaaggcagaaattgctctcggcagccataccaacattttctggttatgtttttttaaaattatgcattatgggagtgtgtcttctaggccaaaaagaattgggcccttaccttttagctcactaacacctaggaaccacagggtgccacattaaacatgtatgaagccattacattgagccagaaaccaaacaaagtcaaagactttacatcacctattatttatttggaggtgatgaaacaataagagctattttaagaatggcaaaaatcatttattactagcctgtgtgtatttgataatggatgagataacacactagttaaacagtttatgaaatgtctaagtatccagtatacgaatatttttcaggggaacaatagtattgtccatttagaatttatatactggtttaatcatgagaaaataccatatttacttaaaagatagtaaatactctttcaagaagcttaaaaaatattacaggaaaaaagcacaaagagttgtacatattaatacatacctcaactgtaacagtagccacattatttacagatggcaataaaaatgagcaatggcccagaaagcatggggaataaataaaataagtattttaatttaaaagaagcatttgcctttagttcctttgcaacatttcctgatctccccaagatggaaaggtttttacttccttggctaaacactctaattttattggcaaaatattaacacacaagtattagcatttcttgtaaaatgcacaataaacagttctccttattaattgctgaaaacctgttgggaaaactgtgctgccctgggttgtacatgggtgcattcggactggttgcttacttcaatataacacaaaggctgcagattacgtcttgtgaaaaaaatgctcgctcagaccagtagaaggaacaaacacttaagttgaatctatttatgtattagaacaaagaaaatagtacttgataaatataccagttgctagcacttatataatgtgtattatttgccaggtactgttctacatgcttgacctaccttaaaacttttaatcctcataacaaatctatgagaaagaccattattatcctgattttacagatgaggaaactgaagcgaggaagttaagtgtcttgcccaactcgtattgctattaaattgtagaaggcaggatttgaattcgagcaatgtcattctaggatctgtatttctacccactaaacttttctcatctccccttcctgtgaagcatagtttacttttctcactggactagaagttatattatcactgaattatgcaagagactttgtgaattgaggttcatatcacaatgaaattcctgtggaagtataattcttgagcccaaaattcagcacaaataactgtgctttattcctccaattccagttgcttttcagctgaatgcagtatttgcttttgtcttacatatgtgcagatgtggctgtatgtcaataatttgtttgttgagttccacttcagatgaggctagcctggaagtgaaatacacaaagtgttttatacaggtcttgggtttcttcgatttattttcaccgtttttagggatcattattgccgtcggaatgatcctctttgcatgcaagatgattcctaatgattattactatttgtaataatctgtatcagaaagctccctggctagctcttacctgaactgcaaagtactcttgtgggctctctgggaaacaccaaatatcataaactgcaggtggctcatggaattattctaactgcaagcaataggacttcacagtaatgaaagagaaacatatttgtttcttaactaagtaggtaaatagccttctttattgctactccttggggaccaacggttttgaaaatagcatatcaaaatggtagcccatcaaacctcattaatttatattcaattgattcagaagttttttgttcttagggcacagtggattgaatgttaactttaccatgcgtgagtgctagcactttctaagtaaaataatagcatctaccattgaaatattttatctaataaagagcacagggcaagaaaaagccactccatatgggagcactgccactaaatattaaatgtgttccttataattactgcactcgtttagtaaaaaactcttacataatacttgaagccttcgatatagcaacctacacttaaataaaaacttccttaaaatgttcggtttaaacataaataagaaaaaagctcttcctcaattggccaaattaaggacttataaaaaaattgtttgatctttttcaaattttagaactgaaaatgaaagatgaaaaattattatgaagatgactaattataaataaattacagtacacacatgcatacatatataagaactcaggtagctgtgggaggttttagccaattaaaaattatacaattatcaggctcagagcaattattttatctcctcccacagaccacagcacagtggagaagcccacatgttgatttccagcctctttctgtctgtattcctctctaccctgggcttcttttcaatgctattgttaaaagtggtactgctcctcttatttgcatatgtgatgctttaacagcagataaaattctctacaaaaatggtgcttcaaaatagtgcctttcactagagaaaatcacccaaggcatactaaatcaaatagaaatataagttttatacaaagcaaaaagagattcttttataaatgattttcagttaaaagcaaaaatcagcattatttgcacaattttacctcttaaaggtgaaacttacttgtatcagaatgctgaagcataaaattacaaatgattaaagaactgaacacattttaatatcatgcttgctactctgttcacaagggcaaaagatcttacatgggcaaaagatcttcctgtgtgtgaaacaaagtgagcaagagagaataattgtaactttctgcaatttcagaatattcaaaattcgtgttcttcaattacttgaccttaagattttgccatttcttttatcatttattatgtttattatgatatttattcattcatagtctttgttatttaagtaaatatgactaaaaaaatcatcatatccctactaacagcactagcaaaaatgagaaccaaaaaggtaagctaataaatggtgcactggctgtcgagggaactgatttcttacggacgaactacatctgtaaatatggcactttacataaaacatattcaaataaagtaggggtttaatatacttcctttcactacaaagggttaatcagcaaggtttacatttgggaattttcagaatcacgctcctccctctccagtagcgctgccaaaaatcatcgacaggaaacgtaagattaagtttgtcctacctaagcgaacaaagagtgctctgaacaggccaccggtttactgcagagcgggaacttttctaatcctgctggaatctgcagtcctgctcagaaaatatcacggaaaaaagttgttttctttcctctaacatcttgtctcaggatcatctcattttggtcacactgcagatcctgctgcttctcccataaaggttaacttaaagctccaaacataatcatgtggaaaatggacattattgattcctatggtccattgttcccccaacctaagtccctgaagttcaagttcaatctggaattacatcatgtctggtttctcctggttaccagacggcttgagacgtgaccacagctacagaaaaaacaaacagccttcttcacgcttcggctcccctatcgattcaaacgtaaactttttttctttctctcaagtacgcttcaagtatggagcatggttaatttagagattaagttccaaattagattatctaatggcatcttaatggattgctgacccatttcctgtgggatggcagcatgcaagtctggctggaatacaattaatttcttaggaagtgttctgaagagtttgcctagataaaaaggaaatgtcgtgttgtacaaatctttctttataaatggagaaagttaggcaaaactacgacaaatcccaacatattattcaaaagccagaccacagatgttgtgcgtccgtgaaaaccatatcaagatcatttttaagaatggtaatgtttttatttttgatttcataacaggtgcaaataattttgatgagaatagagtaattcctttaaaaagaatattcatatacaaagacaaaagtagttagcagcccctttaccaaacaatgatcatgtgaaattttggtttttgcaattctccaccttgaaccaaagattcttccattcatctaccatatcagcatttctatcatagtcccagagtggtgctaggggcccagaatggtgtataaaaagttgaggatttgaacacactttagagctgacagctgaaaaggaaattcagcactcggagaataaagctccccccaggaactccaggaacaacccagctgttgtactgtagttatgtgtcaagataacaaactgagagcaggaaatgctaacctagtgaattcgcggggatgttctaagtgtaatgttgaaataaaagttaactctttatattacctaaggacatactgcccttatcatacgtatgccacatatatgtggagatatacacacacactacatacacacacacatatagatgcatacacacacaaacacatatatgtaatacaaacatatggtttgcaacccattattgaaagttattttttgtttaaatattcattcttttgagagcatacattttacaaagaaaatgttatgaacaaagcaaggaaaatggctgaggtgagtgttatgcaaattaagttacatggataaaatgagagctattacccccccacactttttttttctttctttcttttttcttttttttttttttttttgccctccctctcctgaccaaccagatccaaataacctttactggctgctaaatttctcttgagaaatcaagcaactctctagaattgcagtaataaacgacaatttcttagaaaaacatgtgtaaagtaactacagaatgaagtattcaacccacagaaaggaactgctaacacatgtaacacggaaaatagctgataaaagtctctttggtgccattcaattatggcatccgcagaaacacaaaaatcctcccaattattttagtaaaatcttcatttattcattatttcagaggctgagcaaatggtttgtgtaaacatatcctttggtaacacgcgcatgtttattttagccatctgaagacttcttctatgtttacataagccatcagacacatacaaccactcacttgtggctttgcgttttcttgaaaggggtgaagggagagaagagagaatgaaacaataaattcagtttctcttttgcataaagcactccctctaatgttttaaaatagcttatgtttgtattattcttggattgtccttcagctttctttttcattcaattatattgatctttcatatctgacagtacaggctatattctgactatcactttaagaaagccagccagtcagggagtaactgctgtatatgtttatgtccacataactcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttactctgggttaactgcagttcctgacctttcacttaggcagaaaaattgactctctcaaggtgcaagcaactcctttgcacatgtgtgtgcacacacacacagttcacaaaacagttcacaaaattttaaggtcaaaacaacaaaacatcttcagggttgtaacctaataaggctgtgaaaactttcccaaagagtcagctttggttcctaagggaatgcttaagccttggggttgcgggtggatggaggaaatcttccagctttgattatacttgcacagctcccttggcactgccattttcagttccgacaagagctgcatttgacatggaaacacctcaacagggcaattagtataaagcagaaaagagggtgaccatggaaaagtgattgtacaaagaaagtaatgacaacaaacaacaatcaatcaaaataaagcaaaaccaaaacacccgttttgctttgtccttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactaaaaaagatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaagatactggctgggcatggtggctcatgcctgtaatctcagtactttgggaggccaaggcgagcagatcacttaagtcaggagttccagaccagcctggccaacatggtgaaatccagtgtgtgctaaaaatacaaaagttagccgggcgtggcagtgcacgcctgtaatcccagctactctggtagctgaggcgttaagaatcacttgaacctgggaagcggaggttgcagtgagacaagatcgtgccactgcactccagcctgggtgaggaagtgagactatctaaaaaataaaaaacaaaaaaacaaaaaaaaccaagataccttttaaagagcttttaggatcattaagaccattctacatgccattacctactaatcaaaagaaaagttacaatttttgagagggaagaaacattttacctaaataaattctgtatttttttctgacttactatgacctgaaactgattaccacatcaatttttcaccaggaaggggatttgtgacagcaacaatactgccctaagaactgagtttaatcatcagattcatttcctccaatacatgtgttctgagatttattgcccactcatcttctctttccatgggctatcaagtttttatttaaaaaattactgtggccgggcgcggtggctcacgcctgtaatcccagcactttgggaggccgaggcgggcagatcacgaggttaggagatcgagaccatcctggctaacacagtgaagccccgtctctactaaaaaatacaaaaaaattagccgggcgtggtggcgggcgcctgtagtcccagctacggagggggctgaggcaggcaggagaatggcgtgaacccgggaggcggagcttgcagtgagccgagattgcgccactgcactccagcctggttgacagagcgagactccgtctcaaaacaaaaacattactaataactaggtaaagttacattttaaatctctaacaacttacaaatatgctttagaggtctatcctatttttagatttagtaagccaatcaatattccacagaattggaagttcgcatagctataggtgcatttacaaacatgagtacacgtcatctggtttgcaattgttataaatatggtaagcttgtacgcagacatgagtcattttgttaactgatagagcatgaaatataagagagttattcaataaaatatggaaatattaggttattaaattcaattaccttttattaaataacatatggaaatattaggtcattaaattcaattaaataaactttaaaatgtatattaattcagaatattttaatgagatactttcacttaattaagactattaatcattaaggctatttggataagatggttacgttgagtttatcttctttttataagcatatattgtattattttcaaaagggaggatgaatacaatcttgttaaaaaaatcacaatatgtaaaaatgtataccttttaaaagtggaggttatatcaatcttcaagaagaaaagtcacatggtagtgaattaataaaaagtcattgtttttaaaaacataatctgaattatttccttaatttttatctgaattaaagtggacatttaattattttgattctttaaaatctactcttcagcagtttctgtgaaccaatatggagataggcagacgatctacaactctatctgagtatgtacctttctatagacactttccgtaaacggaggattaacatcagagcagggttggaaaattatgtcaactctatctggtgaactccttctgggattacctcactctcttctgccaatttttatttcttattacttatgattataccatgaatctaattatttaatttgtcaatttgacacaatttgttcttaaataaaataaataatacataagcgcagctgactttgaaatacttactttctaaaggcaatgcatgaaacagtatcagaactggttttgaaaatgaagttttagaatagttttctcagccaaccaaataaggtcaatcttccatgaatcacatcagtatacaaacagaaattaaaactttaacaaattccttctttagttactgattccaacaatcttcctactccaaaatttatgggtgctgtcaataacagttaaattgactaaccaaaattttttgctattttttttccctacaacaggggaaaaaaatgaacagtgaaatggcttagaattagcagtagaggaaagagttaaaataagaaaaacctacaatgtgaaaaccaatgctttatcctcaggtagctgaaaaatcttcactaaagctgtgatttcacttttcaggtcctaaaatctaaatgtcacattccaccccctcccccaccaaaaacagtataaattgtagaaaacattttatagcatttaaaaattccaatgatcagtaagcatatactatagtcccaacttaatttgacgttccatttacataagaaataaaggaggaggacagggaaagaagaatggcatagccaaaacaactaaatttttaacatatattttctgtaaagctagttaaaaacaaacactatagctcatgtaatttttaggtgtaagtgtagggttggaaataattaaaatgttacctttgccaagtaattcccaatgtatcctcactggtactggggtataaatgcctgccgttttgattcatggtccagtcacaaatcctcagctgtcaattgaaacctagcagtcagatatggatcgagcagtactacagtttttagtatttaaatgaacacatgcaaactagtactgtacatggcattaaccttactttcccaagaggcaacttaaagaaaaaaaaaaagcaaaaaaaaatcttattcttgaaaagcaaaattcctagactcttttttagaaaaagctattgcaatatgcttctctattaattaaagcatacaagagaaacaagtgcttagaacataacaattagccattattagagcacaaattgagctggaatgaaagcaaacgttaatgttcaatagagagatatattttagaaagaaaataaaaatgctttttttctatgcatcacaccaaataatctgcactgaataaaataatcaataactttaagcatgcagtttgcaaaacacagaagacatgcagtttagaggagaaaaggcccaccttacaaacattcgccctaacttgtgtttagaagcatcaaggtcttcagttttaaccttttactaattttgttttgcttaaactggcattgtttagaaagagttgataagcatttctagttttattttaaactcagagtaatggcatttaaaatactttactacatctgaagaaagtgaggaatgcactgaatacaagctgaaacaaattcttcccagatctccgaatcatcagctctgcccttcagagattgttcgagtaaccctatccagctctgcttggttaacagctgccctacagtgctagcagatttattgaaaagatatattgcttatttttattcttaagaaagtaaacttatctgggttggggggggggaaacacagtagaaaatcatcgtttttaaccttcagatggccacactgtaaattaacagcatcttacattgaaaagatgacttcttcacagtaatccactaaaccttgtttgctgcttttcagtgagaatttccagatgatgactggaaccaaagtaccataaattatcataaacttaaaatttatgataaactattttaaacatttctgataatgttgtggccaaagaaataggctattaagaatctttactttcccttttagactatcgagcttctgcacacactaagtaatagtgattcaggagttttagaaagatagtttttgctcatttttctatcgatctatgaggctctaaaaatactagctaaaatttccaaaccacgtgttttagttatttgcatatttcaggatttcaagtaaaagtgattttatgatttaaagaactgaaaaaaattccctgcatatacatagatagatcaacagattgatagacatgtagattctgctcaggatatatgtcataaagaagtcataaatcagtaaataaattagaaagaaaaataaatattctttttttttttttgagacagtctcacttcatcacccaggctggaatgtagtggcaccatctcagttcactgcaaccttcacctcccaagttcaagcaattctcctgcctcagcttcccaagtagctgggattacaggagtgtgccaccatgcctagttaatttttgttagtagagatggggttttgccatgttggccaggctggtctcgaactcctgaccttgagtgatccgcccacctcagcctcctaaagtgctgggattacaggtgtgagccacgggtgcctggtcataaatactcttaaaatggaccaaaatactcacatgaaggaaaaaaaagtacactttgctttgttttaaatcagatgacatactttcaatatttcaaagaagtaaatgtgttcagtctagcgggaagcaatatggcaagatttcttaaaagttctcaaaatgggtcgtctaatcaaatttagtgtgatggggcaaattgtcttctgttttttttttacagttttttttactgtaaaagttttaaaagtacaatgaaaacaatcaaaaaacagttcaagaaacttggctttgtataacaagaatgttaatgatttatcacttactgattctactctagtcaatgaaaatggaagggttttgtttaatttttatttgtttgttttttgagacaggctttccctctgtggcccatgctggagttcactggtacgatcatggttcactgcagcctcaacctccagaaatcaagtgatcctcccacctcactctcctgagtagctggaattacaggttcgtgccaccatgcctggctaattaaaaaaaaaaaaaaattgtagcgataagatcttgctatgttgcccaggctggtgaaaatgctagttttgaatcaaacatttggaagaggggagatgtatatttaggcatagtacatattaattatgttaattattaacttcagattagtatctatggggctctcagcttaggttggagaagttttcagaaaaataatatgctttcacaaagccaggggaatctaaataccactcactgattgcttattgtcccacagacaactgtaggaccacatctcctcagaaggatgtgttgtaaatgagttagtttttttgttgttaatgttgctaatattttgtctgtttgtttgttttacgacccccaaaaatgtcaaatgggctatctttgaccatatgctgcacacataaaaatgaacgtatttttggacttttcttttctaaaagtagtcccaaagtggataaacctgactacagctattcattatcatctatttaagatatatgcaatagaaatattttctcccaaacagaaaaatatgcttaagtacattcaaaataaacaacaaatatatttagcaataatttaatgccaaataaattggcaatatattaattagcattgaatttccttttagttactaaaaatgtaaaatataagaaactaatttatctgtttagattgtgcactaccattacaacatttcttgaactttctgaggagacacgctataacttaagccaggttacttgagcaagagcctctctcttcatgttggtttttttcaattaataaaccttcttggtcataaagcatcttggaactaacaaaactccctgataaagtgaaattttaaagtgatggtatgggtgggggatgcaattaaatcattaaaatagaaatcacttattcaccaaagatttccatgatagtaattcctaagaaaatcaatttctaatcttatttgaccaagatattcctgaccaagcaaattgtgaacagactctatatattaaaaggttaatactacatgtatttaagcttcttttggggtcatgttacatattcttgcctttagcataattcagttttcctaataaaaaataattttacattaggctttaaataagtttaacataataggtgataatcttttttgagtttggggtggtgattccttagtttctgtcctgtgacagaatcagtgttaggtaattcagctgtaaattctctttttttattttaaaactttaattttaagtggcacataaatacatgcctttcatttatatagaatttttctaagttcaaagctttaagaatgctgtaagaatttttccaagtattttttattaagaaataggaaattgcttttttctcccaatagtaatcaaatttaaaataccaagtgccactcagtttagaaattcagtctgttagaattgtctgttttcatgtggaggtggggaacaattcttatttttgtaacaatatagactctcaaaaagaactgatcatatgcatatccttacaaaaatgcacactcatataaatcattttaatcctttaatttatatgcacataccaatatgaaattctattgtctagaaaatgcccagaatttcaaaaccaaataaaaggtgaactaagaaagtaagattatcttccaaaaaagctatcagtaaagggggaaggttggaacagtttaaacaaataagaaagatgtgaaggtgaagttttcactgcatatgttcttagggtggagttctgtggtctctggaaagagaaccttgttcctggcccagttcaaatcagattgcttcaaagaaaaaaagaaaaaggataggggccatctggttcctctcaaatggctacataaaggggaaacacctaagatttggatcattatcctttcctaaactacactcaaataatcatgtaagtagcagatagccataaagaattaatattgcttgtgacttcagactaatagtttgtttattcaaatgggggtcctcctttgttattaacagggtcttttgttaaatacacagcaattagctttgggaacaaaagaaagaaggtaagcaaaatgttctattttgctagactcagcaaacaggctgaggtactaacagttcctacgatgacaacaaatctcaactgaaccaataaaccattaaactgtgaacagaacaatcaacacaggcaaatttaccttctcacttttttttctttttacgtttacaatggccctcaggagaacatcttgaaaggtatgttttatgttttcttgtgtttcttcatttctccagaccctcaatgaaacagatttttaaggggtgaaggctctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaaaaaaaaagatactcaagatcatcctcatatcttaaaagtcacttctagtgccaatttctgaaacccatgtttcttgatatttaatttaattagcagaagtagaattaacttaaatgagtatgcatagtccatgagcagaataaacattattaaccataaatcataagataagtattagaaaatgaaagattttgtttttaaattagaggctactacaacttgtaaattttaaggtttcaagggactttggagcttatgtagttcaacctcttcattttcctttccaaggtttaaggacttgtccaaggttagaaatgccctgtcacatcaacactaaaacccaaaccttctgactcctaatccctggttctcacccactacaccagttgcctgtcattgttcctttcctaccctgtcccttatgtgcagttcaagaatatttaatgctaaaatatctgtaaataaaaccttcagaattccctctacctccctgattcaactgagatctaagttaatattttcagaaaagaagataattttttccttgtgtttctgttgattaaagttaacgttacataaaatgtaattttacttttacattaattagaacagcttatctggatattagtctttgattcccagtaaaggtaagtgaacaaaccagggaatgacaaaagacagacaatggaaggattttttgaatttaagaactagccaaagagctaaacatttgcatagccattatttcgactgaaacttcctttaaatgtgtttcctttcaagccagcatacatgaaaagtgacctcttatccacttacatacctacccagaagtcatgtgatagcgttttacgtcaagctgtcaattatgataacagacacaataagaacagcccaagtgttgatagcctgcttcctgactgtattgaaaagtttgttcatagtccacttgtgtccttttaattgcttgcctctaataaatgactacctttccaatggtagtaccaagctttggctttgccatttgccaggacaaatattataagaagatttaaactaatatcttagtttaaaaaaatcctacagaagtaatttcttaaaaaggccattttgtgtaacagaaattttcagtgtaatgagaagtactttcaaattctagttttaaaaacaaaagtgttataagaaaagtgttgaaacaatttaaatatacactagaccagtaattgaaattcaaataatagcattatatagtcatgcaagagatgtaacatgctgaagcccaagcaccaataaaatccatgcaactgtgagaagtaatgcaaagacctgaattgatcaggccactgattcattagctcttattataggtaatatatatatagtcaggagattataattttgagattatgaaaataagaccgatttcttataaactagactttacttgactttattgtctcacttagggaaggcaaaagtgagctcctaatttattcagttgaaatctcaaatatacatcaaaggttaatatgtacttcaatggcttgtttgaatggtgaacttttatttctaaacaagaagcttcttagctgcaaactttttatttccaacttacaatgagatttttaaatatatgttgatgtacaatagtaagaatttaggctcttattatgaccttagactcaaatgtaatggtgataatcaaattagccagattctcttgtattaatactaccaaactttctatgatagcaaaggaaagaggcctgaaattagcaactcactatgaggtagaccagataagaaactggtgctaattcaagtaagttgtctcttattattcatccatgctaaaattgttagactgaattataaaataatttctatatttcctaagcaacatccaacactctgattgatagttcccattttctcagggagataaaatttgggaaacgtggttccttcattgcctatcataacgaatttgcacaatgtgttcgtgaattataaagtatgagagagaaaaggatatactgcattttactgaacttctatgaagttaagtcggggcgggggggtgttccacatttctgaaaatgttccaaaccataaaaagacatttctcagcagagactaatcagttcagtttgccaaagcaggacccatgagttcttcaagccaccaaaaccatcttccaatagaaaagttaaagaagaatgaagctccaactgaagttctgattttaagatttcccccatgccaatagcgaatgcaataactaaaccaataatcccaaagacagactagttctagacttgaaaagtattcaagattgtgttaagagataaagaaaaagtctaaagtcaaatactgatcagctggtatgtgctgactattgtgactgattagagaggattatttttaatggcagattatcaactggtttacatgaacctttttgaaatagtctccaggactatgtgaatttattttttagattcaaatgagatatattttcagtgataggtgaactttcttccagtcagaataaactagtattcccaagcagttagcaaccaatgccatcagcaataattattataaaaaggaacacaaagatgtataattactaataacaattgtctgtgtaccaagtaaatgatatgaaagtgtatacttttagtattcagatttgacactatgaatgtattactcttacaggtgaagtacagggttcattttaacattagaaagcttttcatcttaatttgataatgctagtaagcttatgtattagaaaatgaccagattggaaactccactgtagtatcatcttgtggaaagattatttataaaatagtcaaaattacatgaccactttaaatttatcattaactctaatttatgtaggctctattaaagttcttttctaagaaaaacaacactcaaaactacacatcagtacttttcataacctaaaaggataaatctttataaagcagccaccatgaactgaagaatgtacctggtgacgatatttattcttaaaggatcatgtatattaaaggctatagggaatgtttaaaagaaccctctcagactaaagcactgcctttctaattttgaatttctcctagctaatataacatgattgattacctttatttcatgtaccccttgattttccttttcattcatcattgagtgctttaaaccaaatgcatttagaaactgcctctagaagaatggtctcttttaaatctttgtaaagtaatgaaaggacacagtaaatcaatctcatttctactgaaggaaagaataatctttactgaagtcatttaaactatttctgtttctttattcctggatagtaaacataaaacttcatttctataattcttttaaaatttgaaaggctaaaatgaataggcttttgactctagccttagtttactaatatacatctatagcatgatatgcatttatttacaggtattttctgcatgcctcaaaactggagttcattataaaataaagcatatatgggcttcttcaaattaaaaagcagcactaactctttcattacatagaggacaaattatctgtctgcatggtatttaacattttcagctataaagaacttttttttgcttccaaagattaatatatatcatgtatcccataagtattaactatagttgactgaacaaaacgtattcacattgtaagtggtctcgattcaatgttgtccacttaaataagtggctgtcttctttgattttaaaatagtttatagttctagaactcatagtttttaaaatatatcatgtgccagaatgctatctacattaaaattcatattttcatgatgcttgctaagttttcttgatatatttttagatatgtgaaagaagtaattcttatgttaatggactttagtaatcataattacatgaggcttcgacatttatcataagggataagaaaattaaagctgccataggttagggtagtggaggaggaaggctgcctccaaatacatggaattggtcagagtattctaactagcatttggggctaaaggtttaaataatggaggcatgttttatgcattaaaaattaactggaaattagagatgtgtcataaagaataatgcaaatcccatgagaaaaatattcctgagaatatgtgtaatgatttttaaaagaacaagtttctaaacttatacatcctgcatatgttttttaaaaaacacaatggacacatacatctgtcaaatagaaccatattctagtaattataactcatttcgtgttataacaattttagaggtgaaaaaaaagcaacattccagagaattatgttgagaagccaatggctggcaaaaccactaattattattatttggtattttcataactgtgtacagatgttttcagttagttctcactcttttggtttgttttgttttgctttttttaaacctggcaaaacatcaagtattctgaataagctatcatctttatgattttctctgagctctgcatgtggtgacctctaatatgcagtctgcccccttgggctgcaactggaaaggacttgagaactccacaccaagcacagttgaggtaggtcacaacaagggtatgtgaggtgaacagatcaagaatgaagtaagtgggcaaaagtatcttactacctacacaaaaagtcatatatatgcacaggcaacttataaataaagagcgagttagttaacaccagctctttattatttattatagcctaattttcccctatgtaatattttgcatactgttaatttcaaactgctctgctatcaaaacttgagagcagcaaacatatgcatcataaaatatatttaaattcggaactgtttagaattacgtctcttatcctgtaactagaatcgtgggatttctacattggtatggtccatgcttttgactgtggctgatctgtttataagccaccattaatcctggctgtatgttttcacagtttgggtaaacacttcatttgcattaaatttacagcattaatgagatgtgaaatttaaaatgctactagaaacataaatgatgtaagaaagcagaaccaaaaaaaagtgttttatcacatctgaaatcagtaaaccaatttaaagctattaaaataataggaatgaagtgtcgcctgagattttaacttcgtaactcatcgtcttggactaaaatacaaatgtgaggagcaaaacatctggaaaataagaaatcactcaaaaactcgaattatatactgcttctattctagttggctttaaaacagtttgcagtttttgtctttgaaagctatagtctgtaagttctcaatagccaatgagactgagaaaaatacactttggctgaaacactattactcatggatgttatcaatatatgctacagagatggaaaaggtcatgagccaatttgagaaactctactcaaagaggtgagaaacaaaggatcaatgagaaaaaattctgggaaatgaaatgatcagttttggtctcagaagccccgggagcccccttctgagtccggatctgagaggcaacatggagaagcacggaagcgaaagcgtggctacaccgtcacacctgggtgaaacttgcccacctgttgctgatgtaggaaggatgggtctcttgggcttagtcccacatatcgattggcttgagatgtgcctgaggctgtgtaggctgattaaggaagaacaaaaacaaagataaaaattgtgaactatcagaacgaacaccctgtccatgtataagaaacccagagaagtgggatttgcaaccaaaaaaaaaaagtgtcttcatttctcttctcttttgtctgagtgaacaccaagtgatagaaaagaaataataattgacttcaaatcaactagtttattccccctaaaaaatctatccagtaaagcagatctcatacttcagtgtgggtgtctcacacttacatgctctagtaactgtcctgtggaggtactaaggattggataaatagaagggccctgttcctagacgtactttttcaccagatagtagttgtctaatataaaataatcaatgatggtatatgattctaaatgtaaagcagactgaaagtccgccaggaaaaagtgacagcttttaatgatggaatttaagcagatgttcttaatgatatgggatggaaaatgtctttcttaaaagttttgctaaaaaggaaatcaaatcttactatcatgaaggagaagcctgtatcatgtagaatgaatcagctcggtattttacctgtgaaaatggcctcaagtctgataggaatgtttttgaaaaaaagtacttcccataagcacacatacaaaaatcaattacttgtaactgatccaggaagaaagctgatgcacctttaaatagttggccactaggtagtaagtatatatggtgactattccttacattgttatagtctcatttgcaagtactttttgtacaactgctttttgctttttggtatagagtaaatttttcacacacacaaaaaaaaaatgaatagggagctactcctaaagacttttgttacttttcacaaggaaaggactgaggtatcttcccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaagatgctcacaattcatattttaattgctcctgaataaggggacatgcaaggcagccatcagcaaccagtgacccctactcaatctccaagcctctggaattcaccacacctcacagacagccggagatgagcctcacccttacagaagagcaccaaatctatgctgctttttcttttcaactatgagaaagagccttccttggcttctgtgttttctttgaccatagtactatatcaattcaatgaccagttttttattactggtggtgcctaagaagctggagctacaagcttgtttataggaaagaaaaactactcactatgtttcttttatgtaggagtggaaaatggactgatgcagccatctttatacaaccaagatactccttttgaatattttgtaattttactagtcaaatcagatccctttttgaacaacctgtatgtaagtataaaaacaattcattaacaaacaggctgagggtactcctataagtgaactgtgatcatttgggtctgatcctctcctgaatctcttctattaataacaccacaagagtaggcatcagagtttctagaacttggttttgaccatttatcctgtgataatctttcaactacttaaaaaaaaatctttgttttctgtgtgcttttatttaaattgctgacattgtttgctcaaagatgtgaagacatccacttttaaaatgagtacttagtgttttggtgactgtaatgcacatagcaaacctctagaacaaaataatttttagtttttcctgagtaggtcgcatccatctgtgcattcagggaagtattctaagcattaagaattactgatgggtattacaagcctataggaacttattaattgacggggctcatgaattttgagaaagaaatgctgaattcactgtacaaagtattgtccatttttcttatagggttccttcctagtctttcagaaaccataaaaaaaaaagagcatctttccaatggctgagaaagaatgagtggtgcatgcctctgattgtctctgattcacatggaaatttcaagatcatggggattttcttgctctaagaaagaaaaaaaaaaggtttgaattgaagatatctgtataattggtgaggtgcatgctaattccaccaattcgatagctttatccattctacttcaccaatttgtacattccagctccagtactaagaagctgacagttgggtgaaaccacctcaaaattaatttcttctatacttctaagtattttacatgaaaaaacaaaggaatgatgcggcttattggtacgtgttaggaaggttcactggctaaatctctgacatttaaatgttatggccacactaaaaagcacagtatttgatgtaccaatgataagcaaaataatcaaaaggttttaaaaaaaaagcttgcagatagtgaaagtacaggtagcttacatgtgcctaatactaagttttgaaatgtcctcatctgttcccaaccttatgcgactgtttttaacaatgacataacctacaatgatgtaaacatgcaattaccttacagaggcactgattccatctgctttgtgaaggggcttgatttctataggaatgctccaataagtaccaattacctaatctctctttgggtgatacgaaaactttgtattctgcgttatgttactcagtgcaatttcaatgtataccttgaacaagcaggcatgacttattatttttgttatagctgttaacttaaacaagtgagcttctcccttttcaaatatgattcactgactggaatttgagaagagagagcctgtgatagcagggccacatccatgcctgctagctccacttaaatgagaaatctccatctggtcaggtagctggaaaaattgccgtgttttccaccttggatcagatatccaatggtgcctctgatggacatttctcatttcctatggaaatacttactggttgctgtaggtgaagctgcctcaccttcagtggatgtagtgatgggtttagtatctgtcatgctcagggtcacaggtcgcactgcactgggatggggagagggtgccaagacaggagtgaaatggccaggcactttccctactacttgaccactgccgttaggctacaaaacaaaaacagaatgccgggtgaagcaatccaaaaggcagtcatcttgttcaacaagtccactcagcacacacgactgtgtggatccagcacactgcgcataggcgccacacaggccctctcgagtcggagtcggagaggccagtcaatggttggtagtaataaggagcagcagcatttcaaagaaggttttcatcttcaaagcacgtcatggtataggtgaattcctctttacagcacccctgagagccaggtagacttgatcctttcatgtagtaggccaagaaactcaagtgcagacttaaatgcttagcccaaaggctaaaatggaattccttactgaactagctacagttggaacccaatgcttccttattctctgctcttcattttctataatgagtcagttttggcttttagaacacaattttcacctacatgatgatatcactgaaacaaaggacacaaaaatatctaggagatcaaatacaacgaattctggaattttcatcatttacagtcaagaaccattctcctgcatacaaaactctagctctcttacacacaggtgtgctgagatgcacacattaggcaatttagattccgagatctatggtcaacttttgatgatttactaatacaagaagatagaataagatgtaaagcatctaaaatttcagaggtcatacaatgatataaaatgctgagctacgtttgtccttacacctacaaataaaagatttccaaagtaaattaaactgtactgaggggaagcagaggacaagcaaatgagcattgttatttgagttactcttacatccatggtggtgcatggagagttacacaaaacatttcttgttgacatttgtgagaattaactgagaaaatcccctgggcaatgatagaaaagatgttactatctgagttttagctcctgggtacaaaaatagtttccgtggtaggaaacaaaatcctaaggatacactctttgaagaaatagtggaatatatttttctagactgagaatgttatttttgattatacccatgttggaattctccactgcacggtgttcatcgcaatttgctgggaggctattctcggcaagtatatagtctttataatctgaactgttaaaggcaaaaaaaaaatgaagcagaatatttttctaaatatctgcacataaattacaagtagacatttatttagagaaaaagatgaacagctaataacacttaaatattgtgacttagagacatgaactaagtcttcggttaggctcctcagaggccacattatttattctataaagaaaatggacttcctgaatatcctgattattcatcatgggtaattttaagtatttaacttgatgtcaggaaaattgaccagagttttccaatatggaaacctatgggagagttacatctttaaactaattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagtcaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttcttttttttttttttttgagatgagagtaatatgcttccttagaaggtgatatgtatcttgaaaaagtgaagaaaaactgagaacaatataggcagattatcacctaatatgccctcttaacttataaagaaattgaaatatacgtaaaacaagcactgaataattaaagaaatgtgtaacactaagggcctgattttaatttgcataatttttcccctaacagtgcctaattaagacatcagttaaaaaaaaaatccaatggaactctaagattttccacactgaattaacgttaaggacttttaatggatgtcttaattagactttgttattcatggaaattctacacaaattaaaatcagaccttgtgtgcactgttcccagctgagtctagcaaaatgctctatggaactgagacttctgaatccatgagctgacaacaaattttatttctaaacgatatactaagatcccactctcacttagctgtctttagtacttcagtcatgaaaagtgctacaacattttaacattttcttctaaaatacaaataataattttaacttcaaattcaaaattcaatattgagtttaatatctcagtcagtcaaactaaaagtaatgataactttttaagtaacccaaagggtcctggatgcgttgttattctaaattaaaagttcagaaaggaccattttgtttcattttaacaaattaagaccaaagggatttttttctcacctttctttgctaatttaaattgatagacacacactatttactagcatttcaggaatgttccaccgtagtaatgacggaatgtttgtgaaaattctccaaaatattaaaaggtataataagtggacaggagtcttagaggtaaagcagcaaagctaaatatcagatcctaatatcaaaattacattacatgttttagatattacaattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaaaaaaaagaaagacgcttctagtaatgtcactcattattaaatgtaagtcatgtctctgcaaagaatattcaagtagtcatcaaacactgagaatgtttacattaccaaagcttattttaatacctaatagttggtctataaatacaactgtaagttcttttgtgtgtgtttattttagcacataccttactcctgcctgaaataagcacattgtctctgtgtcaaaccaggtatttaagaggtgtgaactccagcccagagctttcctgtcaatgtactttctgcataaactttcccttcagtcagtgaaaatccaaaaacattaaaccatcttcacaaatgtaccctttggggcaacacacttcctacctgtcattcagccacctttaaataaaaacttattgagtcaccaagcaacttcctgaagatggatttcaaggcttgacgttctgccagacacactgtctgactaacctttgtgtctcagaattagatctgtcccatctcccttaggtgctaatcttattttctctcttatttttacctggctggtttgtggactggatgggtcataagaaggtacatagttcttcagagtatcctgaggattcaggtggggaggatatctgattgttggatgagaaaagtagctcgatggggctggaggaaggatagcttgtgttggaaatggcaacggtgaaggtggaggtggagttcgagttgagatgactgcagaagacagaaaaggaaagattgactcatcagctggttaccttattgctccattctgatcctgaagaatgctgtgaaactacaaaactggtaaccattcatttttgtccccatgatttaaccaagctctcctaaatcaacagttactttttcatttttattctcaacaccagtacggctaactacacagagataaaacatcactctagaaaattaacaatcttgcttcctggctctgtgagtggttacaaaatcagtttctcttttataggttatgtcaatacttgataaaacacttctttgagcaaagatatatcccgttgaaaacatattctttgattataaaatctttaggccgggtgcagtagctcacacctgtaatcccagcactttgggcggctggggcaggtggatcacctgaggtcaggagttcgagaccagcctggctaacatggtgaaaccccatcgctactgaaaatacaaaaaattagctgagcatggtgatgggcacctgtaatcccagctacttgggagcttaaggcaggagaatcacttgaatccagtagacggaggttgcagtgagccgagatggcgccattgcgctccaacctggtgacagaaccccatctcaaacaaacaaacaaacaaaaaacattttgtctcataagccccatctcaaacaaacaaacaaacaaaaaacactttgtctcataagtccagagcaagtcacagcattaagtagagggcaaaagagccaaaaattttctaccaaaattaaaaacaaaagtgaaattcaatttcaaataaaacgtttccctgtacatcctacctggcaattgtttagaaggaaagacaataactaatacaacatcatctcatgtcatttataattgtctggtcatggtataaatgcttatgaacattggaacatagagctagaaactctcctaatgaaaatgtttctttcaaaaccaaaagagctctattctgcaactatttttctttctactttaacttttactatatgtagtttaaaagatattgttaatataaaaccaagaataaaacacacagcaatgaaaatttaagctttcatataggtaagtatattactttacccatatatcacatattttataataattttataaagggaaatactatataaaacacatgcaatgtggacaatgttcaattttactataacttctcaacattagtattcttataatttattgttcagtttttgaaatataaatcttaagtttgaaagatggagaaagagtgtaatcgtatgatcattatctctaaaatgttgagagaaataatcatagaaatacaaattaaaactaccaacaaatatatgtagaagtgaaaagtaaatgtctttctattttaatatttcccaattcaaataataggaaattataaacgataaatgtctaatgttttatgagacaacttaaagaatatgaaaaaaaataaattttagccataacctacaaagggaaatcacctagaatgatttatttccaactttgaaactatgtgggtgggggggtgggacctatttatgggatgtattgcttacctctcccaaaaaaaactttttcagaagatataagaaattaagaatgtatagaatagaaaaaacataaattcaattttatagtcacgactttgttctctgaacgtccagagcactgtttctgaaattctctgtattgttcttacaatgcagatcccttggtctacacacagacctaggggatcaggacctctaggggtaaggcaccaaaatgtatattttaaataagtgtccatgtaatcttcctacatactgaagtttgagcatcctccatcaaatgtatgcatttcagagaacaaatgcgtatttcttaaaacaaaactctttactgaagtattactttatttaagaagtatacccatttgaaagtatcatttaaggaaatacaaacatctaagaaaaactgggcatcttttacttagtgtctaaatgctcttaatctcagctcattttaaccatgatttttgctcacatctgtacacaaaccctggaaagatatatacatagttccatcttgggtcctttagcttttgagattaatttggccttaatagttctggaggagatctattttcaagtgaaattgcagaaatcaaacccgaactcacatctatgggcaacctggcactgtgcttgcatgagctgtaggtggcctgataccactgggtaaaatgtcgtatttcaaactgagagtaaaaatgactaccttttccataaaagccattctagtcctttaaaaataagaaaagcaggccaggcatggtggctcacggctgtaatcccagcactgtgggaggtcagggtgggtggagtggatcacttgaggtcagatgttcgagatcagcctggccaacatggtgaaaccccatctctactaaaaaaaatacaaaaattagctgagcggggtggtgagtgcctgtaatcccagttactcgggaggctgaggcaggagaattgcttgaacctgggaggcagaggttgcagcgagccaagatcacgccactacactccagcctggagtaagaccctgtctcaaaaaaaaaaagaaaagaaaaagaaaaaaaaataagaaaagtaaaatacaagacaaaaagttttcctttattatgaaagaatacatacacatgtatgtgtatttcttgcatacattattgcaaagccttattgtcttctttccttcagtcttgctccttccaaaacatcctttatagtgctatgtgaattactttttaaaaacaccattataatcatgtaacttctccgctaaaattatttcagtggcttcctactgcttccagaataaaatcccaacaggtttttcagtacacacaacctcaggtactctgagaccgagtcctggatcacttctttggcttcatctctggccagacgaagatatttgtggatccttggctatatggcagttgcctgctgcaatggcctctaatgcactgatacatgctgttgcctctgcctcctttgcctgccagtttgccccttttcttcctagtttgcctctctgcctcccagtttgcccctcttcctcttagtttgcccctctgcctcccagtttgcccctctgccttccatgttgcccctcttcctcctagtttgcccctctgcctcccacattgcccctcttcctcctagtatgtccctctgcctcccaggttgcccctcttcttcctagtttgttgttccttcttgtggtgaactttgccatcacactttagctcagaacacatatcttccaggtatctaaaccttcttcaggttatctagtcatgttcagattagatgcccagccaatgacgtggccccactctctccccactatatcctgaactctttaaggacagaaacgatctttctgaacaagatgcctaacacagaccctaatatacagatacagaacaaatatcgggtgaaggaccaaggtggagggctcatctaggtctctcctgtttcgttatataaaaatatactgtctactttttttcacgttagaaataagaatattttcatcaggtgtcgtaacaaatgggtgatttgacttctcagttaattctgtccaaatattcaacattacaaacctatgaaacagttactgattttttcacctatctcaatggtataggtaataaatgcaaaagttcttataccacatttaagttgtatagtcctctctcaatttcgtaattttttaatgatagcaataaaggccatgcatttttttaagtatagcaccaacaaatatcaacatatacttacaaaccaaagctaataaggactttattttaaaagatgttacattgtttgcataaagatttaaaaaccagattcgattagtcagaaggatgaggaagtgcctaactataaatttaaaccaataacagtttcactattaacatatttatatataaaactttttccacctaaaatgcagtctactcctctctaggtaaaaagtacacagtgttaattattagctgtatctcatttttaatttttgaaagatttggtattagctgttggttaaagtacaaatgtcaaatattggattcattttcctacttaaattaagacatcagacacaatatcaagtgtactagcccaaaggatttgggcatataaaacaagtgtcaaaaaaagtaccttttattctctgattactctcatatagataaatattgatttatatgtagaaaataacatctacagaaatagtgccttacgtcttaatgcctttagaaacactctaaactcagcaacataactgaaattccatctttcccttagtaaaatatcaggactaatcctgaagctataatgaagatagctatgtacccatattttccacattcttctgataacaatctttttgattaaggtaattttaaaacacatattataaatattatttacttgtatgactttgaaaatctttcttttttctttttgagatggagtctcactctgtcgcctaggctggagtgcagtggcacgatctcggcttactgcaacctttgcctcccaggctcaagcgattctcctgcctcagcctcctgagtagctgggattacaggctcatgccaccatgccaggctaatttttgtatttttagtagagacggggttccaccatgttggtcaggctagtcttgaacacctgacctcgtgatccacccgcctcagcctcccaaagtgctgggattacaggcgtgagcccctgcacccagagaaatcttttctcataaattgagaagaaaaaatacttgatcggattgtgcccctcaccatatgggttgagaaaatatggttgccatagctctatttataaacttttgctccgtccctaagggggttaggccctacagacaagaaggaggcttctcctctatgcttgaaactcctcaccactgtgtgcaactccaggtattccgggatggtggtgctgggggaaagtgctcagtcttggggaagaatcctgtggagatgcagagctgaacaatggcttttcaggcttcttcatagtagtcggagaagacatatctgcgagaaacagagaaaaacccaaagctccatgactttcttaagctctaaggttcatgtcaacaaatgacagatctcatcttgcaacattttagtattcttatactttggctcttttacaaaatatattctgagtgtcaacgatccagctgtcttggagctctgaaatatttgttcaatctccatggaagctagcagaagccttcattaaaattatcatcagaattattcccattactaaataaatcttaaacttctaaaaacccaaagtcttgtttcctttagccccttggttcacacaaaggccttctttacctcagtatttcattctgagatttatatgattcagaagattgtctttcgacagaggataactgctgcaaatgggaaaaacaaccttcaggtatgttggtcacgatatcactgatttcacagcttttatggaaaactcattcacttgattagcaaaaagtacattccttaatttactccttctgcaaacgtttactgggtttctgtactggccaggtaaaatgaagatgtcaaagaaattaaaagtaattcctgctctagggatgctcactgttggtgaggaggaaaatgattagaagaaaatggttgtgaatggttgagaggtacaatgtgtgttgagagcagggaagttttggcatttgctgctacatcgccagctgcgatgtacaggacagatatcgtctcagtctccccaggatgaggaaggcatttctcattggtgccattttcaaaatgtgaatgaggatgacattctcagagaggaaatactcagaaaaaaagatggcacagaatacacaagtaaacagtgtgtggagtggtgaaagatgaagaagaggagcaagcctcttgcaggtcccacaggatgacgggtctccagcttcctgtacaaacgtctgaatgcttaccctcataggagaaacgccatagatgggcaaaacatgatcacaatgacagtttaaaacaattcccccagaaactaaatggagggcggactggccaaaacagagacagaaatcatgaagaccacttcagaagacagattcatcaatacattcattccataaatacttgttcaagaccgaatgtatgccacatgctgcactagcctgggacacactggtgaactggactcactttcggctcctttaaagcttaaaatctagtgaggcgatgtggacaagtaagaaggaattgcaaaggtgctgtgataggaaaagaattcagagatttcgggcttcattcactcattcatttcataaatatttaatactgccaaaagatagatcatgagagcttgaaataagaatcatgatagaactaatgcaataaatattttaacagggttcacccaattaaattattaagcaatgtagactgtcatcatcttagttgactaagagactataccatgcagtttgttggaataagcagggagttgagagatatgccttggttttaacatcttgagtgctgttgactttaatggaagtttatcaactcatagtaaaatgttataaaaatgatgagctataaaatttgtattttattatgaaaaatgttaactgtattcacaagtagacagaattgtaatgaatcctcacgtaccgataacccaacttcggcaatgatcaactcataacaaatcttatttcatctttatccccatctacactttctctccctgtggtactttgaagcaaatcccagatatcatataactttgcttctaagtagttcagcatgtatctctaaaagaaaataaatctttattaaaagaaaaaaacaccaaaactttatcacacatacaaaatgtacacaatttgcatttttgagttttcttgaaattagaaaaagaccttatggtgctattaatatgagaaactaattatcattacattttaccatttgaaaaattacctaagctctggtaaaggcattcataaaattaaatatgcattttcagcatggtggcatttaaaggatgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataataaagcataattatacctcattttaaaataatttaggccgggtgcagtggctcacgcctgtaatcccaacactttgggaggctaaggcgggtggatcgcctgaggtgaggagttcgagaccagcctggccaacatggtgaaaccccgtctgtactaaaaatacaaaaattagctgggcgtggtggtgggcacctataatcctagctacttgggaggctgaggcaggagaatcgcttgaaccttggaggcaggggttgtagtgagccaagatagtgtcattgcactccagccgcgacaagaacaaaactctgtctcaaaaaaaaaaaaaaaaaaattaatgtgaccacagcttgagaaacagaacagtgtcgttctgggtatgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattttaagaagcaaagcatttgtattttcttagccaaaatgacacacttgcttttactgagtaattattatgggtccatttattttttcaattcttttttgggcatgcacctaataataacggtacgttcatagaggattatacagaccaacacagaagaaacagaatacaatttgctgttcaagttgcaaaaggaaccacaaactctttccttaaacaacaaaagtaacttataatagtaaacataagaatgggaaggttcactgaccaaactgaaaggatttgctttagagacaggtgaagaacggtagtatcagaatataggtttaattgcctttgttttctcattaaatgaaattaattcttggcccattaataaaaatacactgctacacagcatgcagaaggcactatgctaagaacttaggaagatacaaaagtgaatccccgctcaaaaaaaaaaaaaagacaaaaaaacaaaaaaaaaacaccctctctagactagaaggggaaataaaagatcaattatctggggaaaaagtaaagatagagtttctagctattacattttaatcatgaaccaaactagtgttattttaattttaatttattttgaatgtctacagtctaaaaggcttcatgccaaggtgaaaaatgatattgtttctatgtgtaatgtgctcatatgctacaaaaaaaagtttgaagaatgaatatatagaaaagatactttaaagtgacctttctgtgaagaaaaacaaataccacgctttacacaatctactgtccctcaagcaggaagaatactacataaaaagattaagttgaaaataagttgaataataataaagttgaataatgcataaatatataataacttgaataatgcatacataataatgcataagttgaataatacataaaataaagcagctgaaaagagatgcaaaatgataggcaaaggattagctgatgtttctactggtgggagggaggcaggagttgctggtagttgaagagaaacaagtagaggccagtgatggcttaaaatcagacagaacaatttaaatttgatttagaaagtaataatttataaatgaattgattttagaagaaaaaactttccaaaaatttgactttttttttctgttctcaccgcccttttcacttgtacctggctgaaccaaaaattttcttcctagtctcctccaggccttcctctccatggcactttataaaaaccagcagctggcatcgtatccttcaaacagtatctttctcattgcaagatctaccacagtatcacatttttaaatagctctttttctttgttattccattttgtttaaacttcagtgaagctaattttcttatggcttccattaggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatttttcattgttatttacttgtatccactgcgtatgctttttttaaaaaggtgactaatggcttacctcctaaggaacatgcttttaccaaaaacacaaaaagatgtagaggctggaagaatatgctacttgggaagagaatgaaaaaaaaaagtagaaatgaaagaaagaagaggtaaagcaggcaccgtgtctaggcagcttattttagaatctctggcatgtgaaagaaactgtattatgaagtgatgactagtagtgcaggatgagaaaaataaccatagccagtatatcttaaaattcatgttccatgaataaatatcaccagatgagaagtagctgactgtaaagcaaagagaaaagaaaatcaatcactgagattctagtaagtgtgaggaactatggctatgcatcaagatgccaaacaaaaccacgtggtccctgtcttggtgatgctcatggtttagtagagagggcagaaattaaagacagaaatgcattaaatagttgcaatcataataatactggattgcagaaagaattcttcttaatgacagattagagagaataatttttttaaaaagattcacattgatggtgttattcttcaatgtgtacacccatgtttacatttataactggaaaattagctatgactttagaaactcatcgtgtagttgaatatggaataaaagatcaccatgtaagaaaaaagttcaagtaggctactgataaagttggttcatttattcttaagcatccctttaaataagtattttgcaaaatcaaattatcacacgatttttcctgaccatactatatatatttttggcactgtaacatatatacatcctaggccttgatgtgttatttatttcacgtcatcacttcaaagagataaggacttaagcaaataaagagttagatcaactcatctcccaacaaggtaatttcatctacaaaggaagagagtcgctgtgaaacacagcgtatgtactcgactcatcggcagcttgcacaaattgcgctccagatgtatatctgttcaagtcagcccaaggcaacaattttgatcaattctaatgtgataaaatgctgcagggaaagtgtgcagaaacgtgtttacgtcagcccttaattaaactgttgttcacttccaaagaaccttaggaaacactaatgagacatgagttttggcaatttcttcatcaaagcaaagaccccttcctcagtctgtagcagcctgtcatccaagtcgctcccgggataaatgtcacatggcactccaatcagttagccacctgttagtagaacttcattgaagtcaactagtgatctagggcaagctcaaacagcaccttaacacctgcctgtctgggacacctgctcctttttcacatatagtagagcaatatgttagcttttccaatatgctcgagtagattaaggttacaaatcagactactaaagcctacatagaaaacatacaattttcttttttgaaaaattccttttcttccctatagtaacacaatttttaacaatttcaaattaattatgtaagaacacgcaagaattcttgaatttctggaagctattattttcagcaaaccatatcactaaattaaaatgtattaaccatgccagtcctatgatttagtcctttttctaggatagaatagtcctatttctatctggttaacaaagaagtaaattccttcaaaatgttttaaaagtgtaattattttacatattcctaaattgtcttccttatttacatgccatacttgtaacttgtaaacaagtctaaatgaaccctatagagacaagtcaccatttgctggctacttttattctccagtatttaacgttaaggtttgttttattgctaagtgcttataaagctataatcattgttaaaatatctacatattttctttatttttcacattatcaagctgctaaacaatttacaggattcctctttttcctttctatcttttattattgtgtaaatttcatttatttatttaaatttatttaattattttagagacaaggtctcactctgttgcccaggctgcagtggcacaatcatggctcactgcagcctcaaactcctgggttcaagcgatcctcccatctcagcctcccaagtagctaggactatgggcacacgatcacacccagctaatttgtaaatttttagtagggacaaagtctggctatattgcccaggctggtctggaactcctagtctcacgagatctcctgccttggcctttgaaagtgttgagattataggcttgattcattgcatacggtcttcttttttcctttcttcctttttttcttcatcttctttttttgttattttttggcagaagaaaactcaaagtgtaatgaaaacagttgcaaaacttctgttaactttgaccctctggtatgatactgaccagaggagtttgatacagaccagagaaggaaagaacatacataagcacacttagcttagagacagtccaatggctgggatttgacaagattatattatattgacaagttttatcaagttgatacaccctcataattttcaaagttcttcattttttggacttttgaaagtattagactttcatagattttttttaaaagagttttctagataaacaaaaactctgaatattgaaaacctcttcagagaccaaattcattgctgggtgaaggcaaaggtggtcaacacatccatcactccattgaaactctgtcaagcaacacagcactgaaagagaaaaatgagctttagcttaactgggatatttctgctttccattaaaatgttgggtggaagctggaagacaacaggaaaaagaaaagaaccatctgtataagataataatgttatttaaaataaataaggtagtaaatgacaggctaccaaatcaagtgtgtgggatgagttttgtagctgaaatctgacatttttacttcaggccacaaatccagagtcagtcctgagacaaggaaacagtttgggctctgttcccagaggacaaggagaaggcagagaagatgactgccaactgaaagctaaaaagaccacaatttctctgcctctgtttttgccctgggataaacagtgttgaagagaggaaagtgtccaggttatttataagtgtatgagtgttatgtagaataagacaactattaaggccagattggggcagcatctagcctgccagatacttaagatcccagtccaaagctttgaggtatttatttctaaggatctccatgtagagaatgacagcaatccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctgtcagaggacatgctttgaaattgcttatagagccatgtgctacattgaaattattacggcttataacaatggagttaagccactcaggcactgctctagggaatgtaaattgataagatctatgccaatatttaccaaaagccttagaaatggacataagatttaacttagtaattctacagtaggaatgtatttattcccgtagcaaaatttcactgaacttctacttggtgacttcatgccaggcagtatgctagggacttgggacagtgaaaagaactagacaagaatcacccaatcagattaggcacagagttacatgcagtgatgttcactgtatctctctttataatacaaaaactccaaaactatctaaatattcatcagcaaagtagatatttaaaattctatggtgtagccaaagtgtggcatattatgtactcattacaaagtggaaggctggatggggtggctcatgcctgtaatcccagcactttgggaggccgaggcgggtggatcaagtcacctgaggtcaggagttcgagaccagcctggccaacatggcgaatccccatctctactaaaactacaaaaattagctggccatggtggcgtgcatctgtaataccagctactggggaggttagggcaggaagagttgcttgaaccagggaggtggaggtggcagtgagccaagatcacgccactgctctccagcctgggtgacagggcgagactctgtctcaaaaaaaaaaaaaaaaaaaaaaaggaaattgaaggatatggtaaaatgccattagattataaagacaaaaaaacttacaaaatagcatatatcatataagctcaatttactgcaaaaatacattcatagaaatagaacgcaccgaaatgcagaaaaatacatagaaaaacaggctagcatatatacaatgaaatactaacagaagttatctttatgtgatgagattacaggtgatttttattttcttcttcatatttgaaagtttgttttttcaaattccccacaaataactattacttttactgtaaaaactgtaaaatagatatttttgggaaaattgttgcctgtagctccacagaatactataaataattcccaaagctgggctgacaatattgaatcctgttaggtgtcccacattacactgcaagaaggaaagcttcatattagtttaggtactggatattgcaaaactgtaaaatgaaatgcttcaatgtaacatttgcaatttagttggctacaggcaaaacaatgtcttttgaaaatacagtgaagaaaaaagaatatctaaatatctgtgtctaaggactcctctagatgtaaaattttatgattgtgtggcaaatgtgaacaagtccttcccacacactccaagttaacaaaaagctctgaatgttatgacaagacatatggatgtaatcccactacagtagtttgatgatgatgccagatgattcaaaaaataattagctgccatgttaagaaagtatctccttatatatatatatttacatttatcacactctaaaataacactggaaaaaatggcaagctacgttaagaggagataagatgtcatcttcaattagatttctcaaccattttttttaaatttatgaaatcagttccttttcaaatgagaaagtatggtggtctttgtgttaaataaatgaaattcttactttaattactgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaaaatcctttgaataatgaagaacagtgctaaaacagtgaatatggaataaatgaaaactactttttaaaaacacttcaaaatgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaactgtaaaagtcagaaagatactggaagggctctaatttaacaagattacagatgagttttcagaggagaacatttggggaaaagccatacatttaaaaacatttatgctacaagacatctcaaggtttttgttgttactaatgctgttattatccacgctggtaatggttagagttgatttaactgatgtgttactttagtggatttacaggaaagtcctataaatgatctggaacttacttcaaataaaatcattacactgaggtagtaaactaattgcttgagaacaattatgatttgatgtgatttagtgtggtagaaaaagaattacaaaaattttaaggtcatcagttcagcagctcaatgcaaatatgattactctgcacaatattctgttgctcttaatggaaaagtagtcaaaattggtataaattgtagtgtttaagttcaacctaaatctatattttttttctccaacaaatgtaaatgaagaaaaaaagaacattctgtcaatgaaattactatgatggcatatttattatcctaatggttttagaaatcatgtgaaattcatcagtaacaaaacctctatttagtaatggaccaattacatttgtgagataatgtcaatgaaaccgaatattgtcacaggataatggtctcccattgctacatccctagtcatttagagaaaataaatgttgctgtctggctgagtcatttgttttcaaagtaggagacactgattccataacaaggttctgttataataactcaatctctatcaatcatttgttgcaccagaatggtgcaggacaggacatgcatttgtgagaactgcgcattcctcaggtataaagcaaaatatacggggcctccaagcacataagcagcccaattattgttattcaatgagagtgtttaaaatgaacattcaaaaaataatttaagaaacagaaaactttctgaattttccaaaagatccatgttaatgacggctttggaaagactcaagtactgaagatcttcaaattcttggactccaatagattcaaaatctaaaatattagaacacaaatcttagtatacaactttgttattttacagatgggaaaactcaagagttactgaagttaagtgatttgtctaagaccacaccagtatttagagtttcctaatcacaattacagtgcactaggcttaaggcaaaaagactagaacagaactaaaagaaaacatatgtatgataataaatatatactttatttttatattttgacaaatatagctcattttaaactggccatatatcacacacttctactaaagacattctagaacttaggattatttattactatcttattaaatggaaaagtgattttaacctgatttcagagcaaggactacatgcatgaatctctaaggagtctacgaacccctgtgaagttatgtgcattcatctgtattgaagtttcatgcattaaaaaaaattgtaacagaggttttataattagtttgcaaaatcataaacataatatctcaatgacttatttgggatacagtattatatagcaataacgagcatgggtttcttcagcaagagagccaggggttcccattctacctctgctacttatgatctgcatgatctatgatgagtttcttaagcatgatcagtttagtaagctgtaaaatggggtttctgtcaggtttaaaagaaaaatagatataaacttagccaagcacctgacagaaaggaagggctcaataaataaatgacaaccacaaatggcaatagaatcttgttttccatgtttcatttacatgtgcttgttgaagacaatttttaaatttacatgctttcttcaataaataaataacacagaaaaaggaggcgaataatcagtgtaggctaaaaagaaggtgaaaatacaaatataatctatggactaaatttgagtcctgattcaaacaagacaacctttgagatattctagggaatttgaacatggattatatgttagattatattaagaaattaatgttatatttgttaaattgataatagtactgtgattatgtaaaaaaaaaaagttcattgttcgaaatattcagatctatttacatgcaaaatgacagatatctgggatttgctttaaaatacttttaaaaactgggagatagtaaatgcaataagactggcaaagtgttaataacagttgaagctgtgtgacagtacagtgaggttcactttacaattctactttcaatattctccaggccaaaagacttcttaaaattgtgcttaaacattcatttcaaacaaactcttccccacatttattcttcaaaagcattcatatcttcagtttattttagttgaaaaaattttaatcctggcactaataataatagttgatttatgtgtgtgtgtgtgtgtgtatgtatatgtaaaattttaccatctcaaaattttgttttgagaattctttcagaaccctgaaaactcacaaatacacctctattttctcattctagttctgttaggtctaacagagtcttccttaagctttccaagaaaagtgtccctctgggaagacttgcgaagcagtgtttaaatctcctaggccatttgtaagtttacatactgattccctaggcaggctgcaggataacagaaaatgaaaaaaatcccttgaacaaagatctaggctctgccattcattagttgggacaggacagcctctctgatccttggactacttagctgtgaaacaggagcttgaattatgtcttactaagggttctaataatttgtgatctgtacctgaaaaatcaatttcttattgtatatgatattgggagtctaataactcaaatgacactggctttccaaactacttcacaataagcttaaacatgaactcaatatgtaaaaagatttgaaataaaaccttttcttatgcagagaaactttgtatggcacactatgacattatctcccatgggtttcccacttccctattttaagctgtgttccatcaagctagaaacccagtattaaatagaaagttgttattttttcaaactaattatctattgtggtttttctgcaaaatgctgtattttcaaatctttaagcctccagagcacagaaatatgagcacgacttttccatattaatcagtaccagcccttctaacatgtatacaagtttaccccatccaaaatgctattcttgattagaacacatgaagggggaacaaacattcactaattaggaggcaatgtggggaattctgatgaaagccttcaccaacaatttattgttttcctttccattttgaagaagatcgtgttgtgatttttcaattacagcagtgtagcagtgtagttgaagaggcattcctcttcagggtggaagcatccttgaagtttgctttccaatgccagggtagtacctagaaattcacttagagttctttacttttgatattttccataataagaagctaaacaaagaaacttaaaaattgggcttgaacatcaaattcaaaccatctcttcttcacattcatccaccaaaagcatttgtagctctctttttttctggttcaaaactttggtatttgaatatttgccatttcatccctgtgatactaactgcaggaatataaggaattgttggtgttctatttggtccccaaagagaactttaaaacttcttccagtatggttactaagctgtctgcactgccattttctaggacttcatttaatgttaatgactcccagatagcagttattcaaccatctatgacagctgcttattcactcagctcccacagctctagagaaatcttgagattatatcatttgtcagactgtggtttggactagagcactgtgttccaaagtttgggcctaggattaatgctccctatggattctttgatagaaataaaaggttctgaagtcacaaacttaataaacatgttcagtcaagagccactcctggatattcacagcacacagtagcatattaaatattctgcatattcatttatgaatgaaaatagttgaaatttttgttacaaaaaaactttgcaaatttagctgaccactcttttgtatgtagcatatcttttcacattcctaaactcacattaggaaatgctggggagcctggtgtggtgcctcacacctgcaatcccatcactttgggaggcccaggtaggaggatcagttgagcccaggagttccagaacagcatgggtaacatagtgagaccccagctctacacaaaatttaaaaattagctgggcatggtggcaagtgcctgtagtcccagctacctgtgaagctgaggtgggaggatcacttgaacctgggggggtcagggctacagtgagccatgatcgtgccgctgcactccatcctgggcaacagacagagaaaaaacagaaatgctggcctctgattctggttctgtcagcatgctatcacactcttatttactgttacttatttcctgattgagcacataatactaaactggcatttttactctctagcccccagtgttcccttgggccctctggcttaatgcgtttgacatttaatactatatccttatagaactctagaaagtgcaaactgaaatttagcacaacagttaagactaccttactaatgagaatattttcaaaattatcaaaaataaatctctaggacttggaaacaaattaaaatttcagaaagacttaactgagaagacatttatataacagaactggagacttgtataaaaattagtagttttattttttagtacctaagacaccagaacacaatgcctaaatatagcttgagagtccagtttaatttttcaaactactctccaaattgtaataacatgccaatataccaagtagtgctagtttttgctaacatgccaatttattgattttatgtaaagatttacggctcatcgtccttaaaactaagctagctctaaagcatggagtcggttctctcataatcttatttattttagtccccgatttttctaaatagtaaaagttacttttccattcaggaggtcaagggctggaaacttaatttattcatatttgtgtacccaatgcctataaaaattcctccaatataatatagacatttgacaaattgttcattgaaccaaattatctcaaatcccatacatgtagaaattaataacattttactgcataaagtctttttgaatttatattttatctaagattacaggttgtttaaatactcatctggctgaaaagctgttcaaatttccatttagaaatccccagctgagggcaacccgctggggtcccccttccacactgtggaagctttgttctttcactctttgcaataaatcttgctgctgctcacaaaaaaaaaaaaaaaaaaaaaaaacaacgaaatccccagctgcatactgcaaatatatttaacatatcatattttttctcattaaatgtctattaaatgttttagaaattttacattcagacttagataaattagtgactattagaatggcagtggcaaagtgaccttataaagaattgttttcaatgttcaagcatactatttatttgtctgttaaattactgagtgatatggtttagctgtgtccccacccaaatctcatcttgaattgtaactcccacaattcccacgtgacatgggaggaacctggtgggaggagactgagttatgggggcagatctttcctgtgttgttctcgtgatagtgaatgagtctcacaagatctgagggttttaaaaacaggagttccctgcacaagctctctctttgcctgccaccatccatataagacgtgacttgctcctccttccaccatgactgtgaagcctacccagccaataaacctcttccttttgtaaattgcccagtctcaagtaggtctttatcagcagcatgaaaatggactaacacactgagcaacggaatacaactggatttagtctcatgagagtaacttgaattagacgaaaaactatgacctcttatttttcctcttatatcaaaagttacaaaagattgctctaaagaaaaatttcaaaaaaagtacatcaactagaaattgagtctctgaattgactcagatggaaaaaaaaataagaaagacaagatcttaatggaattttttatggaggaagtattggaataaaagaaatgttcaacttgcctgttgacagtctaatctggttctattcattaatcattaaaatcttaaatgaagaaaagcaatatccaaaaaagaaagtttttaatagagagagaagcagtcaggagtttaagaccaggatttacagaagagactaagcaaggagaaatattctgaaacataggaaagaaatataacagttgttggatacccctttgctagtgactcagtattattttccttttcattttgttctgtatatataaaataatacaaagtaaaaatataaatactacataatatagatgctgacaaatttaattttcatcactattcatcagaagaagcaaattatatagccccctaccaaatgcttaacactattaaattatggttagttttaaaatattcatgtctatatttgcagaagtataaattacaattctcttataatcaggaagttgtaactttttgttttgaaaagaaattacataaggacataattaatttattattgtaatatgctaaaaatactttttcattaagttactaaaattgcatgaacatattattacataaacctagattttgtgttaatattttgcctgatttattttaagaacagaatacatataataatttggtcatattatatcctttatttttgcctactcagaataaatctcaatggtttaggttggtatttcagattgaaagggaaagcagaatgccacatattgtccataattttgttatctttgattctcatatttaataaatcaattttgctaagggctatgtcaagaacagattttaatgcaaatttaacactaacagaataaggcatacccaggaaataattaatagtaaattttaaggatttctgcccattttaaacacaagcatattttaattaaccaataaatagttattgagtatcaattagtgcagggctttgtaggagaaaatattataaatacaagacatgtcaaagctatttcaatgactggagtggcactcaatatgtgctttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtttaaaatgcacatttgagaatggaatattcttccttcctctaaacataatatgcctttacagactcctccaataagtctagtcatcttgacaaaagaaaatcaccaagacaatacaatgttttcacaaagaaaaagaatgacagtttcccttctacttttcaaaaatgtttcataatatgatttgagattggctttattcagtaggcttaaagaggaatcaattcttacaaagtgacactctctataataaagaacacctacacttctgaataacgcatccattcccacacattcacaaggttattaccattaaaatcttctccagaagaattttctgacaaggaaagtatggctttgtttagaataagctgacaatgtcagtaaaacaagcaataaaatataaagggttgagggttttgtttttcgtttcacttctgcaactctggtaaaagtctctattatatcttgccttcactaatgagactggtgttctgcctatcaatggttcatttatacaactacttattgtactcctactacgcaccaagtgtgtgttaagtgctggttacagtaatagtcaaaatagacaaggtcccttctctcacagtgtagacagatttagacaactaatcccataaatagctatatgattacatattatgagtacaatgaaagaacagtactgggtgttgacagagaaaactaggaagacagaatttagactgaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctccatgaagatttttcactattctttaaactccatggcactcggtataaaaaatttgagcagcaaagaaggagcactgaataaagaactgactttggccttaactgttaaggcccagagttatgtgtctcctaagagtactcaacatagagtaccccaaccctcaccaatacacacccaagtcctgggctgaaaaccattattcctttcttttagacttttttttttttttttttgagacagggtctcactctgttacccaggctagagtacagtggtgtgatcacagcttactccatcctctgcttcccaggctcaactgatcctcccacctcagcctcctgagtagctgagactacaggcgcacaccactatgcttggcttacgttttattttttttttgtagagatggggtcttgccacattgcccaggctagattttttttaatgcagaattctatttaaaagacaatttaaaaatacatgtttatgctgctgacattaagatcttatttgcagacatgcttacataccaacaaaaacttcagttagctaatttttctatttccatgcttaataatctccctctgattgtgggggaaagcatggatatatctaatgaaatatagtaaatccaacagactttaagaagagctaagtctcaatccttccgggtctcaatacccatttcttaaagttatatttctcctcaaagctgccctagaactgggtcacagttttatctagaaagcatagctagattgactccaacacaaagtatcttacattacacttttctttattgtatatggtctacctacttccaaaaggaattgcaggttcctttaaatgacaactttcagttcctggcacttgcaaactgcttaaagtttggctccctgcaacgctccatagagaggagcaggcggatctaattgaatcacagtttgtggttctgctgtactccaaccaacaaatgtagacagaccataatcagtcacatacataattgtgggttctaaaatatcattttgtctaaaaaaaactccaacgaaacatgtaaaaataagattttggataaattaactttgacgacatttgactaacattatctcaaaaataattctacaggaatcattttatgaaaaaaatatacaatccatattggtttaattatgaaattttgactcaacgaaacttaagaaacgagccaacattttactcatggtctctagaggcatctccttattactcaccttgatctctttcgtgccatgttcgacttccagcagctggtgaacttggagaggggtaaaagtctcctgtaggacttggttccatattttcatctatggatatagttttgggtcttttgctgttaaaatatggcaatagttatattaatgggatttctgggaagatgtgtacattttaaagtaaatgatctgagaagatccttactgtgaaaattttcataagcacaagtaataatggtgagtataatggtgagtattgaagatatcaatagtaatagcaaatatttctagttgcatataccatttattagaccatcttatacctaacctgtctaacaaatatggtgttcattatatttatctttcaaatgtatttccaaaaaaaattccactaataaaaagtgaactcttaatgttgtttgccttctaacattaaaattgtgttattgtgtacctgactcattattattatcaatactaacaatgttccttttaatagcacttgtcattgacaatgcaatccaaagataaggtaataaagtaaaacaagagctttggggtcaagacagtcctagtataaaatcttgagtaggccacttatgaattgctaatagtaagctccttaacttatctaaactcagtttaatcatctgtaaattggaaacaataaaacctagttcaaaggcagacggttggaagagtaaaatgagttgttaaatgtaaagcttttagttaagtggctggcatttagaagatacttatcaaatagtaattcttagtaataaccctatcattaataataaaaaattatagtattttactgattataaactatttcatatattattctttactttttcttaaaacttagattattgattctttattcttaaaatcgactgtgaaaaaaagaaggccactgccaaattcaaacttttaaaatgatactttttttttttttttttttttgagactgggtctcactctttcacctacgatgtagtacactgtggctcaatcttggctcacagcaaactccacctcccaggctcaaacaatcctcccacctcagcctcccaagtagcttgaactataggtgcctgtcaccacacccagctgattttagtattttttgtagagatggggttttgctattttgccctggctggtgttgaattcctggactcaagcgatcctcccacttcagcctcccaaagtgctgggattacaggcaggagccactgtgctcagccaaaatgatacattttaatatggaaatatgactcatctcaatgaataagaaaggtgactatccagaacaaagattaagaagctattttatacccatagtggttgatatacttctttcatatgcccccaccaataaagcagacaattatgaaattatgactataaaagtgaattcttttctttttttgtttgtttgtttttgagacagggtctcactctgttgtccaggctggagtgcagttgcatgaccacagctcactgcagcctcaagctcctgggctcaagtgatcctcctaccacagccgcccaaatagttaggatcacacacacatgccaccaagccttgctaattaaaaaaattttttgtagagagggagttgtccaggctggtcttgaactcctaggttcaagtgatcctcctgcctgggcctcccaaagtactgggaatccagctgtgagtcactgtgcccagtgaatattttttctttaattaaaaaaaaaatcttattcacacctatgctggtaaaacctttttaaaaatcttcaaaattcacttttcgcagcaataataaccataatgttataggatttcagcattgaaattgacctcaaaaatcatatacataaaccaatccccttgtttttacaaatggggagacacatttggagagattcagtggactgtccagggcaagttaatggaagcagtcagacataaggtaaggacgtctgacttccgcaagtgtgctctttccactgcactgtgtttccaagcccttgaatcatgtatatgcctgagtacatttgtagatactcatgattaatatttgactcacaattctcagagtattaacgatgtagaagatggcaatttctatccatgctaagcttagtttcttcccaaagaatccaaagttagaccttacattttaactctcttttaaacatattctctcatctatgagtcagcagaaaatctgcctgaaaaacttaaaattggggacaaattacatgcataaggaagtactagagaaatgttttttaaaccttgcttactctgaaagacagtatcttatataaagtagtcaggaagaaagatctgtgttgacaacagtgatttagcagacagaatttaaaaattactgctcacattttaaatttagaaaaatcaaagcatttctaagactttgatatgtcagagactattttaataataaaccaaattatcttgctacacaatttaactatatgaaaatggtttaaccggaactgatataaaattgatcttagtttataaacatacacatgcccagtccataattaattcaaattcaacgaactttcactactgagaatactttagaaaaataaatatacaggtatccttttatttttaaaaagttgacattgtaaaatgagtgttttgctctagaattcatgtatgctcttatatttgattacacatatatttaatgctctaggaatgagatgggtcttgaagatctagctcaaataaaaaaaaattaacacatctgtaatctttattcaccctgactggcaattacaatgagaagatcaggaaaaaaaaaatgagaatgttaacagagaagtaaaaagcaaagagaactctctctagctgacccccaacatagaatggttaaaccaaatctcagggaaggtagtattttcattggtaacagagcgttaattaaattagtcaaaaaacatcaactaattgaagaacttggcaaactgtggtctttaattttaaggctaggtaaatgacacattttattttttatgtttcattatcctaagcttagatgtaatatttgggtaaaagttaccaggaatcagttataaaccagagatcattgccacagcaacatcatttttaaagccatcaaaagattttgttaacttgtagcattttaatatttcctacaacaggacaaaagtcatattaatatattttcctagttacctgtccccctgaaaaagatttttaaaactgctgtgtacaacaattacatttaatttgtaacagccaaataaatttaaccaggaaagattaaaaatctgtgtactaccagcaaaaattatttcccatctctctttacctacctacctatctatctgcctatcatccacctacgaacctatgtgtgtatcacttgagaatatgagcagcccttctttcagtacctgcttggtggagaagacagagacctctgaagattgacccccgagttcatgtcatgatagtatggttggcttgggatttctccaattgggaagttgactccagttccctgggttatgggcgctgaggaataagacaaagaagcactgggaatgacattcgtatttctgacctctattcaaatgtaataatcgagaatctttcatgcctctggtcaaagatagagagaactttcttcaccttaagcctctaatacccaccatacaacctgggtaggacctgaaaacttgctcaccttagcaacgttcaagcttggaaatttgaggcaatcagattataatcactggttaccaatttcccgaatcctattcctcaaccttctttactcactcctttatattagttgacattacatctgtcactctgctagttaaaaatgccttggaggaaacagaatatacgagtcctatcactcagcaacaccaaacaagctgctttgcactacctaggctctcgaaaaccaaatcattgttaaataaataaacagagaaccgtttcacaaaaaaaagcaaaaatcattattcacagcctcccagttaggatatgataataattattaatatcatgacttctaatccactcaaatattaatgttgatattaatgttgataatatagaataataatttttggtttgtaacacaaaggataaatgcttcaggtgatggataccccatttaccctgatgtgattattatgcattgtatgtctttatcaaaatatctcatgatattttgtataattacatctgttcacattttttaaatttaattttagatatcatgaacaaagctgtgaggcagcatattgtgttagaatcagcagagtcttgagagataaatagccttttagtttaaactccctctgtattataagttatgtgccctagtttcctaactgtaaaatgggagtaataataaccggacacataggattattttgaggatgaaatgaaataggtagtgataagagcctagaatcatgcctagtgtataacacgtgctcaaccattgtgagttcccttccttctttgctttctcctccaaacttcttccctggtagactggaatggttagcaaagatgaacagttcaaaaacgtgttaaaagcagaggaagaggtataaatgaacctgttcgctgaaaatttgttcattcaacaaattactgactgtgtccactgctggcaggtgttggctgcaatgtgtacaaaatagtctcatatattgcccttaataaaaatattgggcaacaagctgggtaagtaaaacattcatgcgaaacacataaataccaaaatagatgaaaatgaaactgtccaaattaatgacatgatccaaaactgctgtagaatttcaagggaaaaagaatccaataccagcttgaattgtccaagaagtctgcgaaaagccatagctggcactggactctggagaatgagtaagagattagagggaggtcattctaaacagggactgctgcagaagcaaaatcataggtagagataatgtgcaaagtggagaccaggcaggttggtgtcaaagaactccttaagaatagtttccatttctttacctgtcttaatcagcccttcaaaagctcacacgaaattgtactctggggctttgcaacaaaattctagagcccctgagatgcactctaagcatacgtggtctacttaaactcctcctctctcccatctgcctcaagttgagtataaaattccaaagggattgcagatttttatggaagttttcttacccctcatttttaatgaatattctaaatgtgttcactaccctttgaattgtattttaatattaggcaggctaagattaacttaaaatatttttaagaaagtatgattaggaggtacaagctttatcacagagaagtaaccacggaatacacaatgaacatctccctttctggactaaaaattaaatacatcagtatatacatgactagtaacagctccaaacttctggattatctatcagccttctgatagattgttcatgttatataatacactgtaacatcctttacacagaaaatacttgtatccaatgagtaactaagtgcctgatggcttgaattatttggacagctaaaatgtagctatgtctgttgtggcttgaggcacaccaaaggttaaaaaaatgtgaggtaagaaatcccacagtaaccgcatgttttataatttattattagaaccatgttctatatgacactggaagtggggtacatgctagaaggagtatttcaggggctcaagtgaagtaaacaatctgtctggcttcctatcacagtaatggatacaattcatagacctgagttattaacaggaaacttagaggttccaccttacataaactattttcaatttattaagctcatgcaatatttaggcaaagatttatagtttctattgaatacatatggctccatagttaacataatttgcttacccataaataaactagatgtaatttgtagtaaatgataattttaaaatcttcagaaattgtttttttctaaattttgttccagaaagattattccgcagtgtcaagacagcaataaaaacgacaaatatagcatgttctcactcatacatgggagcttaaaaagttgatctcatcgaaggggttgtcagaggtgggggagggtggggaggtgaggagatgaagagagattggttaatgggtaaaaacatacagttataatagacagaaagaataatttccagtatttgatagcacagcagggtggctacagttaacaacaatatattacatattttaaaatagcaaaaaaagaagatttgaaacattcccaacatgaagaaatgataaatgtttgagatgacagatatcctaaatagcctgatttaatcattatacactgtatgcatggatccagagatcacatggattccataaatatgtacacatattatgttttaattttgtaaagatagcaataaaataatttgtctacggatttatgcatgagcactgtaaaaatttagtatgcattctgacactaaatgggagatacagaaaggaaagtagattaacaaacacggccaaagtactaaaacaacacacatggaaattatttaatgacagagtgtgtgggaacagcaagtctcagtcagatattcctgcttaagagcctctggaagaacttacatcagacgcaaagatcagtgttagcgcctctcccagggagctacaagaaggctgaaagctgcaaatcatgtttaagaggatgccgatatcctcttagaaatgaagcaccaaagaacctcagattctaagggttagaggccaacctttaatctcccttattgttctcctcactccaaaagctgatcctaaatcaacttttaagatggagataatatcattcaaaagagagatcactatcctaatgctgaatggcttcattagctaaagtcaacatacacatcagtgggtcttatgattgtaaaaccctagaggactgaaagcactagcatactgtaaaccctcaagaagtcagaatttgtgatacacacatagtgttgtgctgaagtttatgtttacttagcaaacccctatttcataaataatgaagtttaattgtgtaaacaaagattatgatgcggatatattaaaacacttaggaggagaacttatcaggcctttcagagacacctatttacatatggaggagaaaataaatgtttgctgaataaattacgtaatgaatatagataattaatgtgctaattacaaatcagtaatgtttgttataacaaataacctaaaagtttctaggatatgacattataagttaagaatgaatgaatgaagtatattaaatttaccttggttttgaactgttctagaaagataattttcatctttgttttaatgtttgaaattcagatttttcaaaatatctatctgggcttttgaaggttctaatgtggttctcctttgacagcccttagcataatattacctatcatgaggtactaaataaatattttctgacagctgactctactgccctactcctaagaaggatgaaaatataccattgaacttgaactcagagaagtacaaatttaagcaaataatttaataagcctcctaactggagcaccataagcctttccgctaaagaagagtatggggaagacacacacaccccttcagataacccctgtcttacctgatgctacaaagtgctactggtaagtcaggcatatttcttcccaaattaaaagtgaaaactttcaaatgttggatacctttggatatcacatattgatctggaaaaacacattaaggtacactgccttggacaatctccttgcccatcgaatacacaccctggggctaccagaatacaggatatttgtgtttcttctcctacactgccaccatgtaaaaagacccatgagagaagtcttttgggcatacatttatccactctagaattataccagaaaggataaactacttaagatcttaaacgttcatatgtatcactccctgctatacatgctatttgcactgttcactttagaaatgtgagctatttgaggaactacggttcaaaagacagtcagtgatagcgtgaagattcctttactgaacaacaagactctaaaacactgcttattcttatcctcagtaactcgattactctttgttctttctggatcatcataattcttattcatgacctctaaatatgacccaaatgagaaacacaacttaggcaggtatcagagtgtgactacatcatctgaataacatcactccgaagtgtgatgcattctatcaaaatgtcaggtgaaaatatacccttcaaagttacataaataagctaaatcagtgaagggagtatgaagaaaggagtcaccttctttaacataattagtacatatagatctgcatcttggatatgtttgtacatgctagtaataagtaaaagagttaatcaaggtaacgtcccctttgcttaggtagcctgccaggtgagcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtgcatctccaacccccaccaaaatgttagtaaaatgaaaaagcacttatctacaggaaacttatgtgggttatcataacaacatagagtacatttaattaatcacacttcctttgatataaatggccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaaattttcctaatatgtggtcactctttatactacatttaaggttcaaaatataaagtattttaaatcatactgcatgcttaagtagtaacaaaacaatttacttacttctggatactcttacaagttctgatacattgaagactccagattttacaaaactatcctcaaggtaacctgaaaataaatattaaaggaaaaatgatcaatataagcagaaagtaaaataaatgattatacactagaatttaagtgttttaaagccaatggtttgaacaaaaaccaaatatgcttacaataaggactttaaaaaatgactcttaggaatgcaaattaggtttgtttaaacaaaaataaaaagtttagataccaaataatctcttaggaaaattttttcttccctttctaaaagtacaggtttattgatgcggtttgatttgccatggcccatgcatacagaatggtctgtgggctctcagtgaatgcttttgactcggtagcacctggtagactaaagcgaaaaatgaaagaaagaaaaaggaaaccacaaccacaattagcaccttgctggaataatgtcaaagatctcttaaagccaccgttcttttgtaaacccttctctgatgaaagaaaagtgaactgctgttaccagcaccccgacccttgttccagggtcactaataacataaaaagcagaacttgtatatacagcaaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcatctatgttaagggggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaaggaattagatgcagttcagagatgtgaagcatgggtagtgcagcaacatggagcactgaaatcaaagagctgggatttgaatcctagccacagatgaccagttatgaaatcttggctaggttattagtcctctttttgcctcagattcctcacttaacaaattggagacaataaaaatcacctatcttatagagttgttactactggagataaaaatataaaccccatgataagcatgttaccaacaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccacccaccttctttagaaacagaatgaaagaaggagtgagaggaagttgtaagatctcagtagggaataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaagatttttgttgcttttgttattgtttatagttcattatactttattttatatagggtaaacttaataaagtaaatatattaagtacaaaaccttctttatcttgggaggccgaggtgggtggatcacaagatcaggagtttgagaccagcctggccaatatggtgaaaccccatctccactaaaaatacaaaaattagccgggcatggtggcgggcacctgtagtctcagctactcgggaggccgaggcaggagaatcacttgaacccggaaggcagaggttgtagtgagccgagatggagccattgcattccagtctgggcgacagaacaagactccatctcaaaaaaaaaaaaaaaacaaaacaaaacaaaaaaacaaaacaacctcctttatcatgactacagctcatatacttaaccagtcacacaagattatttttcatcacccaattgtactttgtaaatgcctacccttcatatcttcctcctgcagctccctgagatgagatggccctctttctacacactctagtctcatccttcaaaatccagcccaaccaccacccactctgtaaactgctcctccaactccttctaccacccactggcccagccagaaatctccttcctctgtacttgtatagcacctagtttgtactaattttatactttgtactttcagattttctgagagatctgttttcaagtcttgcagtcattgctggattatcagatcctttatttacagaagtgactgggttttgttcatctctatatcttccttaatgactaactcgttgcctatatatagagtaagtactaaataaacacagaacaaaattttaaaattcaactttacaaacagggtcacacattaacatcttagtcattttattacaatgtagatacagatggtttaagatttatggataattatactaacctctgttattccctagaacttgtttgctgaagagtgtatttaggcttttgggtcacatgagaaagagtaatgattagggtcggattgtatctcttactttgttgtgtactaatgtgtaatgtcaagcatttaatacaaagtaacaaccaaagaactggaagtgtttaaatagtaagagcccaaaaatatttgtgaaacacatcgatgaataagtgatgaacatttcaatgtatttacataaactatatcagaggtaatacaaaataacattacaatatctatgtgtaatctgaagttcatttccttattactccaatgagaagtcagagatccatctgctcctaagtcatgaccattaagatggagtggggtgtgagcctgttggaagccaaatcatgaagaagggatgagtcagctcaaggccaattctaccagtgggaagacagtcaggcagtcaaacacagacaatacaatgactattgcagctattcacagaaaaaaagaagacaattcagaatgtagcagggtgtttctccactccccacccccaacttcccaggttctaagaaattggaatctacggaaacaatggaaagaggtagtttaccgaaaccatgaaaagcattggaaatatatcagaacttctttggaacctactggataaaatgcaaaaaaccacagaggtcccactgggctctactcctgcatggagcccagtgagactttagtggaggaaggtttcctgaggatgagtgatgatgcctattaaccatgtacctatgggaacagggacaggtgagaatcagccaagtggggtagcctgggagaagcaccggaagcagatggctgccaccttcatgcatctctgcaggcagcatagcctttgtaacggacaggcattaaccaagacgtggcagagtgaaaaagaaatcatggatgaaatagtactcagatacttaaaatagtacttggatacctactagtgcttactcattagcatacagaagacaatacttgagggctgtagcaaaataactgagaggattttgaaatgggcaggggtcctgcagtaggatagggggtgaaactcagcaaaatgtcaggttatctgctgctaacataaccccatctgtaacctccaaggtccttgggcctttcaggaacatgtttttcacatttcatagaccactgtaaatctaaatagctaatacaacagctaaagatcttaaagcaatttggagacattcatatagtaaattcccttcgtctaccaaaggaaatatgagcatctctgaggcagagcagctgcttaatggttacagagcaatattacacaacagcttaatccaggaagaaaagaacaactctgcatttgtgtgatgctgtatttacactacatgtgtgctttttaaaaaaaataaaattgagtaggaaataaagacttctacaaactgaaaagtctcaaaggcaatatcaaattatattattttacttcttttttatttttctctgacaaaagcaacagtaaatcactactcagaagttaatatactgtttaacctcctttacaaacaataacagagggacacaatggcatatctaactgttaatatctcaaattataatcagtaccatttgaatgttaaacaacatttacatagaaaatccaaaggaagactgataatgctcatttttacagtctactgtgttctattcttgaaattaaaaaaaaagaagccacagaaagcagttattaaattcatgaaagccgtcttcaagtattcgaaggactattaatgtagatggtggatttgacttattctgcatagttccaggagctgttttttggctcaataaacagatttgtcatccaatgggaacaggcctaaaaaggcatgtgaaattttgcaaaggtagcataaccaatatattcccaacaactgtgatgaccttcacaagcaggcattaacttcacgttcaccattatcttataaaatatgtcatattattggtgttgccattttacagatgaggaaactttcatcttacagagatagtttctcagtggctataaagactcccactggatataaaaattcttgctttgtgaaggaaatctcaaaaaaaaaaaaaaaaaaaacagaaaaaaagaagaaagcatctcaaaagccactgcaacccacagattctcccttcttacacagatgttttcctatgttagttttctggcattgttcatttggagaacaaacaggtggacataagacatctataggcattttccagccctatgattgcaattgttcactttcttcaacagagtttaaaagaaggcttaattctttttgtaaagggacaagaagagattactttatactagctctttgccaatcttcatataacttcagataccacaactaacccattggtaattttctggtagtgatgttacaggacatagttctatcttcagtttctcaactgacttgaactatccatggttaaagctaaacttgtgttgaagttaaagctgaaactgtgattataaaatagaaatattaatcattgcaaagacggtgattttcttcacagagattaaatctcagcctatagcccaggttaacattcaaatattaatttagaattaagtgtatctctcaatatgaaacgtaaacccacgaggatgatttaggtgatcttggagggagtcagaaatttcccaactttaacacgccctgatagcattatatttttttcaatatttccttccagtcctttaaactttttccgcatatatatatatatttatttataaaatcaatatcaaatttaaatatagttgtatccagcttttttcctattaacattgtatctgtccttttagataaagtttttcaaaagcatgatctttatgactatatattgcatggctgtatcatactttatattaaccattccattgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacaatcctgctgccagacttacatattagtagggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgttggctatgaatttatcactgatttttttttctcattatctgaaaaagtactcacttattcctagttttctcagatttttaaaaagttttctgacgagaatggctattgaatattatcaaattcttttttggcattagtagagattctccggtttttttctaacagcatttattggtgttatatattactgaattcgtagatttaattatctttgctcatccatggaagacagttcttaaatttactgttgaactggttggctcagtttcttctaatatttctacaggtagctggaaagcttttatggaaatttttgtattttatttgtcaagtttttataccaggagtatacacatgcttcataaaatggttttgatcattgtcccaatatgttttatgctctggaacaaaacaaaatattatttcataaaaagttattgaatgtttggaaaactttactagtaatatcatcttccttgaatctgttgcagagaagactcttagataactctgaatcgtgaatactattctacttttgctttctaatgttgagataaattttattatatattttccaaaaaaattcaatttttcagatttataaatttattagcaccgttattttacagtttactaagtgggctatgtttatttttatggcataataaaattaaatgtatgccctcttatctttttaatggatgtggaaggtatgcctctctccaacggtgttaaagcatactagctaaaaaggcagccctggggcaagactatcaccatttactatgtaaacctaaggcaagctgtctaactcttctacacctcacatttctcttccctaaaatataggtaataatcatactacctatgagtagatgcaaaaattgcataatcttttcaagtaatagtaaagcagacatctcaagagcaggaaaagaaaaagtagaatttccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatatggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataataaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgactctctaaaaagaccaacaagacagaaaaaccacttccatgcctgattaagggaaaaagagaaagtaaaaatatacaagtatagtcatgaatggcttaatggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgccatatgtaatctgtcttcgactgacctatcatgatgtggtacatgacatacaaatataaaaagaagacataaccatagaaatcaaatacattaaaacaattatgagagaataatacatacaacttattgactacaactttgaaaacttaaatgggcaagtattagtaaactaaaagtaaccaaaattgagcagagaagtgtaaaacctgagtggaccgattatcctagtgtagtggttgccaaatttgctgaacactggaaccatctgggattcttgaaagcagtttatgtttggcttccaaccccagctattctgatttaattgatatggggtgagacctggacatgagaactcttttaaaagttcccccaagtgattcaaatgtacagcaaagtttgggaatcactatgacaccacattcagaatgtggttccagagccactagcactggcataactggggagcttattagaagtgaagaagaataggctctaccccagaccctcagaatcagaatccacagcttaatgagatctgcaggtgattcataagtgtacttaaaaatttgacaatcctagaacatactagaaatgtgagtaagaaccacctttgaaaacagcaccaggtccaggcgagtgcacagctggattttatgtatcctttatctagtctttaggttccaatgttatttacactctcccaggccttaggaaataagacaagcttcctcatgaagaacactttcttataagcctctatgaggccagcaaaacttgaatacctaaatttgtagcctctctcatcgaaacaaaacaatgaaccaaccaatgaaagatcaagcacacaagtaaatgtgacttcaagatgcctaaataaaatatgaaattgaatacagcaatattatcaaaagaacaatacactattataatcagggtttattccatgaatgagtgcagctcactatgagaaaagctatcattacgatagaggaaaaagtcatatgaccatatcaagatgctgaaaatgtacttgacaccaagaggcaggcttacctaataataaatctaagcacaaatagagacaaagcaaataatacagactcttcagcaaaattcaacaataaattattctaaaaggggaacactagtctgtcattcctattttcccaacctccccagcctcctcctctttgcagcccttaaaaatgtaatctggaaaaaagccagtcacaaaaagacaaatactgtataattccacttacatgaactatctagggtagtcaaactcatagaaacaaagtcacatggtggttgccaggggctggggagagtagggaatggagagctgttatttaacaggtattgagtttcagttttgcaagatgaaaagtttctggaggttggttgcacaatgacgtgaatacatttcacactactgtattgtacacttaaaaatggttaagatgacaaatttaatgttacgcgtatttcactaaaatttaaaaatgcagtctaaaattttggacccagattgttaaccacattcttgtttacatatattcaagaacaatcttttacattgacatttatgtctgtcatcttatttataacaattacttggtcataattctcaccttaattgttactattctcatgattagtctctatctatatttttattcatatatttatggttatactttcctgttcttaatttttttattgagtcatcacattgccagtcagaataggtattcaagtaacatttttgcaaataaaatgaggaactctattttttgataccatgagtaataaagaatatatttccattgcctttgactgtaggtgaaactccttgagtgaaaaacaatgttttttccatcacaatttcaagtattctcccactgtctcctgttatttaatgtcgataaaaggaaatctagaagtaacttgtttttcatccaggacatttcaaaattttcttcatccacgaaatgtaaaaatttcaacaggatatatttagatacaagcctctcattatgtggctggaatagcattagtccttttaatccacatagataatttttagctcatcaaatttttctccatttgtctttgatcctacatcctccaatttctccacaatgaacacctaaataaaccttgaattttctattctctcatcatcaacccttttctcatcatcttaacctctgtgtttcctctgcttctggaataagtatcttggggttgtcctctatatcaatgcttttttccacagtatcagtgctgtttcttactcctccgatgcaattttaacgctatgaaagcaatttagtttttcttgatattcttcctcatctcacagaataccgcatttattgaagctattcttttgtaggttcacttttcgtataagtcttctgggtaaacattttctctggaatttttttctagttctttattttcaaagatatgtcctcgtggttcttgatcatatcccatttcccttgttcctccatattttctcaccaagggcatattgttgtgtgtgtgtgtcggggggggggggttcccctttttaacatattcagtaatgtaaactaattggaagagacagaaaacagatcaataagtcatctgaagatgagggtagacgaaacctttgggattagaggaaacgtcatcatccttgagtgtggtactgatttcatgagtatatgcatacgtcagaactggctgggtgtggtggctcatgcctgtaatcccagcactctaggaggccgaggcaggtggatcacttgagtccaggagcttaagaccagcctggacaacatagcgaaaccctacatctactaaaaatacatagcatggtggtacgcgcctctagtgccagctgctcaggaggctgaggcatgagaattgcttgaacctgggaggcaggggttgcaatgagccaagatcacaccactgcactccagaccgggcaacagagtgagatgctgtctcaacaaaacaaaacaaacaaacacatatgtcaaaactcatctaactgtacactatatatatgcaacttattgtatgctattatacctcaataaagttagcaagtgacctataaagagtggtttccaaattttcaaaaagtgctatttccacagcacaaaaagaatcacaagtgaatcagaaacattcagtgtaatcaggaatatttttgaaggtatgaattacaacagtcaggtatttttttgcagcttctagaatgttatcttaccaggttcctcattcatggtcaagtgaactctaagaacactgtagtatactccctagtaaacaaaagcacaaaagcagcaaacaggacttctctataatttgtcaaactgggagaagagaaactctatccacctgagattagtattctgaatcagcaattatattggagtgctacaattctcagtcagatacctctctacaaaattcatcatcagtatgctacataagatgaggagttcagaaaaatattccaaataatcatgtctaggatgtggtatacctacagggcataagaggatcactgtaagtatctccgcagaagtacccgctttttctaggcctaggtcaggttctgagtaagggaatgatcccacacactgcaagaacaggttatttatttagtctattattggtctaagcctctgcttcataaatcttggacattgtctgtaggtaggcattgccttggatgataggtatacaaaaaagaagaatgcaatactcacccaaaggggctcagaattcattaaggggagtagatgcgaaaatagagataaaatagtgcactaaatgctagtactgtaaaacagcactgcagagaggctctgaagaagtctcactgaggaggtgacaagggagtacaagcattctaggcagagaaacaacatgagcaaagatacaaagaagcagcacacggctaacgctaaaggcatagtccatgtgtgcaacggacaaatcatgaagggtcatattgtatgtcatgctaacgagctaggcttaggctagagtggagaccttggaaccatacaaggaggtgaatgaaataatcagatttgcacatcaccacagacctgtaatggatatatcagagggattaagacatgaggcaaaatatcgctacagagattaggaaatgattaaaatgatctaggtgagctagttaaagaggcaaagtgtaaaggtttttaaagagttattaagattcagcatcaattaccttctttttaaaacattttgcccctctcatcagcagcctgagcctttgtattcattcctctgttctttctacattctttctcccaaaagctcacaagtactcccttcttcacccatcaacattatataaggtaacattattcatgtgggctatttttggatatcaatttggacatggtaagcataaaatagcagaatactttatcatgtcccaacagacatgatcatcttctagttctatcttacttatttagaaaatactgctctgcttagaaagtacttcaattcagaaaatgacagcagtccaaaataccaaattttaaaatgaaaaatccattgcattgaaaacattactgcaaaatacacaatggagccagcatcttaccattcatcatgtcactgtttgtttcatgacattaacaagtggaagtgatgattttaataagatcaaatctgaaagtcaagtggttttcctgtcttcttcctgctgaatactgcaggaacacacatacatgcaaggtatagagcactgcgcaaggggaagatatgtctagtggaatcaggaattaaaatatctcagcaaaaacaggagtttggtatgaaagatgccaaggtccctaaagagcagaatgtaagtcaaaagaccccaaaaagatttgtaacaactttgaaaaccaaaacctgaccattgtttcttaaattcttctatgatcaatgacattatcaagcaaaagctaataagagtcagctgggtgtggtggttcacgcctgtaatcccagcacttgaggaggccagggtgggcggatcacatgaggtcaggagttcaagaccagcctggccaacatggcgaaaccccacttctcctaaaaatacaaaaattagccggacacggcccatgcctgtagtcccagctactcaggaggctgaggcaggagaattgcttgaacctgggaggcaaaagttgcagtgagctgagatcatgtcactgcactccagcctgggcaacagagcaagactccttctcaaacaaacaaacaacagtcaaattaacacacaaaagtccttgcttaaattattcattacctagatacgctttcatagtcacggagaaggaaagaaaaactgagactttagtaggagatttgtccaagatctttaaatcacatcctttaatcctataaggtagaaaaagattaaaactcctcgggtaattagacacatatctacttaatattttattctgtttgcaatatattactatagaattgtactctctttttaaacattatgcttaaatatacaagtgagagttgccttagtgcctggacagtttagtccagcgagcttaacttctgcaaagttcagtgattttaacaagcctagagcaagtccactatatttgtgatacaaaacaatcccagctttccgtctgtgaggcagaaaatgctttgcattattaaattgtagctgtatgtggcaaaagcagatcttgtaaatatggagagggaaagaatttaaactgagaggaaactttggatgcaggaggccaccgtagaaggaacctgaggccaggcatggtggctcatgcttataatcccaacactttgggaggctgaggtgggaggatcacttcagcccaggagctggggaccagcctaggcaacatagcaaggctctgtctctacaaaaaaattaaaaattagctgggcatggtggcacatgcctgttgtcccagctacttgagaggcttgaggtgggaagattgtttgaacccaggaggcaggctgcagtgagccatgactatgccactgcactccagcctgggcaacaaggcaagaccccatctcggggagagggggagttacatgagatacttgggtaaaagccatcactacaacactgcccagaacagcaggtaccatcacaacctcacctagaggaatttatgactcagacgtcttttcacatgaggattctgaccctcccttaaggggaacctagacattcaactaagaaaaatataggttatagcaatagcctttaaaatttagcaaattacaagctatttctgtgcaagccctcttggaagttttctggaactaggtacagtattaattaagtgcctacatcaatatattaaaattttacttggattctatgttaccttatgacaccatttcagataacacgagaccttaaaataccgttgtaaagttaaggaaagtttgaactaactgtagcccatgaacgagtcctttctctgacagcattgtgaaaggagagtactgtgttgaaattaactcttctccccattctttctttctctgacctgtatattaacacaagtcatgaaacacaaatctgacttgctgaaaaacccctgatgactcactacttatgaacctatattctatgtcacggctttaaatgctgctcaagccttgctcagacaccaagttcccttcctttccccttcttccatgtgaaatgctctttcctcggctaggactatatccaccctacaacctcttgttcatccttttatccaaactgttccatgcatcttatattccctgggaaggggtagacatctctgactccactatgactgctcctttaaatataaacttgtgtgcacacatctcttgcccagtaggcagtcacattttttaaaggtttttcctcaatttcaggcaagaaacagtgttcagaggtcaaataagggtaatggtaactgagaggtaaaagtaaattcaagagacctttcaaagtagaatatgaatgaatatgtggaggataaggaagaaaaagggttcctgggaaagaaatcatgagcaactctaaccaagggtatctagataggattctggtgactccaggatatcttaaaaagggaaaaagcaaaaacaaagaaaacaaaaaacccaagtctggtaaaataaaataaatttaactttggaaatgttaaattggagttaaccatgagacatctagggaaacatgtccgaaaagtagttggacacataggtctaaatcattaggagagagaggtatttcaaaggtaaacatctaggagaaaaggttaatatactttaaaaatcgcaaggtactgaaaacacagagaattaaagacaaaaatctgattaagaagacagaagaaatcaccatatgcaatttttaaacataggaaggttcctggattaccaggagaggtcctgttttcagaggcacgggcaaagttttaaacagagcatggccaactaaatcaaataaatattcaggaatatggaagcaagaacaggacagaaagaaaccactggtcatggatttaatgagaatcatttcagtggggacagaagctgagaagaaatcaagatggaatttcaggggaaatcaagatgagactttgacatccttcatgccatgttacgaagaagaagagagagagatgagacacttggttaaaggggtttgtccaaatgaggaacaaaagatgtatgttttaaaataagaaataagttggtaggtaggaatcagtgaaataagaggcagagtaagagggctaggaaaagtaaaggacagacagaagtttcaatagacacagaaagttgatggcttcataaagtagaaacaccatggaaaggaaaggaggggaaaaaaattatacaatgttaatacaagcttctacaagataaattcttggtaggaaaaaagtaatctctaaagatacatttgtaccttttctcatgtcaatactgagatttatgtaacaaaagtcactccacctttccttttatgccaataggcttataacaacatttgctttctaaaaattacaattctatttcatcatgagacttgaaagcatctgtttcttttgcctcctttataaaatctctaacattctattcttatgcatcttctgtaacttcggtatgtcatcttaagcctttagagaagagcagtataaaaattcaacactttttttttttttgagacggagtctcactctgccacccaggctgctgtgcaatgacatggtctcggcccactgcaacctctgcctcccaggttcaagcgattctcctgcctcagcctcccaagtagctgggactacaggcaagtgccaccacacccggctaatttttgtatttttagtagagacggggtttcactatgttggccaggctggtctcaaactcctgaccttgtgatctgcccgcctcagcctatcaaagtgctgggattacaattcaacacatttctatttgattccacatcaaatgatactttctgcaggaagccttcttgatcaaactagctgaagagaaagtagaatgaaaaaacccctcacttttatcaagcacctgctatctgtcaggtgtgctcccctatgtgatcctcacaactggcatgaacataattgactgcacaaagcggttggctgacttgctcattctcctgatgacccttataatcattcaagggaaaattttaattccaaagttcatgctcttttcactccaccatgccacctacaatggtgggaaacagtatttcacaactttgaactcctacaagacctgcatcgtaacactaatatttagtctttatcttaaatataaatacatatgtaatatacatttcatatattataattatgtatatattattttgtagattttatgaacaaaaacatttgggaaaagcaaggttcatgtgtaactcacatttttatcttctccagtatctagccgagtgtgatgcatacaatagatgctcaataaatatctgctggctgaaaaatctacctatagacagctctttctgaattgtttatggttcttggtataaaatggtgtgtattttacacaagggcaaatggctgtctctgcttctaatgttgagctgactcaaatgtagtatttaattgttaactcagcaatcgttaggcaattaatataatttgttatctgatagagtaggtgactggggagacatggaaaaatctccttctctcaggaccttacaagacattcctaaattgtcccctttttttgactctttcacattaagtattacaaataatcaggctagaagcactgtggaggctgggcatggtgccaactgctatgtagatcaacctttcatgagtgggctgtatacaagttcccataatgtaccctgtaaaattatgtagctgagggctatgcgttcttctggctttttaagagtaatttgtgaaagaaacacttccctcatcctctcttcctttactctgaatcctattctaaatttgaacatttaagaactttattgaatgtgacgtctccaaacaagttagaggataaagaagaaaaatgttttaaaacaaaatacattaaaaaaaaagtcctttgattttagcactgacccatacagacctcattctcaaattacttaaaggttttacctacgatgtcaggtcttacctgccattaaccagtcctttcagcatctttctccaaatatttttatgaatagagagcctatttatagtcgaatgcacattgtctagtgccaaagtttaaaatcaccttttaagtatcatgaaatagtgcatttttcctcattaaaaacatcttgatcctaatggacacaataaatgaggacatgagaaggaatagacatgaatttattaagaagtgaatgaggccgggtgcggtggctcatgcctgtaatcccagcactttgggaggctgaggcgggtggatcacgaggttaggagttcaagaccagcctggccaacatggtgaaaccccatctctactaaaaatagaaaaaattagccaggcacggtagcaggcgcctgtaatcccagctactcaggaggctgaggcaggagaattgcttgaacccgggaggcagaggttgcagtgagccgagatcacgccactgcactccatcctgggcgacagagtgagactccatctcaaaaaaaaaaaaaaaaaaagtgaatgaaatatgatttgaaaaagccagagtaaatttctcttttctttgactttgactttgaacaccatattccaagataaaacgtggtatgaggtcctcaaggacctatgcgaatttatctgcctttatgtacagattaaaaagtactaagtttgtcctaaattctaagatctgaaaaatcaagcaaatatcggctctagtgatctcaacagatgaacaaatgacaatgaatactgaagattttgaactagttttcctaataattatttggtttgtttctattagttttatgacaaccttctgttggctttgatttcagtatctataaaataacattggagagagagctatctcaaaatttttatgacttaaagaatttcttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccatgcccggctaatttttttgtatttttagtagagacggggtttcaccatgttagccagaatggtctcgatctcctgacctcgtgatccactcgcctcggcctcccaaagtgctaggattacaggcgtaagacaccacgcccagccagcgacttaaagaatttcttaagtgcaagataagcacatagctatcattaatagataatccttctttgatttactcagttatttatttagtgtcatccttgctccagagaggatataaggtggcttacttgaggtacacccaatatataatcctactggttcccagaggtgttgccacactacatgcataagtcaacacacaaaatagcacaagcacctataaaacctacaaaaaggaaagtagcatgttaagtccatgttattcccggtaagaaagttctgcttaatgatactagaaaggccccaaaagtttatatcataaaatttgcaaaaactgccctagcatttaacatgtcttcgtcatattaccagcagagaattccccacaaaactaccagccttcctgaactccaaaataagacattagtttggaactgacttagaagcaaaaatctgaattctagattgctatgttttccttggattttacccattctaggattagtcaagggattgagattgggaaatcttaaagatcatagtccaaagaatgtagacacacaaaataataaagcaagtcaaagctaatttccaaagattaccatccaatcaatcacacatttcctaaaagtagcagtggagtttttaattattaaaggtaaaaagagattcatgtctaagtcccaaaattaatggtttaccctcatttggtccacaagagttgtttgctataaccaagagaggacatttttagttctattgcttaggagggattaacttgttaaaaaaaaaaaaaaaaaaacaaagaagaagaagtgaatataaatatataacttctgactctatcataaacaaggcaaatgtgtatccctagaaaaatgaagtgcttagcgcttctcagccaaaattgcaatgccatgtccttgggtgctatctgagttgtagagcaccttcactccaaaaagattacggtgcccacccctgccacgtaacaaagaatgcaaacaaaacatttaagtcacaaatcgtttaaagaaataccataaaggctacttaaaagctctataaaataacaaatgacaaaaaattacttaaatattttataaaataatatcaaatattcctttccaaaaatgcgttgcctttgctgcttgtgcttaaatactaattccaacacagaaactcaaagtaagaactaaaggcctatctgtagatgtccatactatagtttgaagagctttagggtcacccttcagaagttctaagtcagtaagaaagtagtctcaaagtcagacattcaagcctgatgctggagaaaagccaagccagaggaggtgttaagtttgtgggtaggcatatgcatctgcacttataggatgatcggatgggattccaccttcaagtcaacagtggggaacagatttcaaagagcctatatctccaaaagggcttgaatttttgccatctcttcccaagctgttggggaataaacacaggaatagacggtagcaatttccatgggttgcacatctcccagtggaaaactaccagtgataagaaagtgttggtattcaaggtgatctttttcaaaagcttagcttgtatttggtataacaattcaagcagcaaagtgatttgattgtttcattgcttgtggtggtagactgaattttctcatacatggatcgtgccttctcaagacacaaaatctcaattttggagatttcatattttggccaaggcaagaatacagagataaaaagagcttcctaaagataaattatgtcctaaaataccaaatatgcttatacttaaaaaagaagcttttaatagaaagtataatttactccagttgactacaaaacaaaaaccttaataagttctagttgttcacatttaaaattagaaaacattttatattctaggtttaatttatttcgaagtattacaaaacaaactcttaagctcataaaaaattctttaataatctctatcattaagtccaaaatagaattccttaataagccttatggttgagttcatagtattataatacacaaggcatattaaagtcaatattttacattctggataattaaataaaattctaattatattccatttaagttgggtataatgtgtattttatattacattctggctctaaaaaaatagaatcaacgtacgatttacatatatacaattttcaactaatcataaaatgtatttatctgtagcatcccagtttcaggacacagtctcaaaaaggtttgagttccaaggaaaatttaaaagggaaaaaaattagaggtgttctaccttggttgtttttgtttgccatgttatatgcaaacagagaaataaagagatgctacatcgaatgcagcaaaaatgaaattttaaccaagcttcttgacaaatattgaaaaattgaatgatgttacataactattcaaggattatttattcagctcaagtagagaacagttttaggtgagtataattccttctgtacatgttcagaaatgaacttcaaacaataactgctttattagtttcaaatcaagctttcattcaaatgcagaaaacatatccgttgtttagtccgacttataatagctatcaactctttttctaccaaaggttcccctcttctcccacctcattctttgtaagatgagtaaggagacttttaaaaaatgtttggataaaattcattttgtctatcatgcaacacagggaaaatatcagttaattaaaaagaaaaaaatctttgtaaagttaaaagaccctataagttaatgaaatattctgaacttctgaaaatttttgacaaaatttattatattctaagtagcctttttggaaagataactaaaataatatcaatcctccattcacacacaacaaaataaaataaatttaactgggaattacattttaaattattctgtttttaatgttttgctctcaatgtacagtaatatttaaatgatttatgaagaaaatgaaaaatcaacttagcatacatttttaaacctgtgtttaattagaactttttatctttgaagtgtatactacttttgtcaacaatatgattttgtacaatacagaattaataaatatttggaaaaagataatttttctgaaataaaaaaacataggactcagaaaaatatagtctgttttgattttgcatttttacttgtatatctacttgctgtatctttctaaaatcattttaagacaaaattggtctgataaactttcttgcaattttggtgttcttctggtatttcagcctcatattagctaagcacgacttcaaggaagatcaaacgatggaggacctaaaaactaagtctacctgaggaaacttttcctattacttcatataaactttctggtttattttcaacgaaaggacagatgagattgtttggggaggtggggggcatgtgtagctggttcggggtttttgtgtttggttttgtttttgttagtttattcttagagcactcttttactaaagtcaccaatataattcacattcttttaataatgaaaaactgcttgtgctagttttatctcatgagaaaaaacactgttcctaaatcaaaagcaaaatgttgtatgttcagagctatatgaagacagccaagttataaaagcccattttcagatctggaacaacttctgaaaacaaagagggtatttgggataccttatgctaaagaaaaaaaaaatcctgctttcattatttcctgattctggagatccaataaaaactttatggaataaaaagtcttgcaaaaatccttcagtgaaaacacaaccaaccactcccacccccaacccccttctaaagtaatgagagttgataaactataattgcagtatggaaatttttacattttcttatgagttttaaaagaaagattaaaaggttcattggcttttcaaacagcaattattttagcacctaaaagatacacaactaaaatatatgcgtatttattttcaaagaaacaccaacaaaaattaaaacattggtgattaggtaaatactgatgacgccaatataaaagtatttgccactgcaaagggcctaagcacaatcacatcttgtcccgatcatacctgcctgccagaacaaaataggcagctgaccaattatggggtgtttatctatacagtggtacctttgttctccaacaatgtcagattgcaaatgtcctggaacacatatttacctggaggattcttggcaggatcattgtggcttggacttcctgattgtccagaatctgtaaagaaatcacagaaaatgttttctttttaatttgttttgaaagaatttcacaatcctcaaaggactcgaaaaaaaaatttgaaggtataaaaatgaagttgagtgcttaaataaaatacactttcccaagacttttgatagaaacattttactcatcaaactacatgaatgcatatacatatttctatgtcaaaagaaaaacacaagtattgatctataattttcttgggctagagcaaggtttttttgaaacaaaagatctggctacaaagccattgaagatggtttgaaggttaggcaaatattgaggcctgtcagtagcaatatgaaataaagcagatatattctcttaaaaatgcaatctaagtgtaattaaacgtgcatttaaaagcctgaaagtatgtttttattcaatgagtaaaatacacagaaatgagagtccgcttttccatgatttcacacacaagtacacatacccactccaataatctcccaacctactggatccaggcccagatttatctacatcccataatagcaatcgatttgcaaacagcaaggaaagcataaattactaggtagaaaccaacatggctttgtggagagcaaatggttgaatcaatttaatttccatccatgacagatggacagactttgcaggtaaggaggaagagatcaatgtcgtatatctgaatttcctaccccatactattcctcattgatgctacagaaagaaacgtggaagacatacaactgttaggcaacatgccctttcggactgatctgacactgttgtgttttgctcactcctcttccctccttgtaccctctccatttatctgtgtcatttgccccatattattatacacttacttgcgagttgctttgtaatcttcttttattggttctagcatttaagttttgtcgccccaactaaattgcatactcctaagcagaggcagagattctgtctacttcttttgtgtcctcctcagtgtgctgttcatggctgtgaatgcactaggcttgcagtaaacgccggaggaatggatggctcagctccagcagcctctttgcttgcctagaaaaggcaattttgaacttgataatgaatttcaacaaaatttgataggtggggcacaaatgacggctctgtcatgtactgccatatactgacaagtctcttcccccaaaccttgccattatacttgagccaagaaagtgatttggttaagcaggaaaatcatatgctggtttttttcatcggggttattctgtccttccaggtaagtgattaacatactgaaattgctgcttctactattaaatgcaagaacatcctgttagtttcttctcatataaaacctggttatttatttctgccctttgcctcatgcctgttagcttagatttaatgctgaaatcagaattttaccccttcatcccatttccttaattgtctttttggttttattctagaacagatttcatgagatcttggcaggcatatttagtgattcccacattttcctccaattgtttcctgatttttcaaaatgaaagtaaagaaactagaaatgaccattcttcatctggctcgagtctcctgaagacagtcagagagctgagaactctctgaaaatctctctcatctcccatgaagtcctcttattactttttctgaaatcaaggcaagattcagtgacttataaattaggagatcaatcttcttcgttctacattcctttaaaaaactggtacaatatgggccactttccaggcctggagtatgatagctacataaaaatgataaatcataactttttgctatagcatcagctatttttaccttgagttcctctgacaaatgtctctcagcattgatattacattccagtttaatttctcaagcgattctaacattttttaggaattcctacttatgtataatacacccactgaccagagcctccctatgttttactttccctccaaagctatctcactcttatgaaggtctagacatgcacccctcaaggtggctaatgccaagcttgtgatgacacctgagatagttaaagttgtcaattgttgcagcagtcgccttatttcaggagttgtagactctgcatgagccttagcatgtttagttacagcaacttcaaaatggtgccgcaaaactcttttccatcatctgttgctaaaatttgggtccagcagagaaaagaatgaaaagtctcttccattcgtaagaaactatccagctagaacaatggcatcccctgttaccacaacatcccacttgggaaactctattcttttctgctataaattactttttcttctcatttccaacaactgcagaccaacttcttcgattgaaaaaatatacttactaaaaaaaccacaagcatttgagggaaagctgaagtagaccctaaatttgaggcacacattggctttttgtaacaattccactttctaaaatgatctggtgtttactggcacacaatgacagactccttcatatgccaaagcccataccttctcatgaaataaagcagtgtatactgtgtctcagaaacataggagagggccctctcagtgagcaaatgatagagcatttacttttcagactgtaaattctaacactataatctactcttaactcttatgtcaccttatatcggtcacttaattccaactgctggaaaaggaagtaaccagggagtcgtggttggcagagaaaccaaaaatgaactgttattgtggttgacttcagagaaggaattattcagaccacatctaaaccccttccaattcaccacctaggtcaaattactctatacccaaaggttttatttaaccacttccatcactttgctcaacaccccccacctctctctctctctctctctctctctgtgtgtgtgtgtgtgtgtgtgtgtgtgtgtgtgtgtgtgtgtgtgtgtgtatttaatatgttacagtgaagcctggctctgtccctcactagtgacatgatcttgtacaaaattacttactcttaagagtcttggtgtctggatcttgaaaactgcaataatattatctaccttgtaaaatcattgcaagattctatcacattaagcaccaaaagcattgggtcagacacagtctacattatcagtaaataaaagatattaatattaagcatagagccacatttaaaatgattaatatatttaatggtttaaacatattaaaatgaaaaaattaatcatttttaatgtggctctatgcttaataacaactaacttttaggaagaaagggagaaaagggacataactaagttctgtccatcccaacacacgcatctgaaaatgactggtgggatgactaagcatggagaagtgtgtgcctacctgagaaatcctgtgtaaatgctttcacccctcattccccaaaagggaggagtccactgctcttcaaggctcttagcagctgtcatgctcaaaaggcagtagataccagccagttgatgaaaattaccttccagaaggctgaagtctttgaggaacaaggctgctaagagttgtgagctgcccagcatactgggtctggtgtctgggaaaaaaaattttttttttttttttgagacagagtcttgctctgtcacccaggctagagtgcagtagcactatcacagctcactgaagcctccacctcctgggttcaagccattcttgtgcttcagcctcccgagtagctaggactacaggcgcacaccaccacacccagctagtttttgtattttttggtagagacggggtttcaccatgttggtcaggctggtcttgaactcctggcctgaagcgatccgcctacctcggcctcccaaagtgctgggattacaggtgtgagccaccacacccagtttagtgtctggaaagattttgatgcagtagagaaaaagagaggagtttttggaggcagccaaccaaaaccagtcctccctcattctcttccacctctcattttatcttcctcgatctcaatctctattttccccattctttaagtgtgggtttcatgttccccattctttaagtgtgggttaaacatatgtttattcttctaaaaaaaaagtaatgaagttatttctaaattactatattttaaactcaatcagttccttcttctccaggttaaagattctccaggaacaagaaaaggttcacattcatgcacgacccttaccaacttttcaatcctttcgtccactccttttttaaaagcggtcaatctctcgtggctcttctaatatctaagcttacctaaggagtgagcagtttttcctatgacccaattttatggaagatcctaggacacataagtgatcaaacggcttgtccaaagttgcatagcaactattaaaacttatgttctctatatggacagcctattcagacacaatacttcttgaatcgttatgatgcaatcctaaaataatgcgaagctaaatgatttttcagtagtttaaatgtttctgggaaacttaccttcccctaacctccctcacccttcccaccattcaccaatacattcaaaatctttttcagaatctttttttaaacctttagctattttctatatctaagttggaagcaattattagtatcactgaactctatatactaattgacgttttaaagagaggccaattctataaatcaaatttgtctccattaagcaaaggaaattctaatgttttatggacaatctggtggaagctctgtaagatgtgtgttaaatatatatgacaataaataagtaatagcctgtaaagtatttcttactgagcactaactttctggagtagatacactgcaactatctgaggtagataaatcatcaaaactgtcaaattttttttgtaggtcattaatgtaaacatcatttaaatgtaaatcaattaagatttatgctcacgcctgtaaatcccagcacttttggaggctgaggcaggcagattacttgaggccaggagtttgagaccagcctggccaacgtggtgaaaccccgtctctaccaaaaaatacaaaaaagtagccaggtgcggtggcacacacctgtaatcccagctacttgagaggctgagacatgagaatcacttggacctgggaggtggaggttgcagtgagccaagatcggctcatgtattccaaacacctggtaatgtttggaacacagtaggtgctctgtaatgcttattaaatttatatttaatttacaataatgacctttaaatattgttttaaaaaaagtatactctatgccatgtagaagctcagaggctgcctgaagagacagaaatatacaaataaaaaaatacataaatcaagaggggacagatgattcttcctaggaaaggtgggcaagggcatatcataaaagatatcaaaagaaggtgaccttaggaacaatgccgtgaaaaaacgacctgatttcccacctttctaagacatatttcactcttttaccaagaagatctttataagacccaaaactgattaagctaaacatctgctaaaacctttacatatattctgaaaatagtatgccattcatggcaccttgatctggtccccatcagcacctgggtcatactttagcctttggactccttgtgtgtctcctgcatttgatgtctccaagtctgtgcataatgttcccccttttttctccctgaagtcccccagggtgaggtcatcccctttacatcctcaacaatatgacacgaagtctattattgccctatttagccttatagccctaatctttgggatagggcctggcacatttggttaagtcaaatgaacagaaaaccatcagtctataaactataaaagtgcacaagaaagaaagacaaagcataccgctctgtgtaaaatcatacagtagaagtcaaacagataaatttcttgtggcaagccagggaaacagacacacaattcccagggctaagtctctcagtctaatgtaaggctcaatcctacttcccaacttcctgaagaaatatttggaaacaagatagggtggataagacatactattttgagttagaaattattttttgtccatctcctataaagagaagaaatgtttgttgaaggtccatgtccctactttgcaagcactgaggcaagaaagttttaatgacctttatagataaactttctactcctagatgaaacttcttttaggaactctttttattctctgacaccatggcttgaggatcaacagaaaaagacaactggaaaagcataattttaatttataatgagtttggtgcaaagaaggagctgtacaaggtgagttttcaggtcccctgtggctctaaaattctatgattccataacaatatagcttttatatcaagggatatcagaggagtaaatgaaacccacaatgtaacctgttaacctacagatagcctcttgctagaactaaacttagtcatcctgtgataaagggcccttttgtcatagttctttgccttaagcaggtgaagaaatagcccattgtcaatgaaagaataccatgagattttttttaaggctcagaacagtctctttctttctctctaaaacattattaattgataatataataaaacagtatatttttacaattaaatatatagcatgccagaaacaagacgtaacaggtaagaaacaaaagcttgacggaaggaatacaaatgcatgtattttatagtagggaaataaaaaggtaaaacaaaaacatctatattattaagggtaatggagagcaaactattctccttgggccaaaccttcttctctcttcccctctctctgcccaaagttttctacctcactctttgcagtttactgtctcccatgactgattccttgggatttacagaacactagctttccataatcaagtttcctattacataatttggcttttttttttccagcacagttaaaacaccaggcagcttcagttttaatggaaggttgcttcattgctttgggtgacacaaaattatagttctacattattttattttctctctattagatgtgtattaaaataagacaacgaaagaacatgggaaaactgagtgttttccttgcctctcataagcatgtaaatgtttgggaaatggtttctctctctctctccctccttcattcttcgctcctgtgtgtgtgtgtgtgtgtgtatgtgtgtgtgtgtgtgtgtgtgtgtgtgtgtgtgtgtgtgtgtgtgcctgtgtctccctttatctcctgtctctctctgcttctgtctctctgtctcttttcaatagggcattaaattatttggagtccacttcactgcaaaacttaacttaacaagctgttcatgaaaagttttaactttatcactttgttaatggaatccctgatcttgtttgttgtttgtttgtttgtttttttagtgaatccgtactcctcctaaacccagttctgagcaataagagaaattagacctctctgaatattttggcagaaccaatataatatttgggagatgcagtttcctgcatattttaaactatttactatttcaagtatgaagacctatatcttcagatccctctttctgttgtttaacattgattttaaaatatacgtttgatttagcaaaacgcatagtttaaaaagatgttgctacacttaagatcttcatgataaagtaatttcattaaccaaagaaaactacagaacaagagagtagatatacgatatatcctgtttcattcctgaacatcccagttgttttatcattaagctttcttttaaagagccacttttttgcttaacaaggagattaggtacaaagagtcatatcccaaggattaaaataaggatttgttagcgctcaagactgaaatttgtccacagggaattaactgaaaaaataggccactgaaatttaaggtggaaaaaaaatcatattatcaaaaatcatatatcaaaaaaaatcaaagcaaatcattctaccacaggggactactaatgaatcccctgcaaatatgaaaccctgcacaaaaagtgttaaacctgccaacatctctgaccagagggctgtggtacttcattaagtagtaccaacccaccccccacaacaatgggaagctaggataatcatatctgacctttctgccctaacctaagattaagttcaatgacttcctactgatctagggattgagtgaaccaaaggtcataatcaggatcacctacagttcttgcttttgaaggctttaacctacagaatgcaaaaacaccgtactggtcattgtcaagattgctgactttctacagtgtgttttcaattaagtaaataaaatgtggtaattaaatcaagattgcataatatgtttttgatttgtaatcttatttaaattaattaactgactcaatccttgcttagtttttaaactggtcgagttagggaaagagtccctgggagcaaatccagttttctatctttaaaaacaaggcaaagcaatctggcatacttaaaaatatacattaaatgcaccagcataatataaatacagaggcaagggtgctaatgtagaggagggaagagttttatggcacgattttgactaaaagaaatagctctcgcactagagagaaataaactaaaacattatttattcaaaacatttcttttcgaattttatgaagattgcatatttgttggaagcaaaacatttccagctgtattttaagtttctgaagagggttgtaagatttataatctttcataaatgctgcccatatcttataatattagatgaacacgccactgcgtactttgaggaacaatttgccaacgcagtttgccacatgaaaataataaagtcctttccaaaacccagccagatccagtaggaaaagatgagatgaatgttctttcttttccatctgggagacattttggatttcagctatactatgtaatatacattttttccccttggaaaccaagaaacctgcattttacaacaaggtatgtagtgcaaagaaaatgctggtgaaataagaatctgaaaatgaaaaccagaatgtcatcagactcaagaacataatcatgaaggcaaatcgaaaaatcaatgcagaatttcaacataaaacaaatgcaatgtttatgatcctattagtcttaaatttttctcttaaaaggaaagcatagaaaaataagtgctgttttacctccaaagtcctgaacagcatttatgttactacctagcaccatgacttacatatctggtttatcctggagtcttcacgcattattctaaatcccacacatacaacactcctgtgtacacatggcccctctgtgctatgtcacttcatgtattttcccaacacttaatatatctaggttaaaatcagacataagactttctaatatttcattggcaatctttcttctcagggagcaggacatgttctctccaaactgcctggagagtcaggactctgggctctatccggcaactgccaagcactagcacgctgactctaagcaaaccatttcacgcacgaatcagttttcatcttgcccagtggcaactagttaatgaaaggtaagagtttagtcttagttgttttcaaaggaattagaaatactaggaaaaaaataatttcacacaacagtgaaatatgcacaagtatttttgtggaaaaaggctatgagatatatatatttaatgttctttaaggtttaattagtactcctcctccccctcctaaaaaaaaaaaaatccccacctacttggttgcactgccccttgcaaacgctgacaacacaggtaattgaagggctgggttagagtgcaactcttctgctacattttaaaacccatggggtcaagaaacatgttagtcttattcactgccctagcatattcctggcacatactagatgctcaatcagtatgtgttgaatgactaaccactgttttacagagaacaagatgatgactggtagcagttaaaacagttcatcttccttaaattacaaacaaactgccagtaataccaatcataactttcagtttttgattattatctacacatattctaatttttaagtttctacaacctctctacaaatacaaatgtagtgattgactcaatgaccaaaaagtcatattcttattttttcattgctcattttttcataggcatatgttcctaaaaaattttttaaattggatacagatttctctatcatgttagctaaaaagatactttgccaaatcattaaaatgtttatgtttatatccttatgtgagcttagagagaagaaactggatgggttttttatatcttatgttacttacatgtgattaataaccagtccttgttttattattaaattatggctcttaagtctgtgatactatattcatataaaaataaatgtatacatttaaactcaagatgcatagcaattaactggataacagagtaagatgatgcatagcctactttctacaaaggtaaagtagatttgtacgtggggtattcattactgcttctgttcataaaataactttatcaaaatattagaggaaaaaaatcagataagtcatctgatgaacaggaagcttgctgatgtggcagataatagtattaaatgtcctaacagttccttgataagtggttcaaagaacttctgtccccatgttttcaaggcaaaagttaatataccaggaataaaactacttgaataatgcatcattgaaccaacatttttgaaaagggataaaatgaggaaacaaatgaggagacagtaatttcctcttgcaaattaaaactgtgcaggcaaagaaaggaactcaattatactgataaaataaaaacaaaaaaatagctgacatgattttcctttttgtaaaaagagaaggtcaagaatattctaataagtgaaataatgggtttgaaagaactttgaaaagtttacaagctcacagagacatgaagatggggcattttatggggcaatattctttcaaacagtcacttaaagagaacagtttaaaatacagataatcctggccaggcacggtggcatatgcctttaatcccaacactatgggaggctgaggtgggtggataacctgaggtcaggagttcaagaccagcctggccaacataatgaaattccatctctactaaaaatacaataattagctgggcgtagtggtgggtgcctgtagtcccagctacttgggaggctgaagtgggaggatcacctgaggtcaggagttcgagaccagcctggccaacatggtgaaactccacctctactaaaaatacaataattagctgggcatagcggtgggtgcctatagtcccaactactcgagaggctaaggtgggaggatcatctgagccctggaggttgaggctgcagtgagctgagattacatcactgcactccagcctcggtgacagagtgagcccctatcttgaaaaaaataaacaaaaataaaaaaaatacagataattctaaccaagaataataaagaataacagaagcccaccatgaaatctactactcatcactatggttatttgggaaatgggaaaataaatgatgacgggcatgttcacttgctatatccattttaaaaaagggaactgagagtatactggtgcagagctatgtaccaggtgctcaaaattcctcccattttgtcttgttactcattttatctttaatagagattcaaatcaattccttatgattcaaaaatgcctaagccaaatccaaagagtatgaaaaaatcaaggttctgcataatgtcccatccatatgccttaaccctgaatgatatcaaacctatgtaatcttagacatcaatgccttccagatgtgacaaaattttaacacagaccaacttcaagctttttactgcagactcatctcccatgctcataaagattattttcattgcacgtaccattacatatggctaatgtttaattttccaaattgattattatgctgccatttcaaaactgacattgccttccaatccaatcaaaaaacaaactatgctgcatactcaacctccaacaaacacatacacaaaaacaagaaatcacatcattatttccaagttctagatagtgcttggttacaagaccagttgaacttttccttgtccactcttggtacctccaaaagatggaaaaggggaaggagggatcatccaattctttgtcagagttaattgccataggaataatttgagcctgtcacctgttgtttttggtcttaaagattgcttctaatcagacaagatcaaattcttcttgacatttaaagcatgttaaaattctaaaattaactaacaagattgttcatggatattttgcaaaaccatctaacagcaaggccatgacagaaatgtataaactaaattttcagataggatttaaaaaattagtaactcaacaccagtaagaaaaactggtgtgataaagctttggatgatattatgcaaacttaattcccctgccccaaacaattgctttgaatcttacctaaatctcatccctccacccacccccaaaattagaattgccctgtaacggtaacttgtcctcagatccatcctgaactctgtttctgcaaaccacctttcccagctccattaactattgacttcaggctaggtccaaccaacaggaggcaatggtaggagtttgggaatttggagggtgggaagaaaggagaaggagaggtattccttccctcctctgctttgacatttgtctccaaacagtggtgagttttcctcttgtgattcttgcttccactgaacaagttcctccctctgtgatgccctcccttcaggcagctccagctcaatttgtgtagtagattcctactgatgctaatgactgggtgacctcactgcccattcagcttttcatctattctaacattactgtaactggccttgcccatgaaattcctcctattggactatctggtagtttattttactcaaatctgacagatacatttgtttttttgaatttggcatatctgtcactctaaaatacgtgtcaggtaatagaattaagcagtattagacaaatataataacttttttaaaaaccaatagatttcacgtgtttgttatgattctcatcttttaaaaaaaagatgagaaagcactgccaccattcagtactaagtacaaaattctgtatcccaaagttttttgtaatgcatactgatacataaaaataatcaagtttttaaaaaaggcaactagatgctcaatgccatgttctaaatatatctcttccaggaggtcttctgataatcctacccatccatccaagtttacttcttctttttatcatctcctagtctctctaaccaatttttaacaagttttttcttgtgcatgtgtttttccttcacacatgactgtatgctccttgactggaacaattataagtttgattatttttgtaaaatatgatacatttacttatatttcatgccacaaacaacttcgaaatgcttatcaattgtcggaataactaacagtctcatggggataatcaaaaggttttcttaaatatgcaccactatacatcaacgtaagaataatccctaacaggaaagagaaatgacttcaacattactctgtttcctttaggaaatggttcataagtccccactggacatgaggcattttacataagaaaaattacaaaataagacaaaagtatttttcccatcagaatagtaacactctatagtgttttgctaaaacactctacgaacaggagaaaacaaaaatatttatgttcatacgcacagggatatatatgaactcacagtaccaaaactttagaatcacatatgcaaacagtaccaatatacttaatgttttaaactgtgctagataacagcccggctagaggcaagtgacataacggaaaaacatacagcatcaattcacatgttgccaactttttttggatagaactaacaggatgacactggtgatggatgtgcacacttagctgccagcattgcaccctatgcaatgtccctctacatcctctctctcaatcattttgaacccccacccccaagatttattttatgtctctttttaaaacattattttcctagttggtgacagtcaccaccaaacatcatacagagatcatttcaactgaaaatacatgtttattattttttaagcctgtgcctgaaatgtattttagtcaatctatgccacataaggcaaacttctaatgcacatttatgaatttaattcaataaatatttactgaaaaaagaaaatgggttggagtctaaatagacataaagtggccatgaagtaagtctagcaataactttcactttttatgttttcccaccaccctttactttccccaatgagaaacttatagtgtgacaggtaagctaagagacaatctccataaatatgacagcagacatattgcacagacactaaaaaccataggaataatgctgagaccacaagacagaaatagcccttgactttttctcgtaatggcaggtagaatgggtgggacagggagcctaaagccagataggaaaacgaatccaacttttaaccaaattttttattacacacatactatttgaaacttaaactttcattctaagttacagtcaaaaaagaaaaaagacaataagaagaaataaaaattatcccagttcttccaatgtactgtatatgtatatgctatgatttaagaattatgccataggaatagataattcaattaaagccaagataaaacaaatgagatacattatactaagcagatagcaaattatgatataatttggctgagaaataggttgaaacaggcactatcttagaaatgggatgacagcaaagaactaagctccaccttcaatgtatttgaaggtctgtttggagccaatttacacaaaatatccacttaccaatttcacagaagatagaacaaaataacactgagataacgtattaggaaattattttttaatattggaggtgcactctaccacctcaatccagcacacattctctctctctctctctttcacaaaagagaaagagatcccgtaagcttctccacaatgttctatacctgaccctggaaggaaatcctattcttctaggcttgcttaagccaataaggtccccagagaatgctaactggggtggttatgtgcccaagaattgaactgaaaccattaatttacttcataggaccaatcaactggcaaaagaagttaaaaaaaaacaaaaaacaaaaaacttttggtagaactgacctacagagaatttaaaccgccagagatggcaaggtttgatgttacagcttccttcatccatctgcaaagctctgtcactacctaataaatgcacaatgcttctctctcctgtggtgcttttaggaaataatgcttgtcattttccatcttattgacaaaatattgtattttttagaaaactccatatctaaggaatactttaatgaaataaagatgggttaaaacatcaagctaattttgtgagcacacgaaacagagaaataatctcaaagaaaatgataaattctaatttttatttgaaagtataaagcacatatgagacgacttttattgtgttgccacttcattcttgtttatttaggtttctttattcactgtcgatataaatgactgcagtgaagccaggattgcagaccaaatctgaatttggaagtttggctacagcaatctggatcccaaagccaaagcttcctcctcacattagactcccattcaaagctatcactgtgttttcaaagtgacaacactgttcaactttcttttcacagagcaggaatcttttatggcattaagggtatgtatgtcacaccatgaaaaacacaatgacattgcaaacatagacaaaggaatctagtaagggcattgggaggaaaaagggggtggggtatttaagaaaatgttttttaaacttttttttttgcaaaagaaaatgcataataataaaataataactgaaagttccctattaatatcatccagcaattattaaaaatagaataaattagctgatatgatccaatcacctggtagggaacagcatgtgtctccttagtccattggcagtgctaatggtgctcctaaatgaaggattttttttttctatgttcacgctggttgaacttaattttccgttcacctgtttacctggattagttttcagcttaacattcattaagcatcaagacataacaagaggtgcagtgatgatgagataaaagtctcaaggccattactcctcccatgaggcactcagggaggatctataagtgaaagatagcttcactcgcttgggttaaagtgaaaaaatatgaacccactctagaactttgaaaatcaaagagagctttaaaaagccgtgtgtttatgttttgcctaatttttcactttttctcattagaaggcaaggtctgactaaatgtgggttatttctgatatctcagcttctagtttgcggaagggggttcctgtttaagggagggaatgctgccaccccctactctccccagcagcagcacactggacacctgagaagccaaaagcgctacaccaaaatataccacctttaatcacaaatcaaacaacagtaattaggagcatcaagttaattgtgtctactccccacagaatgtgtcctccaaggctccttgaaatcaggttgaaagattagtagtaattttactcccaattctcttattctaacttaaaaaaaaaaaaaaaaacagagcctaagttcatcactcctaccctcagaactatggagtctacaagtaaaaccttaaaaagaaaaatcagactacttaattaagtgttttcttaggccgtttatgtaatcagagtaactttgatctttggcttcttaatctgttcaaaatttgttgtcaaatcgtatggaattcctttaaatccagaattataaatgttattttccatttgtcttttattaatgattaagacaacttggcagtttgaatccaatcaatcaagaatgtgcaaaatccatttcatatacattggtacaattagatactgacaataaggctctttcttaccttccatttgtactaaatatgataaagatagcaagaataccttagctattttcgaggcattttcatctacattactttgcaatcccgaaataggttgtgctttattctgaccctttacaattaccagaaaggaatgcagagcttgacaacttgcagagtaatagaaaaaccttgatttttcattgcatttccccttctgactttcttaggatctgagggacgacccttaacctttctcagtctcactctcctgtctcaaacaagctataataaaactttattccagtccactggggtattagaacaatgaatctgataggatgtccctaacacactgtactgtgatctctatagggaaagttgctataaaaataaagacactgttgttattcttccaattgagttatttgcaaatggatcttcttgatggagcccagccctccgatatagaaaagaaaattctatcagtcctctagggtacaattgccttgtggcaattatacccataaccacatttccttattactatttataaaagactgtggagttcaaggggaggcaaaaagggagcttaagaaaaaatatgctgtttattttcaacagaagatgctgaagttgcaaatttggaactcaaggctataggtaaactttgacagaacatgtgttccaaattagtgtggtgtttcttagctgtgtcagaaagtcagaggtgtccctgaggctgcagcgctttagcaaattttggaaataacttggggaaaaaaaaggtaaattacacagttaatctggtcctcactctacgaatgctacaaaacaatgacgaaaaggttcacggctagaccattctcaccaagaaagacagcatatctcgaggtacaaaaggcacaaaagaaaattaaactgagcttaggaagaaagtgctatggacaattttacatgaaaagccaaaagggaatgttggggctacgttgaactttcctggagtctacagacagaatacacgttgccccctatattcattaccaacagccataagaattagtaggtggctcaggtttaggcactttaagaattccatattcctcaaatggaattttttcaaagtaaataataaaagctttgctttatgaagtattagagaaatggggtttcccttccataacagaaatcactaggcccatcacactgcacgtctccaaggagcatgattcacagtgtgggctacggggagggagccttctaaagtcgtttcggatgttcactatggcattctacgtgtcattaaaaaagccttataaatcatcctaaaatttagagtttaaacctggaacaattacttggataaagtttcttatgttaacaggtttttaaaagttcaattttcagaaaagtgtttgttgtcagtggagatctgcatataatctagattccaattaaacacagagctccaaaaagaccaattaaaggagaagtagaacagcttgccgtatcatgacaataaatgctacttgccttattgtcatttcacaatcagtgacattcagtccacaaattctagtgagcatcagattcacctgagatgcttgttagaaattcagattcctcgacctcacccgcaatgactgggactcgtacagcaatgctggggccaagaaagcgctctcaacaagcaccccaggtaactcccgcacattgttctcagccagtgtacaagggacttggctgctgatgcttgctcacagacaccaaactggaaagcaaaaggcagtatgtgactatagagtcctgaaaacacaaacaaacaaaaatgcagtccttaagccaaaaccaatctccacttttctccctctccctgccatgtgatgcaccagctttggccaaaaatcacatgtgtacagtgaatcctaaaaagcaactaaatccaaatccacactgaaccattctgaactctatcacacttcacagagctttaaatagaattctactcaaaacatcacaccctgactggccaagggattctttgggttctgttgctttatccaagtgatccaaagtgacccaggttccattctgcaagttcgcttctacagctttttccaagtcgaacacagaaggattaaaaagaaaacacaaatattggcataggtgacttgaggttacttgacctttctgaaggaagattttttggcaattgtgttctggcagctccctggaaggcaaggccaggacacaaagaggaagacaggaagccgggagctggccatgtgtccttggcaggcagtagtgcggcagggtgaaccacctcatccctgccaaaccagaaacagtggggaaagcccagctaattggcaactcacagccggctacagtgtacatcctcggctttagatgcctgataaagttaaatggcctgccagaccctaatctacttaaacaggatcctcctttactttcaaaaacttaactcacccatttgtgtttccttaaggaagtggtaaggcagcatcttagaatgttaagagctggaaaaattaaaaacaaaacagcaaaaaaagtaaagatgtgttggagtctcattatgcttatagccgttttactttgtgaaagggccatgtatgtttgtgcttttggttttagctaataagacttccacttggtcatttatttttatttaaaagaaattctcaagtcaacattgcagactgattatgacttcagttcattggaggatccaggatccattttttttttaatttcacaaaactcctgaagatatccaaggagactgcagagttgcacccagtttccactcagctattgtttttacttacacattagttggctcaatcatatttgctaaggtatttctgtatgtactagcataaaatcaccactttctgagtcttttacagctaaaatagggaatcacgcagggagaacaggagcagaagggattgtccaaataaactgttccttactgctgctgctaacagagtgaatccagggacctggagcctggagcataattttgcccctaggtctgaaggcctggtaagagcaatttaaaggggtgtgctcagtagttgggcatatttccttctattttctgtgaaactgttcatgccttcttcaaaactcaaagcaaaatttcaaattagcttctcctccttaaaatatagtagtcaatggtgaaatttgatgaagaaaatgcaaatttcctctcagaactggtagaagagaaagattacaataaacataatccactgttttcatcagaagtttcttaaagtctacagaatattcatcctttaagcaacccaggaccccagaatctgtttcagtgaagttagaccaaggaataaaacacaataccaaaactcacatactctctgatcacgatgtgagataagaaaataataatcctcatgcccaacactagctctcaggatcggtaagtctaagtatgtgtttcagctccaaaattactattttttttaaaacacgacttgactttcccagactctacttagttgacttttcacactaagtatccctagcttttggaaattctccttcccttttcctttagggcaccactcctttcttaggtccaatcctctatttctgagggctgctttcctgtcttgatggctatctccttctcttctgttggtcccttatatgttggtgatcccaaagacgatccatccaacttggccatcttcttgtctttgtacattccccctcagcaaactcagctaggtccatgtttacaaatactacccgttttttgagaactctgtatctccatatctagccctaacctcttctttaactgcaaaactcctcctgatgttgctagtgcacaacctttgtacactcttgcctccccgcaaccaatccatatctcaattaatggcattcacagccattcagtttcccaagctgaaaatgctcattccagaaaccccaactccccaaagcttcacattcagttgtcagcccagactctatcttcctttcaagcctatttccccatctccatcccaactggtgctaagtcccttattgagcttcacatttttacctcacaatagcctcagcctcctcaggccattatgattcactcttcacactataaccagactccatcctctgcatagccaccaggaatcacaacacttcactccttaaaacaccttggtggcttccaattgctagctaggataatctacaacctccttagtacagcattcaaggtgctccataacctggccccagcctagcctcactctcacagaaaccatcaccctttaccctccccctcacacccacacccaacttcctaatattcttcttaacagtcctagaatatgccgtgcaactgcaggtctgtgcccttgctcataaggtttctatgcctggaatatcccttatttgatgcaagacaaacgcctaattcatctttaaaagctcttgaatttcgtctgttacaaccttcctgaaccttattgccccatctaatgagaccaccctctggggcccacatggtcttgctcacactttagtgcagggcccgaccagtgcattatagttggttgtttatacattacttctctccaagattgtgacctcctgtatcccaacttaccctgaataattttgggaatctatttaaatggcatacaaatttatcttggatgtactatccatgaagaaactgagacaaagagcattaattcccaaaagaaagacaaagtaaccttaaaaaaaaaaagtcataatgagctatcaatttatacaggtaattaacattcaatattctgattgtgacatatacagatgatatttatccattcgtttatttttttgaaaaggactgaacacctacagtggtccatgtatcatccttggaactcagtctacaacagtcaataaaagatgatttgttcttgtcttcatggagcttatggtttcatttgcacaatgttgactttcattcacttgctagcaggtaaaatgtgctctctatacaatttacaaataagcagaatctgtaatcattatattttgaagataaaattgatacttttcacacacacacacacacacacacacacacacacacaaagatttagcagtgggacaaactttttcatttaatttttgtttatagcaactaaaacatgagagactaaaagccacagactgcaaaagcattgtttagctgtgataagcagaatgtgtaaaggtggtatgatggcacaacagctattgcagcatgaaataatgagactataaaataatgagaccacagttttaaaattctccgacttccattatctttcagaatagatgaaaggggtctactgactagttcgggagctgaagagtcaaatactattttaggatgaaaattactttgtggtcacatcccattatagaatattgatggagccacactacatgaaagtctcaaaaggagtactgagagaaaacatcgttaagaattggttttctgctactcaaacccatcctcaagaaaaaacaaaagctaatttaaaaaaatcatcaccaaagcaaagtttctaaatggaatgacataaaaatatcggttctacgtttcttgtcttttagaaaaacgacccatatgtgtagtattttatatggttttctctaacgtatctgagaaatgggtaagcaaatctatgcaaagagatatcatggattgtgatgtcatatttcttatgaaaaaaatcaccttcacaatgtcaattaataccaaatttagctttacaactccatgaactctaccattttttaggttagctgaaaacgatctattgactagctttgtgagctgaacagttgaatgctacttacatagaaaattatttctttcactccataagaataattatcatggcgatcacacaattattacaattacatctgtaagaactgttactgggaatttatctctgaaacagtctcatgccttgcaggggacatttatctttttgaatgatcatcaacacgagtgtctttttgtagctatataagtgatttttacctccttctattaatatcctcttgcatgctttagaagccaaaggagacagcccccacattttttttttcctaaagcaattgtttcagttaagccaggcccatggcatcttttgagacagaaagctaccctttccattcacggcaacataacattcacaatgtgctttcctaaatggatggaaaacccctcaaaaaagcccctcaaatctgtgtttcataaactgtactcttagcaataaagtttattacagacctaaagtatctgcataaacccggttaattgaaaagtgggtggagaaggctgccaaattaaatgtttacattagcacagctgtattgtaaaaacattctgccccctgtgctttgtaattataagatatttctggactgtgtatctctacaaagtttatctccactgccaagagtgtcttggcacggagcgactgcagtttttggcagccaggagctctccgcgcgggcaggatctaaaatggctgccaagcggcctcctgaaatgtcgccggcctgggcccgcctcaccaagggcaaaggccaaccctgctaccaaggcagggtctaaagtctgtctcacaggaagtcaaaatgtgtatttccctcataaataagacttggtaccacaacttttgtgttgcagtagttaaagctgcttgaaaaactaactacaaaggaatattggaatactaccagatagaaaatggtgacaaggggtcttttacgaaattctgctgacctcaacatttcaatcacacataatgcccgcaatattttctgctgattaaagaaactcatttaatttgtggggaaaaaaaaatgttaaaaaaaacctcaacaaattctgaccatattaaaacatactacagagaagcataagcaaagccaacactttcccatttgcaatggcatgattttgacataaacttataatctctatcaaagcatacgtgtatgaaaaatgaaaaccaaaaaattaatttgttttcttctcatcctttaacaggctatgtttgtcttacaacattaaaataacattaacaaaagaaaaccttttcatacctttctatggcacaggcctcaaaatttgaggaatgatctctcttttcccgccgtccactgcccaagatgtggaaaggaaagaaggccaaggggaagaaggtggctccggcccctgctgtcttgaagaagcaggaggccaagaaagtggtcaaccccctgtttgagaaaaggcctaagaattttggcattagacaggacatccagcccaaaagagacctcgcccgctttgtgaaatggccccgctatagcaggttgcagcggcagagagtcatcctctataagcgactgaaaatgcctcctgcgattaaccagttcacccaggacctggaccaccaaacagctactcagctgcttaagctgccccacaagtacagaccagagacaaagcaagagaagaagcagaggctgttggcccgggcggagaagaaagcgccggcaaaggggacctccccactaagaacacctgtccttcaagcaggagttaacaccatcaccaccttggtgtagaataagaaagctcagttggtggtgattgcatacaacatggatcccatcgagctggttgtgttcctgcctgccctgtgtcgtaaaatgggggtcccttactgcaatatcaaggggaagacaagactgggacatctaatccacaggaagacctgcaccactgctgccttcatacaggttaactcagaagacaaaggggctttggttaagctggtggtagctatcagaaccaattacaacgacagagccaatgagatccgtcatcactggggaggcaatgtcctgggtcccaagcctgtggcttacattgccaagctcaaaaggcaaaagctaaagaacttgccaccaaactgggttaaatgtacactgttgagttttctgtacataaaaataatacaaatttcccttcaaaaaacatctgaggaattaactatgtctgtggcataaaactgaaaaaaaccgagatcagatacatagtctctgtgagtgagttccaagggctgaccaaaggaacaaaaattggaaggaagggaggggaggggagggggaaaaaagaagggaggaaggaagggggagggaaagcagggtgggagggagggaaagaagaaaggaaggggaatgaaaacgtgggagggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacagatgcacctggctaatttttttgtatttttggtagagacagggtttcaccatgctgcccaggctggtctcaaactcctgagctcaagcaatcttcctgcctcggcctcgcaaactgctgggattacaggtgtgagccaagcacctggcccttactaacactcttaaaacttgagctaatttctttcctttcatgagattttatggtctgacactgctgacttattaccttttcttccttgagagtttccaaatactaaaacaacaatctgctcaacaaacagaagaattcgataaatgttgattgaccatctagtacctgcaaagagaccctatgctatcatatacagagttatgagattcagacaacatgctttacaaaaaaaaaaaaaaaaaaaaaaaaaacctaagggatggtttcagattttgcctgtgtcttagtttcagtcatgtttggtatatattgccaagtagctatattttatatccccaactagaatacaagtttttggagatcatgctctatgtcttactgactgcacaagacagtgcaacgcatataaaattgtcacctacaaatgaaaggattccagtgaggctaaatggtgattagctgtgtaaaaccccactattccatacattgtatgtgcttacaatgttagcttatcctcctcttagcagcaaatatcttctaggtgaacagtaataaaataatagtaaggctaacagtcattgagtatttgtttacatgtccaatactgttctcaatattacggtatccatagatttcgtccttgcgataacactaagggatgctattattattcccattttcagatgagaaaacttgcctaaggctatccaactaataactgaaaaagccaggaattaaacccaagccaaactgaccccagaatccaaactaaattactgtcttcccaaattagaggtgtcaccactggacagaaaaagagatacagtccaggtagaggttgcacctctgcaattacagggctccttagtcaattttttctaatttttgacacataccttcccaattttcctggcaaaagcctcccttgagtggaggccactgactgtggggagtttatgttgtggtttggtaatgtgtacaaactgggaggaggatgagaccagaaaaccccttttgcccatagcatgccacaaattgaggactaagtcagtgcatgctgctgacaggcaaagggccagctcggcatgagcagctccgtgcagggactgcatgtgacaccagacaccattttcaaagccactaccttcctccttccccacaaacctcttcatctcccaccaaagtcctgaagcttcaccacaggatcaagtaatccccctctaagccacatctcgtaaatgagagtctaatttctcccacgtgtcatttttcacatgaatgttactacggtcttggctgtacttaaccagagttcaaggtctgatggtttatctacagagacaacatgaccacagagaagagcccgtttccattgccacctgaaagacagatccaccaacacaatgttcaccactttctcacacagggctaaatgagactcaaggaaagagcccaaggtcaaacatttccttggttgaatttaggtggtgggttcccatacagagcacagcaccatcagattcacaaggccaaatgcctcagcatgatgacttgaaaagatgacaagctgcacacaatgttcaaaatctaaattcaaaggtcacttcccactccctaaatagttttataccccaaaagtcattttagaatcatctttccacttttattccatatttgtaatctgattttaatgacctcagggtaggccatttttttaaactccagacaggttctaattcatctatacaacaaagcaatacgtggtgttaaaaaaaagactaagagagtaaatcgatacgtgttcagtgtagtggcagtttagattttttttctttcaattggcaatccttccgacatcaaggttaaattgtactaaaaaagaaaaaaattacacctcattccaaatttgctaattcaagaagaactgaattattctcacgtctacttgtggcaaaacaagaaattactttatgtctcaaatgtgagtatgaattacgactaaattcataaaaacagacgtgacttaagtttttattttactactttgaagttgtaatgtgttcattttcctggtatttttacttaaaagagcttttttttttttttccttaaggactcttcacaagtacttttgatagagtggtataaaattatcctattccaatgaccataatatgaaaatcattttgccaaaaaacatcctggaagtttccctcattttaggtacttgggattattctcataaactgaggaccattcaacaatgttttgaagatatacagtattctattcagaggacaaagcatatattcaaaaaaatgcaaaaatattcatcttttctcaaacaactccagtattaaattcatctagacccactgattcactcagtcttttttttaagtttagtttccaatatgatattatttctgccctcatctcttccttgcaacaccccacccataagggaaaagaagaaacagtcagagatgaaagaacaacaaaaatgtacacaaaaatgaaatgttttctgataagtagcatgtcagagtaaacaagttatttttttccactatcactttcttacatgatctacagcaaaattatgttgcctctgtcttatgaatcatcaatacatcacagcccagcctttttcatatatagtgggaaaaatgctgcagattataactactgtttctgacatggagatatttttaattcatttttatgacatgcttatgttcttttcatcactgaataattgctcgtttccaatactaagctggtatttctttaaagttcacgtaattgcactactggtaactttaggatttggaaggaaaaggatcacaatcgataagcaaatgcaatgacgggcactgacaaagactcaacatttattagaaggcaattgctagagaatgtggctttaattgtgcatacatatttttattcattaagatgaataaccaataaaatcccacactatggtgtcccagcctcataacacattaataaagtttcttaaaggttttggcagggggccagcacagtccattaactctttgcaagttgtaaaaagaagtaaagtcatttcagtttgttttgtggttatgaatgaaacagcaggcagcctgtatggaaacgtcactttggatatggtattggtaatggacgctttgctgcgcaatcagaacagtgtggggagaagttaatgcatcctaccacaacccaagcccagacgcactgaaaagctaatttacttaaaagtggagggaaaagagcagaggactacaagtttggaagatctatttattttgctaataggctgtcacactgcctctgggtaaacttgcccactgtgaaacccaaaagtacaggatacattttaaatgactagaactgcttttcctgattatttttttttttcctaaaaaaaacctggttgcttaggcattcacttggtgagggctggatcataaattacaaaaatgctttttatttaatacaagaagcaaaattctatcctttctacgtttttgttttacatacttgaattaagtcatataaataactacaacaattggtagctatgtatttgtctccgactttgcctaacaatttgaattgaagcgctacacatctccccaaagctttacaatgccatctgttctcatttttcatgacactacaaacattttcctttggaaaaaggattctgtattttgcttcctttttagaatgaaaactggaaaacttgaatgaaactaaatatatagagaggcatccaagttgtacgtgtaaagtagtaaatgtagagggtatttaaaacattttttgtggttaagatctctacccttttcatctgttccactctagagataaaagttcttttttactttaagatttttgcaaaaaataattcaaaactttaaaaataacgaaaaatgaacttaaaaagtgattaaaacccttgagtttgagaacaccaaaaaaaacagaattgctttacaaattgtttttggcacttcacttacgaagaaaatacgctaaaatgtaagtatacatacacacatgtgcacactcacacaaacacacacccacacccctccattaatccctaaccaaatataaatagcatcgttagtcaattacttctgatggttaaaaccacaaattggttacaatgatctgtcactttatatggccaaataataaaacttcaagcagaagagatgattactataagtacaatagaaaacatcattcactgttttaatttgttttgaatttttactggaaaaaaacagaaagaaaatttttaactttcaaatgtaaacattcatcactgagtcctaaaaaaacttcccatttcaaatttcatttgtgtcagtgctaatatgtatcaaaatagccgcatctcttgtacactgtggattttctgggaagttactcacctttgattataggaaagtaaaggaaagtctaattaataggttgaaaccgtactgaatttctgcttctctgtatacatgatcatttttgtctctgtttggactgaaagccagatactcaacaatcattccctaaaaatttaaagtattaattacatacatgtatttgtacaatgttaagtatcactgcaacctggaaaaacttgcggtaaaattaaaatttttcatttcaaaacaacagtgctcttagcttaatcctctacaatattgtattcaaaaatagtttttctgtgtgattaacagtaatattacctgggctatttttaaaatctggaattagaattcaattttaaaaactgcactcaaaaaacatcctggattcagatatgaatggacctgggaagtttcttaaaagaaatacattttatcctagatcgatagtaagaaacagcaaggaaatgcacagaaacaggatatagggaatacataaattgggtctacactggttaagaaacaaagttaaaaaaataattctactcactttaaaatgacactgtgctgaaaaataatgagaatagataaaagctttgaccactcccattgtctaccttaaaaaaatactagtatagttactcaaggcacggaactggacaaactgcaatttgaatccagaagacagaatccagagccagggacaaaacaagtcaaaggagttggtgaccagggcaatggccagaagtttacccgtttatatcagattctgtgccatccaccctgcggggccgtctgagctgtgcttccccagctggtgggcccctccacgtcagccctctcgtagactccaaaaggaaatcagagttgaacagtatagcatattgttattaaaagtgatttgagttgtgacatgaatattgtactttcaataaaggaggtatacactttagaaagctcttcagcctctagaaagaatagacatttaaaagattaaagcgtttaaagaatgatctctccactgaccagaatacccacatcaaaataatgtaccactgggttttattggtagctgcaatttagcccatatgaaatggaatatggccttagtgttaatgcaaatacgttgccatttatcataaaataagtgtcatctctaaaggtaactggactttccttaaaaatgaaccattctaacatgaaagaggcataaattaataaatccctgagaaagcctagcctacggctgtaaggaacatctaactgcttaactgggcaaccaaaagactcatacaaataattagaatacttatttccaattgatgaaagcaaaactactccaattcacattaaggttgatgagtcacataaaccactcactgacttaattttacttagaaattgctcatgcacttttgttgctttcctggaaggttatacaaatgattatatactcatttaattattaaactgaatgatctccttaagggcaacattaaacatactaaagtacagtacaccatgtcacaatgtgcttaagtatccctactaaaaataaaaattaaaacaaggttagaaaacaactaacaactaggttaaattcaatccaaaatatagatttgggaatttctaataaaattgtccatattgtttgaatgggttcaccactgagtaatagtgtgaataatttaggtaatcatctcaaaaggttataattcctctgggaaaaaaaaaaaacatgtttaaaactctacacttacaatatttcacataatataattaataaatgtttgctagatgattggatttaagttatatgataaaaaaatactgctcacacttataatgctttaaatgctttacaacttacaaaacactttcacataagccaccttacgctaacaactgtgttaggtagatattactatccccatttcatagataaggaaattgaggctcacagagattaaatgttttacccaaggtcatagccctagtaaattcactgcttagagaataattagcttaagttaagataacagctacttcctgcttccccattccagtctcagagacacacaaacacaatatgcatcacatataaaatgtgataaaatcaaaaattatacatcaatcatgtttatgcactacattatttgcctatttccattcgtatttttgtaagcgctgtttctgaaaggtaatatagcatataattacacctttctttttaaaatgctatgataatcttctcactgcctgggaagtttccatggcagaaagactgggcacagtcaggtaactggtatttcttgattaccatccaccagtaggttgatctttggaaagttacttatctttggaaagttacctatccaccagcaggttgatctttggaaagttaacgcgggcccccaggttccttgttagtcacataagggatctgtaataaacacttcctaagtcaggtccaccatccattctccacagcagtggttcttaagctttaacatgcacaagaatcacccagagagcttgtcctaacagagtttctggcccatcctcagagatctgatttaataggtccagatagggcccatgaatctgcatttcccagaagctcacaggtcagaccagtgctgctggtcgtgggaccaaactttgggaaccactgctacacagtaacatgggaaaccgaaatacttcagaaaatgaaagtctgatgtagcttctctccagaagccttcagtggtttccccatagcccttagcataaagtccaaagtgctaaatgaataacagtatgtggacacccaggtctccacccagatgcattgctcaggatctctttctgggcctttcctgataccccaagctgctgggctgagttttatgtccctcatctgtgctcttaggaaaatgtgttccctgtgtcctaaaactgtaaggaactgttatcacatgcttccttgcctctgttctcaacattccagaagtggtttgtaaacatacccccaactcccactgctccaaatttaaggggggaagagtcccctcatttcacctcacatcattttacttaagaatcgatgccaccttcgggctatgcatcaggtctcgtttccaatatttctagcagagccctcctcaacccttctttattactccccactctgctccccaaataggccacatcctagccccccattaattccccttcctgaagaagcgacagagataaggaaagcccaaagagagaacctgcacttctctgagcacatccctgaatgaggcaccaacttccccttccccaccagcctgctcttctcctcacaggtcctgagcatgctcaaggatctcaaagcacacagggccagtgtcaggagcatggacccatgcagtcacatagagccccacttacgtggtccccatgcttggcttcatgctcttctgtcaccatcttgaaactcttaatttttgaacaagaggcccacacattagggagctggtcctgaaggcaaattatggaactggatacatctcagctcctcagcaagcacacattaccacatcccattttcacccacactatctcagcagcacagctcccagcagcctaacagaaaagtcacgctttcctctaagaaactgccatacttccttccttcagagtaaaacaaaatcatattatggattgtatcatgctttttacataactaccaggaaactttttaaacacatgatgctaatttagcagccaacatttttgaacttcatggtctataaatttgtactgtttcccatattttcagtctctgtttctattttcttggtcctgactctcttttccattggaaattcatcatttattttactgaatatgaatatcctgctgagagctgtttatcccacagtccagtacacacaggaaggaggcacacacagtgcagagagccatcctatacaattggaatttaaagagatctgacttcataaagtacgtgtatacacatgcatacctatgcttccatgcccattaagaaaatgtggaaacaagaaatttaggcttgggagcaacggccaaaggagaaacaaggagaaggaagagatttacttttcacttttacctgtatatagtatttaattattttctgtaagtatattacttataatttttcaaagtaaatagctcagtaaaatgatcttctgtcaagctcaacaattgggtgcttagcagagcaagaaatggaaaaataatggctaaagcagcttttacgtaatctccaaagacatcaactttcacatcagtttctcatagactgtccagcatattggaaccgaagaaaaagagcaggcataaatactcagaacaataaacttgaaaaatgtaacctctggtatacatttaatggtattaaatgaaaagcagtgaaaatgaaaaccttaaacatctgcatatactaagactatgttaagaagaaacgattattaaaagttaactaataaataagtaaaagtttgagtatttgggggtgaaaaattgtcagaaagcaaatgtgtaaaaagatatatggtcctgaaaatcctcgcttattctaaatttaaaatgcaccttgattctattgcaaagaaagttgaaagtatgtcatcaaaaagtcatttaaaaaaactactacttaaaaagtgatcagataatttacaaagattattctcaagaagtcagataaagataaagatgccccatttgttaacagtactttttgttcttctggataatgtactgaaaaccagtctagcttcctatggtatgcataacttcctctgtaatactccaattgtattaccaaaagcaaacattacttttgttatcaaagcaaatttaataaagaattttcaactatcttgcccactcacttgctttgtaattcagataaatgactcaacatctccaagcttctttcatcatcttgtaaaaggcaaatagcaatctctcccaagcagcactgtactgagaattaactgaattgctttatgtaaattctcagcacgataccttgttcatggggggtgggcaataaataggaggtatcatcatcatcactcttggtaatgacgataaagctggtatattttcaattctattgcatacagtagaatttaaatttagtcaaaaataatgttcaatattaagaaataacagacttcatcttcataacaaaagataggttggcaatggctaccttagaagctacctaattgcctggtcacaattttttctttgtgtactttcctaaaataaatttaatgaataacaaactatataaataattttaactgataatcatgtgcaaagaaatacaatttggcactcaggctgagcttatcccactggaaaggtgtgcattaacatggtggcatgtattcgtttttcaagtcactttactggccactattaagtctctgtgtggatgaagtagaaactaaaaaaggtctggtttgagaaaggccggaagcaggaggcaagtgggctctgccaaggtgcatctgtatccacaggtaagaaggaaggttctccattctttctctctctctctctctctctctctctctctctctctctctctctctctccctctgtgtgtgtgtgtgtgtgtgtgtgtgtgtgtgtgtgtgtgtgtgtagcattgacaagggggtaagcccctacaaaagagagtgaacctcagaagagagatgctggagagacgctgtgtcctccaaaggactcatgtcaccacagtcaccatacccaggtcaggtctacctaacagccacttcaattccatctttctcatgtgacacttaaggctatgctgactttgccaaaattgctttcagccaaattttctaaaagaaaggaaaataagcatacttttctgatgaaaactgttgtcagacaggcctgtaactaaagccatttcatacagaatatcctggccaatgtttagcacatggtgctttacactgaaaactttaaaagctagaacagctatccatatccatcttctaaaataatgttgtaacagcattagtaaatggtgaataatgtttgaacagtgtctactaggaaggacttaatgaaataaagtggaagatatgtgaaatgactaacatttgaattcataaggatgttatgccccaaaaccttatttttggtatcaaggtggccattttgattaatttcctgatgatacttaagaaagaataacattaatttctaaagcttccagataataactttttcccaggttacagcttttatatatgttatatgcaactcacactaattcacacttaacagcagatagaatctaaattagatcttcttataaattatttccagaatgggcaagagcaaccaaaagataagatatacattatctaattattcaataatgctaggaaattcttttaaaatatacaaactaggctgggcgcggtggctcacgtctgtaatcccagcattttgggaggccaaggtgggtggatcacctgaggtcaagagttcaagaccagcctgaccaacatggagaaaccttgtgtctactaaaaatacaaaattggctgggcgtggtggcgcatgcctgtaatcccagctacttgggaggctgaggcaggagaatcacttgaacccaggaagtggaggttgcggtgagccgagattgcaacattgcatgccagcctgggcaacaagagtgaaactccatctcaaaaaaaaaaaaaaaaaaaaagacacaaactaagcaaactctaaatttatattattttggaagactcatcaaaaatcctgctccaaacactcatattgctaattatctcattcaagatattacttcaccatgtcaatattgatttattattttatactttgtttctttcccccaaaagacatgagaacacttacaaaaaatactcctgccactgagataaaatagataggtaagtaaatctgggttaagtcagaatgaaggtaagaaagtaaatatatatgggcagtggtagagcacaaaaatgtaagcttttaggtccctgatcctttgccagtaaagctgtactttccatcccaggctcagtttcttccgtgtttgctgggagttcctgtattactctgtagatttcatcgaacttttaagaaggcagtggttgctttgcctagcaagggaataagaataatgagctgagagctccaaggtggtatttggaaggcatactttttcccagaggaaaaatactgaagaaaaaggccagttgtacaggaaatagggacagacattatcaccatattgaagccaaatagaaaataaaatgattttttttaagtttaaaattcttttgtttccatgatatactcaagagtctgactccaaataacaacctcaaaaccttgtttctgttttcagtgccttcctgaactaagtgttttccctcaagtagcaccaataaaacccagattccacccactggcattctgtctaagccaacacagcttttatcaggtgcttgaaaaagactttgcatacagtaatgtgagacgctgaaggtgcatggcaaacagcaatgcactgctgtagaactccaagttgggcttctaacctcctgagagactgatgactatagatgtcacccaatcaatgaacaaatgaattttcttcagtatttaatagtgtattttggtatctggattactgggaattttaccaagggccaaaagagcctattgctaccaaccagatttggttgggggtttggcatctgaaatgtactcttttccccaggagctgaaattggaagtggacttatttaaatgcattggccttgatcacagtggatgcctagatttctattaacttttagccttgttaagtccaggtaatttcagttattgatgtaccctccttttaacttctccatcatcaaaagacatttattaagtacctatttgtttaccttactcttcgaagtaccacatggagaaacacttcttgccctctagggaacttaaaatcattcctctcatggtctccttctggctttaactagataccattaaatagttgcctcattctcctgctgcaaaaacatttcttcagtgctggctcttcattaaggggtggctaatgaagctcatgtagatcacccaatttggtagaaactctgatggctttagcccttcatctctcctaaatgctgcaccttatgaagtttggcacagcctctcacaactccctatctgccatgtttaaaggagttttgcatttgtttgtttttgattctacgtatttaaaactaccagtattttcaacaagaagagcaaatctaagatgcagataaattacgttactttgaatattaactattatatagattgacaaatattgctattttatctccagagaaactttaatatagagtcatcttgtagcactagggtaaaaaaaaaaaaaaaaaaaaaaagtctaagttgaagagatttttccaaatacgatgtaatttagggttacaatgtcaaaactgtaaacctaaaattaaactactaactatttttgtttgcaggcttcttttctcaaaattacaaccgcattacatttgttgcaaaagaacagattcaagccaggattttgttcattcacatgttattcctgctttacacgtattttatggaggagttacttttgctggcattttgttttgttttgtttcttttactaaatggtgagcaatgttagagataaatgtaactgtctacaaacactccagagcaaaatttggaaagaaagcttgagcaaataatactacatttgatgggatataagaaattaagagttcttcagatgacaagaaagtggcatattctttttaacacaatggaattaaagctatggtgaataaagcaatatattaagaatcctctggaaagccaatatcttgaatcattacatcagaatctacactgggactcttataacaaagcttccatccctgggaaaatgaagaacttcactatgagaggatggaactacaccaaaaaaacttttccaactccagtcttgggagcgcatcaaagcaacaggccctcgtccctggtaaactgtaatctaggcgtactacactttctgcatgttgagccaaggaatttcctcctagcaacaggctgtggtctgatgggctcgtccacctcctttccaagtggagagaaagcaaaatcaggaacaatatcccctgaattctcttcatcaaggattatcagacacctgttttaaattttaatctcattagttattattgataacaaggacaatgtagatccattgcaaaggcttataccacaaagaaaacacaactctaattagtacacgcttcataaacaaggcaaaggtgcctatctgaagctattttaaagcccttgttgtggttcataggcttagagagagatgctttgaattctgcttccatgtattgtactaggggaaagacatggcattctccaaatattattgagaggcatctttaccacaaggcaggatagttctgggcatggggctccctttcgaccatacctagagcaccaagaaaccaggagccccgcctgggagccccagtttcttctctgctatctctctggatgctggacttgcagtctcctcaacagtggatcacagcccatagctctcacatctttttatacccaccaatcccacactctcaacctcgtaaacttcacctccccttcactttctcctcttcctcctgccctctcccttatttcccattcagaaaacccccttcatcaaggtgtaacttcctcaggaagaactgcaaagaatcagcccagtgcagatgaggttccaccacccgaagtttctgctctatatccagtgaaatcaatctccctacacacacacacacacacacacacacacacacacacacacacaccacatcccatcttcttcctattcctctcaccccctcccaaggagagttttctgctctgaactacgttatatcctacctactagcccatctactccctcacccgaaaagtctgaactcctctaaggcctccatcagcagcaagatactaaactctgcatcctgaggtcaagccaagccaaatgttgacataccaggagtctctgcccctccgaccccagcttctagttgatattcccacatttcacttgaaattcaacatcctctcccttacaacctggctacttccccatatcgcaaagtaaaagccttctccagctttaaaagttaaccgctctacctaaattccagattccaaagtttcctattccttgaataatattgcaaatagttactaagatgccatactgattaagtggcaggaactatgctagacatgcattatctgacacagaaatcataagaactctataaggtataaatagatttggttgaatcacacaatatttgtaatacgcagctagatttaagccatgaaataattattttgtatttatatgtgcattattattagctccattttacagttagaaaaactgaggctcatgagacaaagtatgtttcccgaagtcacacagctcaagtatataagaccccaaggctcacagccacataccacactgcccctcaagcttatctgactccccaattttgcacagagctggtcctgtcttctgacctttacttaagtaatgctcatgtcctctccataacttattttaacagccagggtaagacccacattctcccatgaagctgtcctgacaaattccaagccaagctggccccagcctcccttggaatccatagtataattgagcaagctgcccttcttatgccctgtatgccagctaatcattctttaccagtgagtcatctcttctcaaactaaactgcatagttggcaaagcttagaaactctggtaactatgtcattttccctttctgaaccaccatatctcaattattaaatgagggtgttagaaaaaggctgccctgtttaagagaaagcatgaagagcctgtctgcttagcactacccttcattacctttccctccgcaaagcacaaaggaagcaaatcttggcttaaattagaaggtagcaagttgtcctctttttgatccttggatccccatttccaatgcactggtgctctcagatcttttgatattgcaaagacttcctcccttgtcaactgtttccagttcatctttccaaaacactttctacatcccactaatactaactttcaagaacacagcttggaacatgtaacttcctttttcaaacactggcagaaactccccattatctaccatggaaggcagaattctaagatggcccctaagacttcctgcaccctcatctacaagccctgcacctactgaggaaatccattgcatcagatggcattcagggtccttaagggtcatttcctggattccaggctcaggttacctgacactaattcatgcacctcaagctccaggtaaactggtaatctgagcctttgcccaagctaatttccaggtaaatctgtccctttattcattaagtttagaaatctgcattccaggaccaggcacagtggttcacacctataatcccagcactttgggaggccaaaatgggaggctcagttgagcctaggagttcgagaccagcctgggcaacaaagtgagaccccattgctacaaaaaattagccaggcatggtggcacacacctatggtcccagccacttgggaggctgagctgggaggatggcttaagccctgggaactcaaggctacagtgagccatgatcacaccactgcactccagcctgggcaacagagtaagatcctgtctcaaaaaaaaaaaaaagaaagaaagaaaagaaaaagaaatccgtattccttgcagaccagctcaaacaccccttctttcctactctttggactcaacattaatccatttcttctttccactgctccctcaagacattacctggaattctatctagtggcttatgcagctaaatcaggggtgtccaatcttttggcttccctgggccacactagaagaagaattgtcttgagccacacatacactaacactaacaatagctgatgaacttaaagaaaagcagaaagaaaaatctcataacgttttaagagagtttatgaatttctgttgagctgcattcaaagcgatcctgggtcacatgcagcctgcaggccatgggttgaacaagcttgagctaaataaaagctcagggagggtagttgctatgcttagatgatagagcagggacttcctgacagaaatctatagcaggggcacacttatgattcccgcaggtcactgagctgatctactctgaccttgtcctcgccttactgataagtgactactacgtaatactccagttcagactcatgatactaataacttctccactgcattgcttttctgaattgcaatctatttgtaataattttagcaagtccaattctcacccattagaaacaaatttaaatagaacaaagcttaaaaattagcattccaattttttttagggcatttgtctataaaaatgtagaaaccactaattatttaataattacactgactctttttatacctcaagttctcctcttgtgcaattcaataggagatcaatcaaaagttaaattttttgagaaatcatgttttccctcaatgtgtaaaagaggaagaagaagaggggaagatgtgttacatgactggttagaggccaatctaatttcaaggaaatgcaaacgcagaaaaatcttatcagctctagctcaattcctctaaatatactaaatcaaaatctaagaaggaaatggaaatacctgtgattgatagagaagtacaatactaggaatccacctggtctcctcaagggcaacggtttgtttccttctcagccacactatatcctatcagccaccctaaccgcccactacactctagttggccaagaagtcactgagggctgtcctgtgtatcttctcaaattttgtcccttgagcaaacaggattccccctgccttccaaaataatctaaaacaatattaaaagaaataaggtcacatcaaaataaaacaaacagtaaaatgtccctcgtccaattacgccttccagtccccacacttattatgtttgcctgaacaattaacagcttttaagatatttctggctgacccagaaggccatattcaatacacaaaaaggtggaaaacaagtgataggctacacagaaaattgtgccatcatttgctgaggcttctgttcactaagatcacagctatttttcagtttccacatgatgttctgtgtagaaaccatatatccctaatattggaagaccatgatgatcttatcactaaaacataacagctaagaactaaagagaatatttagattgaaagtgtcctgagaaaaatcaaggtgtagaggatcacagttggatgttctgccctatcttagtctcttccagaatgatgtacatacacatgggctccgcatacatgaattcaaccaaccatggaacaaaaatattcagaaaacaaaaattccacaaacttacaaaaagtaaaactccaatttgctgcacactgagtactatgctgaatccactcaaatgaagtgatatgtaggcactgtattaggtattgtaagtagagatgaattaaagtatatgggaggatgtgcacaggttacatacaaatactatgccattttatacaaggaacttgagcattatggtgtttggtatccccagtggggcctggggttggggcggtcctagaaccaattcccccaaaataccatggaacgactgtattttccattgtcgtattttctttacctttaaaataggaatacagtatcttccctgagaggataagtggtttctcaattttataaatttttctttgaaagaacctgttggcttttttaccttttcttataggagagcacatgacatttactttcttagcgaatttccagtatacattacaatattgttaactatagtcctcaacttttgcattaaatctcaaggcttattcatcctacaaaactgcaactctgtaccctctgaccaagatctctgcatttccccacctccccacctcagcaccattctactctgcttctaagtatccaacattttaaaattccagatataagtgagaacagaaggtattatttagaacaaaaactgtaacctcgttttttaaatacatttgctttggatatccaagaatcttcttatctcaagaatgctataaaaaaatatataaatcccattcttaagaagccagttattgtttggtactaggttcatccttacactacattcctcctcaagaagaaaataggtgctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaagaagaaaataggtaatatgatagatttgaaagcaatgattgagcttgtgctgaaatgaagtgatggattgtgcctggaattttttggtttaatgactttagatttaggataaaatttcattttatagaaacaacatgaaaaaatcatcattgcttataatattaaagtctgatatagaaagtaatagtaagttttccagcataggcatggggcttaaagggagatttgactctatcagagtatcaggattcactctcaactttactgtaattctccagaagagccaaaagaaaaaaaatccagaaatacagaacaaaatatttaaagatccaagccaaatgttttttaatgatttttttcttttatgctgactgtatatataacattttgtcattctgatgaaatacatgttatttccttttgaaatctgaatgaatcacatttcagaaaaattcattgaaatatgatttagaacagtgatcaggtaaaatttttaacactaattcagatttaattattatagtctttaattccctgtcattgttaaatacagcactaacagaataattaattgggaaggtatgtactatacattttaaagagcatttttttttttctaaaatctaaatgatgacaatttggctttgtaacacaggctgaaaatatttattcattgagatacggatcatctcccttttaacaagctaataaacaatatttggataacttttttttggctaaagtctattaggtaaaacgaccatcaacaaaaacaatgaggctaggcacagtggctgacccctataatctcagcactttgggaggctgaagcaggagtatcacttgagtccaggactttgagaccagcctggaaaacatagtgagatccccatctctacaaaaactaaaaaattggccgggcagggtggcatgcacctgtagtcccagttactcaggaggctcagatgacaggatctcttgaacgcatgcggtggtgcctgcagtgtgccatgatcatgccactgtactccaacctgggcaacagagcaagaccctatctcagaaaaaaaaaaaaaaagcaatgaatatataagcatattagtcttaaaaaatacttcttatgagctttattaatataagcatatatttaaaaattagtccagataattgctaatcacattttaaaaataaatattagactaatacagccaaagaaaccttagaaataaagaactgtagttattctggtaattctgtcttttcgatggactaataattaaaatcaccttttttgtttggattccaaatggtttcccaatttatcataaactcacatgggtggggaagttgtggaagagagtaagaaatcttggccaggcacggtggtgcacacctgtaatcccggcactttgggacaccaaggtgggtggatcacctgaggtcaggagttcgtgaccagcctgactaagatggtgaaactccgtctctaataaatacaaaaaaaattagccggccgtggtggtgcatgtctgtaatccgagctacttggtaggctgaaacaggagaattgcttgtacccaggaggcaaagtttgcagtgagccgagatcacgccattgcactccagcctgggcaacgagagcaaaactccgtgtcaaaaaaaaaaaaaaaaagaaagaaaagtaaagtaaaagaaaagaaatatattctaaacatgtgcagaaaactactaccaattttaaaagctaatttatcagttgaaagatttctgccacctatcattgtctaaatggattcccagtttgctggtgagatcttatttttagactgtgatatccttgaggatagagcctgtgcttttcatttctaggtcagtatagggcatgaaatattaggaagtactcaaaactatctgttgaataaacaaagcatggatgaattttttaaaaaccaatgaattggaaaacattgttcttgaatatctctccatagacttgaaatatatcatactatggagaaaggcacacctactttggattttcatgaattagttattttccctgaacctaagtaatatgaatactggcatgaaaatttacaacggtactgtaatcatggtttttttaaaaaaaatttattttctccaatgttgttgatgataataaccaccccttacatatgtcaattgtaagcaagctttttgtaacaagattcacaatgtttcactctaattctcaatacaaatcatcaaggtggatactatcatcaactccatcttacaaatgaagaaagggaggcctcaatgggtttaataacgtgcccaagttaatattgctgtttagctgcagagaggaaccttctgaacctctggagtctaagctccagccactcaacctctcagtattttgaagtaattcatgtcttattatggtgttaatttaaatcaattttacataatttatttttatatacttcaacatcattttcaagtatccaagtttttatttttaactcattaataattcatttactcttcctttaatcagatgactcatacaactttgcattttctatcttttgaagacatatagtaaccagtagaaggaatctaaagctattgtgttaaactactgactttaaaaataattatataggaacagaatcatatgcatcaaagatattagattattgaaataataaactttatgattctttttttttttttttttgagacagggtctcactgtcatccaggcaggagtgcagtggcgcaatctcggctcactgcagcctccgcctcccaggtttaagcaattttcccacctcagcctctcgagtagctgggattacaggagcacaccaccacgcctggctaattttttgcatgtttagtagagataaggtttcaccacgttggccaggctggtctcgaactcctgacctcaggtcatctacccgcctcagcctcccaaagcctcccagaaccgcatccggccacgattcttaatagtaattcccacatctaaactatacaatgttccactcgaacccatttacaaaagccacactccattttagtggtcaaaacagtaaacatttaattgttcatttaatttatttgggctatattaattccacataaattcaaattgcttgcaaattgaggtatgcttgattttgaaaatattctaatgaaaaagcttcctttctagccaggctttaccactacgtaagaaaggatctgactgtttggctttttcagtccatctgagatgtctctttgtaactgtattttaattttattagagtgtgttactcatgtggtttctctttcacatgaacccaaaccaaaactaatttaatgccatgttccaggtgactcaatatgaaatggggacacataaaaagatcttatctttttggaatcttagaaattcctttatctcttttacttctttttaaattttcaggtagttgtttttattataatcattattatatgtaccacctacttgtaaaaacgctttgggcaggtttacagggaaaaaaaaaaaaacagtagtagagaaattcacttaaactaagtatgagaaaagaagtgccctaaatatcacaggaaaatcaactacatacgatttcattttataatatttctacattcacgtacaggtaatctccaacttactattgattcgtgctctaaaagctcatcggtaagttaatggtcggaactcaatgaattctattgaaccaataacatattaggtgatcaggttgttacaccagcacgcaaagcccaattcaatcctgaatgcaactcaaccatcataccaatagtaccaacaggaattctgagtctaaagacgatggccttatgaagaattatgccaaatgggagatcaagtacttctacaataaattcattcattcagtagacattaattgagcaccaaaaggctgcagagtgtcagctttacatgtactaattctggaattaaaaaggcctggctcctaaatataaactggagataaaataatgccttaaataaaataatgtatgtaaagtttgtggcacataaaaaaatctttactaattttaactctcttcctttctgctgaggaagaagaagaaagaaacagagttctcagctttacataaattcttgaaggaagccaggcttaatttcctcatcatttgcactcctctccaccttcccttccgggcttcagggcccagtgcaagaccctcactgagccaaccatcttagacctctctctgttccaggctctaaaaatatcccctcccaacctgacttttattcccatcctgcagccactaacatctgctaggtgataaagaaaagcagatgcaatggcgcgatctcggctcaccacaacctccgcctcccgggttcaagcgcttctcctgcctcagcctcccgagtagtggaattacaggcatatgccaccatgtccggctaattattttgtatttttagtagagacagggtttctccaatgtcgttcatggctggttttgaactcccgacctcaggtgatcagcccgccttagcctcccaatgtgctgagattacaggcgtgagccactgtgcctggcctgacctgatgaatttctaattagtggtatttttaagacagtataaaagaatggtataaaataattcaggcagagtacaattataatatttggggacagggagaaagccattcatttattaattcattcaggttctatgaattgccttctatcttcctggatagacatatgtcagagatcatgtcctcatagagctttgagttcatcagggaaggcagaacttgtccaagctatatgactatttccaatgggtattaacaaatatttgtttaacagagtgaataaaatgctatgaagaaacttagagagcaacagaaatgcaaaataaagggcgctaacagaatggaatgtcaaggaagacttctttgttgaaggcttctcctagaatgtaagtcccatgagagcagagatatagtctatatccaaatgaaccctgaatttcaagaacccagaataatttcaggcacatagtacgcacttaactaaaaatacatgaaagagaaaaggaagattagcttaagcttagacttaaagggtgaataaaaattagctggaggaaatgggattaatagaagtgaaggcatttaggtagaaaaaagtagcactttttgacaaatttaaagaggaagcaggttgtacagacgatgaggcagaagttccagagagaaaagtgagaaacaagtttggaaaggtgggtaaaatccagatcaaactgggcctttcacaatgtgcaaagaattggagacatttttcctgagactgactagcctactgccctggaaagcccagcttggattgaactttccacaatcatccctcagaacagttctgaggcagtggcatgtggattctggtggcgaaaggcaaagggggagcggagaaatggagttcgcaagatgagtaactgaggatcccaagctgtagtggcagagctgccactctgtcactagaacaaaccactaagaaataaatacaacagggatatctgagtccttggcctacagtttttccatggggaaaaaaaaaaaaaaaatatatatatatatatatatatatatatatattcgttgagacatttgtttgtaagttcagattgctatctaagcatgctgggagaattcactgggagaaagccctgaaaagaaaaactatttgctcctgaatttatctgtatgagcaagtatgtgtgagagagacagagagagggagagagacaaggaaaggcagagagagggagagagaggcagtcctgtcagagggctgactgtaaaagaatggaggattacacacttcactgttcaagggtgacagagggaaaacgaggctggcaccaagcaggaagcccaatcctgcctgaataaaacactgcacatttatgcaatcccgggtaccagatcttttatcacaaactattttgattgcatagaaagaaaagtgctaagtaaaaattatttactccaggtctattatgaaaagaacagattaactccctaacagttcgttctttttgaaggtatattttctaccttgctggtatgatttatattaatgagaggtttaaaacaggttttaacttaagaatgattgctgatggtgaagtgcagtaattatacaccttatgacaggacacgtgaatggctcctacaagagaactgcataacatgtcaagctaatcctccttgcataaaaagagagaatactttgcaagctggccgattttaagctccagttaacaaaaaccctttttgttggagtctaaaacaagaatgggttaacaaaagcaaggaggaaaaaaatctcatttttccccttcttcacaaaatatactattacaggacttaaaggttttgaaaggccacagtgtggctgaaagacttgggaaagaaacaaggtcttcgccaacaacaccacactcaaaagatcctaaggtaaatcgcagtctcttatcagtatggaacagtatgattttactctagttttttgttgttgttctgtttttgatttttaatgagttaaaggtgtagcgagggaaggagcgacaccatggctaggtaagaatgaaatgggttcatggatgttaggaagaaaaaaacgtatgccatggtgggcaagtcaatagtgtttgtgccttttctgcatggctgctttttctcatacaagagccacttctggacaataatgagaccccgtaaagcatctgcttagggattacgaccccgtcacactgggaatgttcagttaacacagagcagccatgggcttaactccgtgtgtgcctgtcttcctgctgcaaaacgcaccaaatgcacagtggtcctggattcttctaaatcatttgccaccaggaaagaagatactcagctactgacacaccacctacctgctcaaggaaagcaaaaattaaataaacaaaagccatcagatttacttcacatcatggaacttgttaagacaagggagacaggaagactaaaggttgccaggtgtgagaaacgaagtctggaagtccattttaaagtattagagggctaaggatcagcgtcagtgttaaattcttttctaagaattcttttcaccttggaaactttcaaatgagaaatttaaggagcagaatccttatatttttctatgactcttaagtgatttacagaatcctaaagtgtagcaagttcttataatgagttgaactatttaacttattttatttaaatgtttatttcaattgttttgcctatgtactatagtctgtaactatcctagtctataatcaaagaaatcaggagtgcccaccacctatttgcagaggtctctaaagcagagtccacagtggccagggcccatctagcaaactggcatgctcagtgggacaggtcaagagggcgggtctgcctctggcttcctccttcttctaacacatgctgcacttgctcttgataggatagagcaaaaagtcaccactttttaagaaaaccaaggcaaagaacagaaagtttaactcgtggtacctcctaaacaattgatgtcattactgctcttcaaaagatctcttacagacatgtagtttagccataaagatagtacgttgtgttgaaaatgcaaaatcacacaaatattgccttaaatattttatttccaaatgtaagtaatagttaaactatttatatcccttcatgagaaactggaagctgaaattttcagatgtgaaggaatttctcagaaagtgatcctaaaaattttcaggaaaaacatctaacaatttaaccataaagagctttggtgaagtctgacacccagtatttagctcttttgctattattcttttttttttttttttttttttttaagatggagtctcactctgtcgcccaggctggagtatagtggtgcgatctcggctcactgcaacctccacctcccaggttcaagcaaattctcttgcctcagcctctcaagtagctgggattacaggcccaggccaccacgcccagctaatttttgtattttgtagtagagaccgggttttgccatgttggccaggctggtctcaaactcctgacctcaggtgatccactcgcctcagcctcccaaagtgctgggattacaggcgtgaaccactgggcccagacttgttttgctattattctttaataactgtttgcaaactacaaatattgaaaggtgagcatatgtacaaagacaaaattaactagtagtctgagctgaaatattgtagcttaattctagtctatcaattttgatctgaaataataactctgagggcagttttgtcaccatcagcactcattccaatattcaaaaggaaaatttttgtttaatttatataacatcttacttatagatgctttacttatagaaagcacctatcaattataattagcaaaacaggagtcaagggcattgttttattgtgttacatgtcaaggaaaggagacttagagctaacttctgtgactcttggaaaatccaggattgaagcctgcagtcctgtgacttattgaacagtcaaacctaggagaaattatcctaaggtaaaatgtcagaggattactctctagattggatggcagagagagattagcattctcagcatcaaaaaccagatcacaaacccatctgcaacagaagtacatgcaataaaagtactagaacaaaaatcaccacatttaagagagaagctacctcatggtgtagtaggataagaaggaatgagattgataagaggaggcatgtaggtatattatcattactctttttttttttttcttaatggagtcttgctctgttgcccaggcttgagtgcagtggcgggatctcggctcactgcaacctccaccttccgcgttcaagcaactctccttccttagcctcctgagtagctgggattacaggcacgcaccaccacgcccagctaatttttgtatttttagtagagacagggtttcaccatattgaccaggctggtctcaaactcttgacctctgcccacctcggcctcccaaagtgctgtgattacaggtgtgagccactgcacttggtctactcttttttttaacattttgttagttatgctttgtaaaactagcatatttttaatttaatttacatcaatttaactaaaattttattaaacattcttaaacttggtggtgctggcatttgttcgttgaaattttttttttggttttttttttgggtatgttttaactatttcaacatacgtttttaaaaaccagatccaagaggatcagaataacaatagtgaggtgaaatcactggatcaaccaggggacaaaaaaaaatagcttcacatatgctcatttggtctttttgaacaaatgttgaataaccaaatcttttagacttttaaatcattcattattcttgcagttcaaatgtggcaatcttaactatttagggtttcacaactggtaggtacttaataagtatatgcctatagaggataatgataactttactcaaatgggacattacagaaaatgttatacgattgaaaacaaaataaagaataaacaccaagctcagaaaaaaagacttcacactaattcactccatctcattcctttaaaattcaggcttaaaaattttttgataaaggcgatctgatgttcaaaggacatcatttaaaacttgggaggcaaactgatagaggagaatgccttttgtgtttaggaactcccagtattgccagccccgaccttgttcctcaccagctgtaaaagcctgtgtgagaccttagtgctgaaggcctcagcttccttatctgtaaatgattagaatagataataaaggcaacaaccaagtttatacagtttgcctgacaactttgacatatactatctcaccctaaaagatccctttgggttttcatgggctatcatcttggttttatacacaactcttatttggttatatgtcacttacctaagtccaagaattacgaagcacagttgttcagttaatttatttcttatttttaaaaaaagcactgttgtactgctgtagatagaacaactctaatcttcacgtactgctgaattacaattaggtgctaaatcaccttcaaagaatgaacaaccttttgttttgaggctcgtccagaagcatcactaggacctgatatgtacaagaaagaaaaaaatagtaacctgggcagtaagagttttgtcagaaggaatgcttgtccttatcagaaacaccacttatccccaaggcttgaactttaactatgaaactttacccactgggtttttaacacaattactactgcaagctcaccattatgtatttaaactcacaataaagaatcaatgcctgatattgcattatttcctaaaagcagattttgatggaagacaagaggctgggctccagtatcaagagtgtacaggatattttttaaagacatatttaaataatagcattgatcataacacaataatcactataccctcatcttccattcctacaacaaagccccttaacaaagacatgtgtacgcattatagctaccagttttatatggaactgcccactaatagctaaattggcatctttatgaatttaaggttctctataatgttgattatggctactgcttttgactgtatttttcaaaactgaccacaaaatagaagcttctaacttctctctgcccttgtgtttgcaatctccagagaaagcactccttaatttcatcatagtggtcagtaatctttagtgattgagacagaaattaaaattgattatttgaattctgacaagctgcttatgtttgtaattaccataaaactctaccacaaatgccctagagtccacgggtgtgagtgaggggttgataggaaatgatccattttcatgtatctagatttaggacgatgcatgtggaattgtagagccacttaagatcacactcatccgtgctggactaactgaagagggaagtcactatcctctcttaatagaccagacagtcctcacgtcattgctacaattaaattccagagaattttttggattctatttaatgaataaggatatatttttcatgtggtgtcattgtttcactacttcccatgtttatttggacagattcatagcactgggtaggaaatgtattggttggcaacttcagttttggaagagaaagtaaacacatgctgattagcaaacagtaaactctactgtgtttaattttggcttctctttaaaaaaaaaaaaataaaaacacaaaaaagccactatttggtgttgtgttccaagtaggagcatttgtccctaagttctttcctaaccccttactggagggcttccagaattgctctcatttttttttcttcttcccctaacaccagtggcaaacgccaacattatttaagaaaatacttgtgcatatggtatcctcctagcacagatttgccatccagttgaacagtagggccactaacccacacaaactaaactgcaaaattatgaactgcataaacataaacaattgaatttagccctaataaattcaaggtaaaatcacacttctgaaattcctaaaaggctacgtcactgaaaactatcaggtctgagaactgaaggtggtaaatatgacaatctaaaacttccaatgctctctttagagccaatttctttcatctatctcatcctattgatttactgtgactccccaaattattctccaagctttagccattcttagccctcttctcatccatcttcagaagatcatcaaaatccctaacacccaaaaagtgccgaaggccagcacacacagggaaaagcttggccacctaagatataccattgcccactgagcacaaaagctcttcattatgtctatgtaccttctcattaaacagagctggtgtctgatcttttcactgctcatgattactactcattattaatcagacttcccaacatgcttccaaggtatgcaaaatctcgtccccacataccagatgggaaagctgaggcatccaaaagttaaataactcccaaatagcccaatataagaggtcagcaacatctcttgccgatctacattgtttcttattcaataaacatttattattgatctaccaagctcctcaccctgctaggtataacagtgtgtgtgtgtgtgtgtgtgtgtgtgtgtgtgtgtgtgtgtgtgtgtgtgtaagctcctcaccctgctaggtataacagtgtgtgtgtgtgtgtgtgtgtgtgtgtgtgtgtgtgtgtgtgtgtgtattctaccatattctgggttctgggcaaaacagcagattatcaaagtcctaacccacatgaggcttacggtctaggaggggtaagaaacagtaaaccaagaaacaaatgaatatgaaatatgtgaggtagctatggggcaaagagtacagcagggtaaggagaaaaagacctgggaagaagagagtggtagctggagtggtaggagattttgggggcacatgtaatttaagtcttcctctgaatgaggtaagggagcaagccctacctacgatcatctgagaaaaaaacggttcccagcagaaaggacagacagagcaaagtgcctgaggctcagctgtactggagggatggtagtattgctgctactgaaagggcaggcagagtgactcactggggagagggaggcaagggtcagatcacacagcacctggaagtcaccactaaaagtaggggctacaaatataaatgagactactcaagagagacagtcttgtgaagagtttaatacgtaaggttacattaaaaattcactgcattaaaagcagttgatgctttccctaccatcacataaaaagtatatgtgcacaaacagacagaagggtgcatgcgctgaattttatatagtctaggaaacattttcacattggttgtttcagtcaaatacaaagaagttacagaacagcatcgagtacctaagagagaccaaaagcatttccttctgtaaagccctgcagctgagggcttacatccgcctggtccaatcagttcatttccaaacaaaggtaggaaatggctgcatcctagtatttcattgtggactcatgactcagtgctttggaacttggtatctttgggagtgagtgtctattctccacgtctcttgccacagggggaaaaaggtacagataaacagtaacacaatttcacccaaccgagatataaatctgtgggcttctccacccttctcaaaaataaatgaatgaatgaaggaaattcagttcctgcttttttttcttcccttctctgttttgtttcctaattcccaggactccctggtgtctcctaaacagcataaggtcaactgatggtgaaagtacatcacatgataattattcaaaagctgttatgttatacaatatagtttataataggaaaaggagttacatttgattctgcaagagcagtcggtaatatgcccattacatagggattctaagaaactaaaattaagaaatttgtcctaaagaacaaattgattctcctccatcatttaaccaaaaaggtttgtagtattttgtattcacaatgttacacaggagaacagtaacttaactttgaaaactgttttcacacaatggtcacaaagaaaataacacataaatcccattaggtctttttgtaaaaagcttccataatttccaaatccacggtgtagagaggaaaagaggaaaatggcatgtgtatatgttctaagactattacttcaaatgaataaggtttagaggtatacttaacatacaaactgtttccttcaggaaaaagtgcaggaactcctggatagacacaatactcatttctgatgaaagttacagaagaaactaccagttgtgtatgatctaatactacaagtcacttattatctatgaaggaaaacagaaagagaaaagataagaaaacaacatttaaataagaatgagaaaggaatctctgttctaacttaaagatacataaacatataaatccaaatatgagccaaattattttataatgatatccatgtgatcaatgaggcataaccacaagaaccttacacgattataatgagagaagcttcgaaacaggaaatttctatctacaaaaagtacaaattattttcagaatattggaggaatctggggttttctacccagcagaataaattatgaaaacagtgaaagataccctccagagggagagagtgcaagagtttatatgttaaagagaacattacatttcacttttccaatgtagaaacaaactgaagaaaatttagaggggatggtgaggatgaagagaaataaaatcataaaaaggaatgagtaaaaaatgtaataaaagaagaggaatatggtttccacttatattagttttgtccttccattaaaaattataccttaaagtccattactcttgactatattgccaatttctcaaataatacactggtcaagttccaaaatttcattaaatatataaattgcatacataaaagttcctgtgtagcctatggaaacattttaaattttcttcagcaaaattgggcctaaagtttggaaaaattcctagagagtgaaattaatctctctgtccccatctctccctctctccctctctctttctctccctctctctcaatagataatattaccctactatatatcctgccatatatctttatactccaatttcctacctagtcccctattcagacatgcataatgcttccattttgaagcatatggctggggagccaaaagaatttaaattgccttcaaaatgtgcatcgcattataaatggtgtgaaaaaagatcttactattcagctctcaacttggagcataaagcaaagaagaagcaacacaagactgcttcaaactttatccaaaaactcaacagcttcacttgtttatagaggtacaaaaagtatgcgacacagtttataaaacaagaacgatgtactgtatgcaaaagtaaagttaaaagcaaagtatagtaacagccctatctcgttacaaacacttggcagcatgtctaaagtaccatggtcaaaaacatgataccgtctgcgttgtacttctgccagaaagcactccctaagtccaagtctctttagccatcatcaccacctcatttggcaaactctcccaagcctcagttcatctactcaaaattactccacagaaagcagacaaactctctagctttgtaggctgcaagtatcacaatgaagtagcattggcaagtgacagcgtaagatggagctctgaggttagaaagccaggaccaactaaactgtatcctcaaagcttatttgcatatcaagttgagcagggctgtcttcattttggtaattcagggtttcttctctactctcacagtaattccaatgggtctttctgaatcagccgcagctgagaaagaaagcacatggcaagaatacactcaggcaccgaataccttttaggcaaatgaggggcaaatgtattcggcaattacctgccatttaaccatttctggccaggtcttttgaataattccagaacctcaaaaactgcctcaatagttatgtatgcataacggaccaggccattaccaaggctaagtaaatacaagaatatgcatcaaggtttaggtaataagtagataaatagactatatcagtatcaacatccatatctacctgtggcatttataactaaaaaaacagcagttcataatacataagtataaatgtggcagtgaaaagatgactgataggacagaagtagctgcatgaattattaattttcctagggcacgtaagaattggcttccaaatttttctttaatcgactttctccaaagtagcatattacataattcaaaaaaaaacagatattgtcatcttaagtttacagcttgccatatttcctagaaaataaacaataattaacaacatatctcatagttgttccctccccacctttcttcaagaaactttacactctgaaatgtagatacataagctacttttggatcagggcccacaaccatatgcttccaaaggaataatatgtacaggttagtctggtgtgtaccagatgttaaaaaaaagcaaattcaaaaacagaaatatcagtattcaatgcagaaatatattttaaattaaatcccattcttcctctccttatagacacagaatcaaagaaagccaattgtatgtctaattttttaacctttttcctgaacaaaaatcccaatttgactcatgactctagattctttatatacataagatcacaagacaagaaatggtcatttataaattatcctgtctcagagtgagcctcctaccatatgctgatattcaaccagaagaatttgtttgaaaaggcaaaaaaaattccagaagttaagcctataaggcaaaccagccagcaaaaggcgacagagtccacatgtctatcagatatttaatatgttaaacctcaattaccaaaagttttaagattctctgtaaacataactagtgagtctttatttttcagatgattctgaatgcaaaatgagcacattatctgcacattgaaagaatttatgtgttttttcccacatatggaaatatgcatgagtattaaaaaacaaattacaaatatccactctctagaagtttgaaaagtctaaagtttgggctgtatttgctttttccattgcaaacctacaaggattccttcagacttacaaaagttattgcaagaagtcctgcaggaagaaacagattggggatttagatcacccatgcctaactttttcagggcatcatgatctctccccttgttctatacatcagagatgtcactgaagtgaaagccaagttttactttagaatttaataaaaattgattaagcatcacagagcacaaacaaagctgctccataaatctttcaggcctttttgtgctaggaagaaagcaagcactgtctgctgaagcagatgacagatgctggcttaaagataagtattatttatacttctgtaccagatttcttcttatgcatatcttatcatgcatgggtatatgatcaacaaagcaattattttatatcagtcaaagacattcaaatgtaccctggctccataggaatgctttaaagagttcaggtctagggttcaattaaaccaagatggagagaaaagaaagtttggaaagaaaaacaaatattgaaatggttgtgatttgaaatgtactttcacacacaggctaatgaatatatatgtactgaaaataactttgttctgaacatatgcctatgcattttaaataaatgatgcatgtttgaaagataagagggtttaccaaatctaaacacatcaagatatatctatattaaactgcatttatttgtacagtatgtcggtaaggaaacagccccctgaaagaaatccaatagttatgtaaagagatagctgatttaaccaagtttgagaacattttagtcatcaagactagagtttaaaaatttaaatgacattccttccctccctccttagaaagacagaatatatgaaaaccaatcacttaatgaaaattcccagaggtttctttattgttttacttctagcatatgaagtggaaaaaagataactaattatttgaaagagaagaaaaagcaacttatattaccttctcaaaaaatatataatattctgcatcataaggcatttgaaggtggagaagctggcatgtgattccaaaacaaatctggataagtaagagaaataaatcaggtgggctgtcttgaccattttcttctaccccgattcctaagtcccttgagaatctagaagaggagcaggtttgggggtggaattgttttgttttattgtgtttcatgagggaagacaaactggaaataaatgagttttcaagtccagccagaaagtcaacctatggttagatttacctaattgggtattttttaaaaaaaaagtacaaaaacaaaaacctgtgctcatccatttttttatggtatcttattgtatttcatttttttctcagcatttttcttcgtaaaagttcgtcctaagaaatcccaacctcgtctcagatagcctaaaaggcagaaatgttcatccactcaaagaccaggaaaccctaagctgcatgacatcatgtgggagtaaaatgactgagtgagctcaagccaggatccttgctgctggagggtttcctgcacaagggctagctgaagccacagatatggctgcaactgcattaaaatgacattggtagcagaattaaactgtctggtttcatggaaattaccgtatactgtagttatcacgtgagaattagcaatgcactaaaataggacacacaaatcagtactattatgtggtaatactaatctatcatacgcaataatttttctttcctgaattatatatgaaaacacatccataagggtgtagcaattatgagcaaatattttcaagaatggctattgtgtatgtctcttttaagcatgcaactccacatagaagcactaaacaaagtaagtgcttaaagatattcaggattctctttcctatttaaataatcctctctattatataaaaattcagtttgtacaacataagcataagaaatttgtagaggaaatgataggtcagaatggtttttaaatgaccttatagtagaaaacaaagttaaaatatataccatataccagtgcagtcagatatattggagtcactaatacattctgaatctgctgattaaatgagagacattcaaaatgaatgaaacttacccacatactttctcatccatgtaagcaggaaagaattacatttcttctgagctaatgggaatgagtatagtaagctttaccgataactttaatctccacaatctccatagacagatccccaccaaaaaataaaataactgcttagtaactttgcagcatatcaaagttcacaaaccatgcccagttccaatacttattagccgttggccttagacaaattactgacctctctgaatttgaatttgtatatctatttaaacaaagataataggctcaaagtttgaaacaaatgggatatgtagaaaaaacattgagcaaaatgcctggaacacaataagtactaaaaaaatagtaaatactattattgttgttcttgctactgttattattattacacagtactttcatgataaaagtctctggccatacatcagcctagattagtgcagcatgtgcctaatttctcatctctgattccatgacattggggtgtccggattctcctcctacttatctgacttctcactatcattctcctgtattaactccaattcttctaaaagtcagcattcccctggttctctttatcaccctctgcaacctcaatcaaactttggcttcaaaggtttgggataacaacagctaaattcagacctgtattttcatttgcctgtcagacatcaacacttgggtcatgcctacccaacctagaagaaaaaaactgaacaactcacctccaaactcagtggttcttccactgcctctgttaaggaaactaacatttacccaggtgacgaaattagaaacatcacagtcacacccaactccttctccctacatccataataatatgcctccttctttctattcctaccagtacaagctttcctatgtccttcttgctgctctcctgactttcacagaagtcttagcttggttatgttcaacaaacaagaacacctaagatatgccaagcaccatatactctgaatgcaaaccaggacagaacaaaacaaaacagaaaaaaaaaaccaacggcaacaaaaaaaatgcaacccttttgctctcaaggttcttcaagtagtgggagagatacgtaaacacatgattatactataatgtcatacaagcaataataagtacacatggccgggctcagtggctcacgactgtaatcccagcactttgggaggcaaaggcaggtggattacttgagatcaggagttcaagaccaacctggccaacatggcaaaaccccatttctaccaaaaatagaaaaatcagcagggcgttgtaatgcacatctgtaatcccagctacttgggaggctgaggcacgagaatcgcttgaacccgggaggcagacattgcagtgagccgagatcgcaccactgcaccccagcctgggtgacagagcgagactctgtctcgaaaaatgataataataataagtacacataaattataaaagtgggacagaggagggagtgattattccatctagacaggtcagaaatgagtttactgtaaatatccatcactctagaggagtgttttgaagaatgaacaggaatgtgtggttgcacaaatgtgtgcaatgaacaggaatgtgtggttttcctctctaattcctgagaattagagaggaaaaggcattctagatatcagggacagcgtgggttagactctaagctctctaatcaacatgtttacacttaaaactcgccagtctaaaacccagacctaattttaacactttcccttttccataagaccttcaagggctttccactgcctctaggataaaatccaataccttgcattggcaaggcactggtattctaaactccgacccattagatgggaggaagctcccactgctctccacatccctttgtcttaggtacaggaagtcactacaccttcatacaggactgtgctccagccagccaccaaaatgcctctctgcccttcaccctgcaaaatcccatttaccctgggatatcaagtttaatttcactctgctgaagtccttcctaatcaaccctgcattgtgtcctcctctgagccttcagtccctttgttgatagctctatttccacacatctcatacatggatttgtagagtgaatgcccatatgtttgccatatcatttttgaagagcttttgctgtaaatgagaacttcagtgagtaatttccaattactttcccccaaattaacaggcaaatattaggaaacatcctatgccaaaccctcttatttggtgccactgacagtgctaacaggctagagtgaaatatcaaggtatatgtgtggttcacagaaaaccactaatatcaccctgctattgactgaactgtgtccctgaaaatgcatatgctgaagacccaatccccagtgtaactgcatttggagacagggtctttatggaagtaattaaggttaaatgaggtcataaagttgaaggcctgttaaaacgggtttagtatccctacaaagaagagatgccaatgtgcctgatctctctctctctctcttgctttctttcactatatctctctctctctctgctttctgagacacaataagcaggtggctgtctgcaaaccacgaagagagccctcaccagaatccaatgatgctaattccctgatctcagactcccagcctccaggactgtgagaaaagaaatttctaccatttaagccacccagtctatggtattttgttatgacaacccaagctgactaggacttataccatagtcaagagaacttgaacagtccacaattaagtggtgagactgtctctggtatgatgcacaatgtatttaactttacaaacagactcattaatctctcaaaagcttaacactgtcaccattttacagacagatccagctaatggttggaggccttccatgcgccatccaataatgcagggagaggcagtgaccatgcccagaacaggattctaaagtcctgcctttcaaatccctgacctagaaaaaaggactactccatttctcacaggaaaatgtgccagtcatggaggcctacatggcacgtctctgcactgctccaggtcaggagggccatctgacactgcacaggcaccactgcagggcaaaaggatgatcaagcatccaaaggccaccgccaccactgactagctgaaaaaccatgaaaaagttatataatttcactggatataaaattaaagcaagattttaatacttaccttgtagggtcactgtgaagatcagaaataaaatacagaagtacatggcccactgcttggcatacagtcaagactcagtaattagtgggtactctgcatgctttgatgtcacctcattaacagtttcacttctacctaaactaaaagcaggaacagggtgttcttattattttttaaaatctacagtagatatctgccctgtttgtttaggtgttgtctacacagtatctactaattttttctttttttctttttttttttttttgagacagggtctctccctgtcacccaggctggagtacaacggcataatcaaagctcactgtaactctgaactcctggactcaagcaatcctcctgcctcagtctcctgagtagctgggactaaaggcatgcaccaccatgcccagctaacttttgaatttttttgtagagatggggtctccctatgttgcccaggctggtcttgaactcctggcctcagcaatcctcccacctcagctctacttctttctttctttccttctttcctcccttccttccatcctagcaatcctcccacctaaactgcccttccttccttcccacctaaactgccctgccctcccctctcctccactcccctcccctcccttccttcctttcttccttccttccttcctgtagccttggtctcccaggctcaagtgatcctcccacctcagcctccagagtagctgggattacaggcatacaccaccatgtcggactaatcttttatttttttgtggggatgggatctcactatgttgtccaggctggtctcaaactcttgaactcaagcagtcctcctgccttagcctccccaaatcctgggattacaggcatgagccaccacgcccggcctctattactttttgttagtaataacaataattttcctctgggaagccactcttccccactttctgagatcatgtagtttgggtgtctcgtgatcctcctctagctcctctccaagaacaggcaggagacttaagcatagccaaagagaagaaagcaccagttcagcaacaggttcaggggtagtccaaggagatccagcccaggaacgtctgcagggactagtgaggaagggaacattttcctccccactgggtttgcttggctaatagaatataagccttcactgtggaaagagaccctctttgcccgagaagtaagggaacaaagagaatggcataggaagagaatcagagaaacattcccagttacatcatttgaacacctgaatcaaactgtacctgcagataaactggacttttaaattacatcagagaataatctccctttctcacttcagtctgtataacttcagtttcttacacttgcaattaatatacaaaccaaatagcagcaagaatttgacacctttcagtgaccaaaaggaccactgaaataagaacttagtgataagaaatacctttcattaaattctcactgtacgtcaactaaatatttcaaatttagtatttccaattacataaactgaggatgggggtagatattattatctctgctttactgataagcaaattatgagtcaaagagcttaaacaaattgcccaagtttaaatagtaagtggtggagatgagatactacctaagatttagcttttttcttttcttaagtattaccaagaaatagtattactcggaaatctcacatatttataagatccctttgttttatgctcttatagcatcatgtgccttttcaccaaatgattcaccacaattgttcattctacttttttttaagattgcgtctcactgttgcctaggctaaagtgcatttttgtgatcctttgatttgggaaattgttttctcccattatcttataaacttcctcagtttacgtctatcatgattattgcatatcattgtgcattcactgacaatagtagatacttagcaagtactgtaaaaaaatagaaaggaaggaagagagagagggagggaggggagaagaagagaggaaggaaggagagtaaagggaaaagaaatgaggaaggagggagagggcagaagagagaatggaaaagtgagaggggaaggtaattccacaaccccttcaccacccttaagccctttcttgagataatttagggcctagcaatagacagtggtgacactgtcctcatgcaaagggataaatagaggaattccggaacaaggcaggaatatcatcataaatgccaaagtcttgtggataccatttctgactcccccaaaaccccacacagtaggaacaaacatgataaaaagtttcacctattcctaactccttgttcaaaacccctcgagtctctttcttcttttcttgataagtcttagggtaacacaccaagttttaaaactcagttacaaatttgcccttaactgagcatctgaaaggttatcacgcaggatttttagctctaacagggaggagggtcttttgagtttatggcctgttgagcacttttgtgctgagtcaaggaagataagaggagtgggaaacaggaagaatccattagacagtgtctgtgcatataatatctttttttgttttctttatgtaagttctctgatggacaataatgtccccaggtagctaatgtcacaaacctcttaaacatgagagagaaattgtaccatttctcaaaggcagctttttggaagggaagatcaaagaggaggcagaattaaagccttagctcaaaaggaagacagatttccaaaacttcagcttttgccattaaaactttcaggtgtgtcccaagataaatgatacatcattggctactacatccccacagtggcctcactactacctcaatttgattttgtgaaggagtgctgaagcactatcaaagaactttggtgttcccttgcttatgtcatagttacctagagaaaagagagtatgccttaggaaatattccagtttaaagcaacattaaacataccaaattcatcaccgggattacagtatatagaatattttaagtcaacctgtatatctctgtcaattatattttattttaactatgtgagagaaggaataaaagttactaaggtatcaccttttctagtaaaagataaccaaataaatccattgagaagtcacgtttattcaaaagaattggtttctctggacttatgacatttgagtatagtacctcctttcttctagaatactctgagttaataaaagtttttttgaaaatgaaatccatgggtatgtgtcataataagtaaatactaaatgcttgtagtttttcagagacttttcttaggtgatgtctattcctgaagtatgatcagaatgcaacatctaacattttacataattaaagattatagtattttgttttaaaaagcaaactagaaacctcaagaaaaacctatccactggcattcctttgaaacatacatacaaagaactttacggtgtttttccttgcctttgggtgtttgttttacaagagaggaactccaggtgcaatcactgaatgaggaattagaacctccctccaagctttcatctgattgcataccaacacataacgaaggacatgatatatttacagtagctaaagagttaatctttagcaactctgcttaaaaatcctaatggcagactgcccatcattcttttagacagagcttgtcagaaaaactagggcagcttgtccagctcagcagtcaactgattactagtgaactcaatggggctcccagccaacccctgagattgctgccagccccttgggtattcaaaggccaagttccaatgtggtttactttgccagaatcacatgatgtcagtgctattttctcctgaccagaataaccagtcattcaggttactgcaagtggtatcggtgaactaggcatcacttcactgttagaggtcacatacacaccaaggctctgctccttctcaccacggccgaggggccactggagcctcctgcaggaggtcagctaatcccagtttgtcagttccagccacccaaatcctgcacgggcatcctgcacaccgcagtctgctccaaggaccaggaattacacaggcgtgctgcacatggcacacttagagaacaaaacaaacaggtccaacttttataaagaacaagctggagaggaaaacaacagaaaactggttttggctttcacttatattatattactcgaggtttagtaggcaagccacacaaattctgtgggatttagtcaccgttatccacctatgcccacattctttgcatggtagtaagacattaattaatttttacatctatcaggagatttttcagttgctacaggatttgcaagggtacatgcatgtaaggagtagccagtttttaaaactgtgattacccttatctttcggtgagagaaagtatttcactccctaatgcagagaattaaaaaacaagatccactttttaatctttcttcctccagaagaaaatacaaacatcaggaatagcaaacgggctgatatggctggtggactctgttttcaaagtcttgaacatatttcccaatgccttaaaaaccttgaaatatttttaatattcctcattacttctatggcactttgcatttatttatatgaattcattttaaaaactcactttaaagagactaaatctttaaaatatgacatttaaaaatactgtagattttctatatcattatatttatagtttttcatcctttcttttttctgtcagtaaagtaataaagttttaactgctgagaaataatgggcagcaaggtaaagaagtgtcatgatttttaaacatttgtatttgttaaaaaaaacagaaactgcttcagttataatatgtaaaagaaaaagaactgtaatgactgcagtaactactattacgtaaaagacaatacatgtttcagaaataatagagtcaatgaactatctgttactactggatacatccttattaatattaccttggggaaacctctaagcaaagtgagaacaagatcacgagaacaggcgtcttaagatctactgatgcagctttacatgttcctgccatacaactttgtggaggaaaaaaaaataatgtctttccatctcctgcagcaaaatattgcacccatgacggtcacccgtattaaactcaggtaaacttctacaagaagtccatctgtcaaggaaattgtacagtaagaaaagactggtgatggatgcatggaaggaaggaaaggagggaggaaggaaggaagggagggagggagggagggaaggcaggttggtttctacaaagaaaaaaaagaccaaaaacaattatttttacatcaatgcttcataattttcattcattccatccatgaagaaagtttaagcagatctgcaacaacttcaaagccaatgttatcatgtttttcaatcaaaatcaggtgctacagttagtgttccctgatggttacagctcatctttgactattcaacatgtcttttgtcctggtcttttatttccttctcagatgcatcatatcctactgctaacataacatctttaacgaactaacaaatgtttgaaagaaagagacttgctagatacaagttctctggtgcaaagggactgagtggtcaccaccaattagattatagcgggataatttcacagttctcgagatgattgtttcaaggaaggctggaaatgtacagaggcagaatagcctggaagtgtgtggttttctctaagcagaccaaaacagcccacaaaactcccagaaggaaaaaagcaagtgagatttcgatcctttggcaatgaagaaataatgcacaaataaaatgttttagcctagcacaggggctcacacctgttagtcccaactacttgggtggctgaggcgggaggattgcttaagctcaggagttagggaccactctgggcaatacagtgagaccccatttccaaaaataattttttaataaaaaaaagaaaaaaatgtttaaaatgaagttgtcagaaatactcttttgagactacgtaataacctgggtgctgcctctaggtatctttgcggaattgttacagtaagtaaaactctctcaagccaacattcatggctctccatgaagtaatctctatttatttttttcacgtggcctccagcacatcatgggtcttgtattccagctacactggataacttcttgtacattttcctgccctttgacttttgctcatgctgttcccctggtctaaatgcctccccagcacttgacaaaacccgtcttttaaagtcagttaaaaacataatttctcaggccagtcatggtagctcatgcccgtaatcccagcactttgggaggctgaggcaagcagataacttgaggccagtagtttgagactagcctggccaacatagcaaaaccccattctagtaaaagtacaaaaattagccaggcatgatggcacacacctgtagtcccagctactcaagtggctgaggcataagaatcgcttgaacctgggaggtagaggttgcagcgagccatgatcacaccactgcactccagcctgggcaacagagtgacactgtctcaaaaaaaacaaaacaaaacaaaacaaaacaaaacagcatttctccataagatgctccctccacccctagaaccagatatgagctcctccactgcatctcagtagcttcacatttatacagtacttctcttaaacactgacttgatatgggcttgcgttacttactgatcttatccctccaccagacataagcacataagcatggagacacgcatcttcagggatgtgcactcaataatcgtttgctgatttgaagtgaaatgatgaggctaatttattttacagtactcccgtgcactggttctctaatagctgctcaaaggccctccactgatccaaaagcccatctgctataatattagtgttaataatgatacataggttcctgagataaataatttaattatcacatgcttattagggtctcaccaagagcagagccatttacctctttatttgaataagacttctgaaaaatgctttgtagttgggattctgtgtgtgtgtgaatctatgcatgtgcatatatgtgcatttacaagcaaggtctagaggcctaaataataataatgatcttttgctcctcttcagtgaacttcagacaagtaccttaaagctacaagctttaaagtattagcttatgaaagcgccaaccatgcttccaaatttcaaaacaaaataaccttcgctaagtcaggaagatcacttgaggatgggaattcaccaccagcctgggcaacatagcaagaccccatctcttcaaaataaaaataaaaatagccaggtgtggtggcgcatacctgtagtcccagtttcttgggaggctaaagttggagaatcacttgagcccaggagttcgaggctgcagtgagctatgatcacaccactgaactccaacaaggatgacaaagtgaaaccctgactcaaaaaaagaaagaaagaaagaaaaaagaaacttggctgaaccatgaggagttaacacttggacattttttgattctgcaactgtaaaagaatcttgctgaatttgttgaacttgtgtctctaacagattactgacatttccttaatgtaagatcacctggggattaaatctcaactgtagcacatatcaatgactgtgagcatctgactttaccttgttttacaattctcatgaaatggatgtatggtcaatgactgaggggatgataaactttatattaaccaaacatgatataaaaatccagggcatactgatgaccagatatgggctggtaagaattagttctaatataacatggacatggacatgcttcagtttatataaattgctctataggtagtgacagattaaccctcctaacatccttaaaaaaagataataaaagttattattcacttttattgatgaaatacttggagtgtttagactctcacaaggtcactataaataaccttttaacaatccagctcactgatgagtcttggtgtgttttgtgaagcactcaactgactgtgagaatcacatataagagaaatgatcaaatagcctgaatgcctttggaaaacattgaattcaactctgtcctgctccagaatccacacactatgctagcatagtattactgaagcgcaaaacaccatgctagcatagtattagtgaaatacaaaacactgtactcaaggcacctagtttaaatccaccacctattagctgtgtgatcttgagaagtcccttaattctccctcatgtgcaaagggaagctaccaatggtgcctgccccacagggctattatgagtataaaaatgagacattttatgcagcttctgttttaccaaaaatattcattttgacccactttttctagaagcctctccctctaacaatattcatatgtaaaaccaacaaaaacactaatcaaattccagagagattgaatttcagggtgagggaggtcttactgcatttttgccttaataatctcagtttcatctttcattccataccaaaacatggttacagggaaactatgttctaagaaaaaaaattattaattatatacccattctgcacatttagaaataaataattttccaaaaacttttacctagacaagaacccctccttacaaacagaagttttctctttagaccaatttcactgctaaccataaagaagaaaacatataagtaggatgagatagaagaaaaatcagaaagcagagaaagactaattagaagatagagaaaaaaaggaagaggagtgaaatataatattcatattctagctgccaatccactaacttccaaaaaggaaagtgaatatgccagaccattaaaatatttcagcaacactagcttgtttggcagtcagagtctcagaaccatgagaatcacagttacttaatcactgtgagctcataaaactggacccaaagtgacaagaccattgggtgagaagggtgagagggagctgagcagggtgatctgctccaacaatgcaccagttccagaggtcctctgcagaacttgaagagacagcacagcatcctgaggccgttaacttcctgactcctgcctttgaaatagaaccaggaactgagcttccatggcctagtttgacctggctttgtcactaccccagttctgatgagattatgatctgctaccctagaactaagcagaggtgagagccaagatgcctttctatggcctagagcacaagaagggcccacatagtaacaaaaacactgtcacttttatggattaggcagtattgcctaaaggtttagcacccaaggctttaaagccagactgtcctggttctaaatctgactttgacacctactaactgtttaaccttggttaagttggttaacacagaggctcaggttcctcacctataaaatgaggggaagtacgaggttactctgaatattaaatgagatacacatatataaaactgagtatagtcctagaacatggtgcacacaaggtgacagctgtgccttattacagctactgcacagctgaaaaaaactgtgaaacactgaaagtcactcttctacaagctggatattagactgtgaattccccaggaccagcaaaacccagcattcccaatgcctagctcagtgctgaatgaacaagagagaaaacctcaaaaatctttcagtaatagaaagataattctggacaggtgcagtggctcacacctgtaatgccagcactttgggaggccaaggtgggtggatcacctgagtcgggagtttgagaccagcctggccaacgtggcgaaaccctgtctcttctaaaaatacaaaaaattagccgggcatggttgcgggcacctgtaatcccagctacttgggaggctgaggcaggagaatcgcttgaacccgggggacagaggttgtggtgtgccaagatcgcttcacagcactttagcctgagcgacagagcgagactccatctcaaaaaagaaaaaaaacgaaagaaagaaacataattctaagactaagaccaataatgtgccagctatggtttccttgtcattgaatttattaatataagtaggcagaattatttgttatcatgctaaagaaaaaatgagatttttttttaacggacaaggttttcttaaagcatcatatcagtatctcagtatctcctataaatagattttgtttaaataatacaatttactaaactgtctgagcagtgtggacttcccccatatttatgtttttagtggctgtagctgttgtggtggtcaaacattgagtgttcttttatgaacatagttagcataaaagaaccttttgatgactcgtattagaacatgaatttaatagaagcaaaggtactgcttatcatcactgagaacattcattcagatctaccacagttttataactgctctgatctaacagagcaatttattccaacatgcaatttaaccaataggctgtttaaccttggatacttattagtaagggaacaatgctttcaggattatgctgaataattcagcccttccagtcaaagaacttttgctggtgggtgagaacagcatgttgtctaagtatctgagaacatttctacacatctggagtatgtggccctgtgctgcctttccaggcctgctctcccagccagaacttcttctgccatggggcaagacagtggaatagaactatcttataaacttttttgaacaaagacagatgatgttgcactactacattccctgtgaattctttctgctgctgccaacttatagtatttttaagtttgctcctaggtgttttacagtagaagccattccaaataagattttgctgaaggttcagcatgaactatgcaactactctgagaaataatcccattatttcaactgtttacttttccattataccccatttccaaaatacgtgcttttaaaagttttacatcctctcttcataaatcaagttagtaaggatgtcattcctttttaaagcatgttgcatagaaacattataaaaacaaaatacataaacacacatgtatacgtgcacacaacacacttgctcaacttgaaactgagccccaggactaacaaacacacagtccagggctctggttactatgccttctttctaggatctggcttcatttggaggctcatatcccataccagtgctcctcaaaccacgttctaaggtccatgaaatattaataatagttctatggggagtgggggagtggtataatcaaatttgtggttttgccttaggacaaatctgaatcataagcacataaggctcgtgagaatctctttggtattgagtgaaccctgccaactattcaacattcacatctcattcattgttacatacaaagctcatgaagtgataacatttctttgttttaaaaataaaagagcactgaaaaaagaagtcaattgcttgtggtggtgatgaaagtgaagagaaagtgaaaaggcctaaggaagtgatggttcttggaagaatacagatgtctaggaaagaaattatactccaaagagctacctgtaaatttagaaactcatcattatctctggacaaatctttcataaatgtcaaagacctgctacatatcaaaatggtctaagttcctaagcatcatagaaataaactggacttgactgtggattctacttgagcaaaagatcctatggctgagtcttgggtatgaagagggagaagtttctcacataagcatgggcccatggggcttagactctggaaagacagctccaggggtactgccatacattgatgttggcaggatcttctgtttaaaaggtattggtggccgggcgcagtggctcacgcctgtaatcccagtactttgggaggcaaaggcaggcggatcacttgaggtcaggagtttaagaccagcgtgggaaacatggtgaaatcctgtctctactaaaaatacaaaaaaaaattagccgggcgtggtggcgggcacttgtaatcccagccactcaggaggctgaggcacgagaatcgcttgaacctgggaggcagaggttgcagtcagctgagatagcaccactgcactccagcctgggcaacagagtgagactccatttcaaaaacaaaacgaaacgaaacaaaacaaaactattggtgaaaaacagatattttagttgactggggcttaatgctgagaagtaggcctccaatacaacctgaagatggattcgtggtggtacaagtttgccttctgtgagggtctggaggaagcacttttattaacaggtgccaagtagaactgctgggtcctgaaagaacctacaagacactggggtgagaacacgtagagaagagtccaagtgcactgagaaaagtgaggcgcactgacttcagagaatggatctagtttctttcctgtcagtgaaaactgaagctcactggagttctgagacagcctctggtctcctggtccaccccaggatggctcaatatctgtaatgcagaggctgaatatgtataaatgcagaggcccaatccaagcactcactatgactcaccaaggacactatgaaatgtgaccaaagtcttccagacaaaattgcttttcagtcatgtaaatatccttttaattcatgttcttacttagtttatgtagcttatgtgaaactcgtttgtcactttctaaagatttacttttgtcggactccaggaaggattgtctaacttttccctaaatctcatggtgcttcaaataataggaacttttccctcctctacggttttgatttcccatggaagacagccatttaggaaagttacctgcatgcagatatatgcacagctaaggtaacatggaggtgtgccagtcgagcatatctgaactggccactgtctacctagagtgacaaacaaaatgtagaatcttgcaggatagctcagatcctaccatcttgacaaccaatcacagatctgtcttctatactgggttcaggcaaggcagcatgcttattggcctatatggggcatggattggcccaaaggacctgctttttctgaatttgaaggcactcagttcagggagctacacagatggtggcaaaaggtagccacatcattggttcttgcctctccatcacaatatgtcttagctttttaatagcaagaaacctgtaggtatactaaattggtggaatccaggaaaggaggagggaaaaaagtcaagacaacagcatttaagactgaaaaggggccgggcacagtggctcacgcctataatcccagctctttgggaggccgaggcaggcagatcacctgatgtcaggaatttgagaccagcctggccaccacagtgaaaccccgtctctactaaaaatccaaaaattagctgggtgtggtggcaggcacctgtaatcccagctactcaggtggctgaggcaggagaatcacttgaatctgggagagggagggtgcagtgagccgagatcataccattgcactccagcctgggcaatagagcaggactccgtctcaaaaaaaaagactgaaaaggcaaacttgatgaaaaggaagaaagaagaaactcaaaagcagtcacatctcaaaccttttgtttgaagataatatataccattcatatcacatttcagcccgtaataaggcagtgtagttgagtccattgtaggggccaagggaaaacatcccctttgctctctaaaagtttgttgaaaattaactcacaaaaggcagattaagaggagaaatggcatataaatttattagtgtgcaagggggagaatgcagggatgactgccccatatcccaatggggtacagatgcttatatacactccttcttagaggaatgggagatggggaagtctggatggttttaaggggacagtaaatgatttttaggggaacttaatgaacttaaagtggcctgggacaaagtctgttgggcccacacagcagacaatggtttgtgacaaatgtctgtccagatgtgttgacaggcttcagtgtttctttacatgctatgagctcagttaatggaaattcggggaaggaaccagagataattgttttattctttggtgcatccgaacttgaggcagataagggaacttcagggaacaatttcctcctttgctttgggagagacagaggattgcaaggcaggaggtggagggggtacagtgtcagagagacctaaggctgcttcttcagctcagcatgtcaaagtgccacattttggtgtatcggtttctgagccctgacactatcatgtcacttttcacttatctacacagggcactaagatgcactgcaccggccctcaccatgactcctccctcttgctgcccttctcactccaggctcctaaacacaggccacctatttgatgggatatttcaaacctggctttgattgtgagggtcagtttggcatacaggtgatttccttgtagattaagaacatttactttcttcctgctggatccctcccagagataccatcaaacctctacctacgcaattagttttcacaggtggctgttttgcctccagtaaaactactttctttctccttctgcaagtcaaagcacagcgaatacacacgaaaacatttcagatatgaaataaacatgttcataaaggcagctatgatgtaatgtatcatttttgactgatccaaattatggaatgaactccccacaccaggattaaagtgagaagaatcatttctggaagaaggagcgcaatgggattgtggtgggctgaaggctagaaaaaagggttagaattgagacaaggaaaaggagccacaatttatgctggcttataacggctagggttttctgagatgccttctcctttcgtaaattctgttactgttgacaatcctaacttactagagacagaaccgacagcggagaaagaaaagatgttcatacgcgtcaagagtcactggtaaggcagctgtttgttttttgtttatttgtttgtttgttttttgttgttgttcctgctgcaccagaccagtttcaacatgaaactggcaagttttgagatgtagctgtttctctggtcctttttctagtaaaaggctcccattttagaggcagccatttccaaaggaaaaaaaaattcaatgtcgacataaatcccttgaactaaacatctgtttaaactgtttctaggtcaggagtctaaaactgtgaaacactaggggtgcagacatgatttctttcccaaggtctccaagtactgcggcatgcacatatcctgccatattgtttaaacatctggctcacttccccctaaaagaaaagggctgatagggtgggttgttatggctttttgtcttaacctataacatgattttgttatttgtacagtctctaaaacaaactactgttaaacaaggttttttttttcccttactgcattatttaaaggtggatgtttcaatggcatttgaatagcatgaggggattttttttttttcataaaagctacgaactcaaggatgttcatgaagaaatagtttccttcagttcttccctatgaagaaaaactcttccagaagttccactttcaacattccccttcattaacaaaaccaagtacgtactcttgtttttaaaagtctgtttccatacccgtatttacctgtggaaaaagactgtgttcaaaatattaaaacataaacttattttaaaaagatgcgaagtggagagagttcaagtgcagctttcccaaaagcctggctcaaaccctgtatacatatggaattctgcactgcgacctcagaaggatctgagtggctatacacaggtttgccatctagattcttcacctttactactcaaaatcacccaaataatttgtgtgtgcatctgtgacgaagaacagttatgagcctacattatcaaattcagaattggagtttagggatagcaaaacgaaaactgagctgcagacaaataaagtggcccattcaataaaagtgaaagtatatggcgtaatccgtgaaacccaaatatcagggtttgtcctctgcatctggcagttacttatcctcctcgtacaaactattactgctcctgtgttatgtccatgtctctcctaaaacttgctggaggcaaaaaagcaaccctgaaaaagttcccagtttaagtgagaaagagtgatttcactgacagggcagaacaattgcccatggttgtcaaatataataaaaggattagagttttgttttgatttattttaatgtacaaaggaagaaaggagacaaacttcaaaggttttgcctctagcccagacttctggcctcagggaaacaaatttcctagtgaatattacagaaatatagaaacgactatttaaaattgaccaaaaaaaaaaagcaaatagatatccctactaagactagatacgtatttcaaaagtccaattttatttttccttcctctctgttactaagagaggtggttcaatatccactcctggccttacttcacctgcccagtcaacaaccattcttttccccatggaaggttatttctatatttaggtcatttgttttttaattcaaaagtacgtgcccaataaataatgttctaggaataaagaaactgactaaaggaagatactattataaaaatagaaaccaaaggaacccctactctctgtgcatttaagagcatttaggtgagaaaaagacatattactgtggtttctttaggaaagtaaaaacactcaatgatgaatttttatctatctgaggattacccagattacagtaagacaaaactttgcattaaccattcaaagggtccgatctgctatatgtcccctacaatattaagtacatacttctttcctggatctgttcttattttcaacagactctatttctagaatgtagaggagaaaaggatttcaaacagtctggaaaatatcatttttaagttccaatcagagaacgttaaagccaataaggaacttgaaaggaaatctgggctatcccccaacctaaggcaaagccacactgatagcaacccaagcagataataatctaatctaactttaggataagttaggttccgtgacttccctcttaacatgttcctgtgcctgacacccgtctactcatgaaatttcttttcaagctgcagcctaagcacattcagttattatcaacagtgttaagtgagtagaaagagattcaggggacaacatgagacgctctgcaagatcagtcatgagaacaaacccaaagacctactggacccgaatttattgatctgggaaaggtatatctaggtctcagcaatgttctttggatcaggatttggagaaaaggttgtatctaccactatagattggatattatatcctatttgcaactaggactatctatctctctataaatgatgaacagtattcagctacaacggaggtgttacagactgaatgtttatgtccccccaaaattcacatgttgaagcccaaccccaatgtaggcagaacagggccttcatatttggagataaagcctttacggaggtaattaagattacgtgacatcataagggtggggccctaatatgacagaactagtgtccttatcagaagagacaccggagagcttgcttgctccgtctctgccatgtgagaacacaatgagaaggctgccatctataagccaagagaagaagcttcagaataaaatctaccttgccagtgccttgatcttggccttcccagcctccagtgaggaaataaatttctgttgtttaagcaacacagtctatagtattttgttatggcagcccaagttgactaccatgaacaccaatatgttgaccaccatatccctctctctgagacagcattcctctcccttctaggatgaattcagttattcacttaacaaacatgtattgagcatcacctatgcatcaagcattgagctacatgctagagacacatttttcaatgagtttgcagtgtagtggagagaaagagttcatttagcaataagcaattctagcattctgtaatcagtcttatgttagggaagtagaaagtactacaagagtccatagggggaacagccagcttcaacaaggggagatcaacttactgcaataccaaatgtctcagatgggccctgaagaatgaatcagaactaattagctgaaggatgggatggtcaggcaaagggagaggatgtttggtgtgatgacagtaaaaaggtcctgagggctgaaagatgtgggttcctctcccgtactcactcactgtagacctctctcaagggtccatctgtagccctcagattccctcaagaagcaatcccttccttgacagctccactggcttctaagtcttcaataacacccaaatctgcattcctaattataaccattcccttatgctcaaacactctttttaattgactactagctattgcagcagggcatgtgatctatggcttatttaaaatccaagtcttagccaattgtggtgactcgcacctgtaatcccagcactttcagaggctaaggcaagagggtcgcttgagtccaggagctcaagaccagcctgtgcaacatagtgagacccccatttctagaaaaaaaaaatttttaaatagcagggtattgtgtcccatgcctgtgattccagctactcaggaggctgaggcaggaggatttcacgagccagggaggtggaggctgcaaggagccacggtcttgtctctgtactccagcctagacaatagagcaagaccttgtctcaaaaaaaaaacaataaaataaagtaaaacccaagtcttcatgcttccctcggatctcctcttcctcttatatgccccatttttgtggcccatctcagcattgattcagtgatgcagtcatcttcccctcctccctctcccttaccctctacatctatcatcaccaagttctttttcctcaatatctccagaatctatccattcctgttgtttctgttctcggtcagatcctaagcaccaaatctgaagaatgatttttattgatttattattacaaataatgacttaatactttaattaatcaaaagtttcaataatccactaatataaaacaaaatgcaaaatccaagagatgaaagcagacaggcagtagaaaattcacagaatcagaactggggaaaacagacaaatgaaaacaaattttgggctgtgagctttctagcatacagggaaaagaagaaaactagattgcatacacagttctcatcataagatgaaaagaggcatgccaacttatcagaaaaagaaaatttgtttcctggaagggatttttcagagaaatatattgcaggggagttgaataagggacactgaacacataataggaaaaaggtagttttatacaaaagcaaagatctgcatatggatcttttacatataaaatatttttaaatatttaattcacggtgaagccaacctaaggttaaatcatgattccacaaaagtagtctatagaggaatacagcaaaatgcttcttatagatagctttctgataattatgaaaggttaacctgtccctgaggttatctcaataaatgcaaatggctcaaagggccttttaaccaaagctatattcataactgacgtcacaaatgagtactgaaagtactaggaaactgggttaattctcatcttttcctatttcatttcctcagaaagactttcccaaaagaccttagccaacaaagacccccataccccattttcactttaatctatgtattatctatgaccctattagttttctcatagcatttaacacaatcggaaatgacttgcttataaatttgttgaattgatttgttgttccctgtgaatagacagtgagccccctgagggcagagaccatgtctgtcttgtacgctactgtatccaaagccattaggaacatcggtggtatgacaggtgctcatttaaaactttacaacctttcaaatgaataaatacgtagcctgttttaggttctaaatattcagggctgggcgcagtggctcacgcctgtaatcccagcactttgggaggccaaggtgggaagatcacctgaggtcaggagttcaagaccagcctggccaacatggtgaaaccccatctctacaaaaatacaaaaatgtgcccggcatgatggcgggtgcctgtaatcccagctgatactcaggaggctgagacatgagactcacttgaacctgggaggtggaggttgcagtgagccaagatcacgcctggccgacatagcaagattccatctcaaaaaaaaaaaaaaaattatatactgtacccaaaaaatatggagaagacaaagataatattttacatgaaaatttaaaagcctggcttaaaacgacctcctcccttcactccattttcttccttcattccatcctccactttgctgtcagaattgtcttctaaaggaccacctaaatataacagcttgaaagcttgatgatctaccctctggaaactctctaatgtggcatttgaagccctcagcaaccctactctttcagcctagtctcttacaactctcctccacttcgcctacacaggctaaagtctagtcaccctcccctgatggttcatgacccccaactaccaacatgctttccccatccccaatgacttaccttttcttgtgctgtttcctgcctccaggacccccatgcctcacatcctcgtctaacaaaacggtgctcatctttcaagctcatttcttgagtcatgagaaccttctttggattcttgtgaattctgaattgcctcctctgtactccaatagctctttttatgtatctgtgtggcattgtctactatctgtttcatatgaattaggtgcttagttttatgtttctgtttccactgctagattagattagaaactccttgagaacagggattacttcattggtcttcatatttctctaacctttagcatgctcctagacatgtagtaagcacaaaacaaatgttcactgaattagacatacccaaaattagaagtactaaagagatattgatggtgacggctttgggtttcaattgtaaacagttgaagacctaggtacagtacaaccatttattaaattacagatagtatcaatctccacttaccactaactgtgccttattagcaattgtttcatgtagtccttgtttcaggaaacttatttatgttctagtacatatgagtaaatatacattttaaactttttttttttactaacagtggctcatgttacgaggtcctctactatattaaaaacattttaatagactttgtccacagactgaacttttactttttaatgtgatatcacatataataccacatctcattctctacagattctgaaatgattcagggacttttaaatcagcatttgccaataaaaagacaaatttttcaaattctgcatcatatgtaaaactagctctttttcctttcctttttttaacattacagaagacctaaaaccttatatttgatgaaggttctaagtacaaggatcaaactataatcgtgtcatttcttcaatactttcagtactgctccccgaccaggatttagtttgccaaattacgacatcattttcaaagtgctactaatcaacagagagggcaatgaatgaattcacccatatacatctgtcaggctattgagcgataaagcatggtattgagacatatgtgttcttaccatctgcacacattacagcaatgcactgcacacatatatgtctgaacctaatgttacacgtgaaaaagaaaagcattcatgccaaccctcagtacaattcacatcacatcagttctacaattggtggctttatgttactctacatatacctatatgtcccgatttttttttcttgtgaaaaatgattaagacacagaatcagatatactctttaggagattagcttcaatcttatgctaacaaaatcgcagtcaccctcaaatggagttatggcaagcaaatttgctttctcagaactcataatttttactttactcctctgaaaactacagagcggcaaggaagttgaactgaataaaaacaaaatggcaagctatatatattgattaattttacattatatattttggaagggcaaattcattatttatacaggtgctacctgacctccatccagcaagttattcattttaacctattaacaagcacactataaacaacaatgaaagttacatgaccttacacagctgtctcaagccactgtacttccatcattaaggaaactgttagatgaccctgttgtcagaacacactaaatctgtctgaataagggaaaacaaaactttgtctccaaagggtaaaaaataataataataatcctaggcagagttcctgttcacactgtacagttactattattatttatcatttcttatttacctgtgtttttagtataaacattcctggaagcttttatactgcttgtggcacatagtcagttgcttattgccaagggaaagactttttccccagaaaggcaatctgtgcacatgctaatttgaaagacagggtaggagctgcaagtgttttaatagcccattatcaaaaattatcccttggctataaaatccccagaccattggcttgagatcagctcaaagaaaaatgagattacagaatttaatctagtgaaggggagtgagagatgagttctaaaaagccttagatcacaaaaaaaaaaaaaaaaaaaaaaaaaaaaggcagaggacagaaacaacatcagcttagattaaaccttccacacatttacctcctacaaatctgacatgttccaagactgattttaattttaaaaagtaaggtgtctctttgcaacattttaataagtagggaatgctcagtgaaaaattacatattgaggtgacaggaaacaaaacagcattttgtcttaaatttgcacaacctaatttatagcaataaagcagaacctatgagttctggtaaatgtcagggcagtcatgtccattacatatgtggataggtatgaagctgagtctccgtaggcccttcaaaaattgcacacagccgccctaatgcaaaccagaagtctcaggctgctggatgaacactcagattcgctcccatgtggatatttagagagggtctcctccacccccatccccattctcacgtatgcatgttttaagagaccaaccagaggccataaccatggaggtggctcattagaagagacctcccaccccaacaaaatctggcccaaccccctgcaaagaaagcaccagcgtcccatagaacctccccctctccccctaacctctactctcttacttctcctcccccttctcctcctccctccccacacccctccccatgagcatctgcctggcccaatctcgcctgggccagctccaataacaacatctgcttggcagcttttcaagcccacggatagttatctaactgaggcttttgtgctgtactgtttattctatgtgaagaaatgcctccttagttgaaagagtactttagaaaaactgtgcagctattagcaagtgaagcacaaggctaataacccccacctgctcatcaaattaattatgacatctgagtcattataactcagaaagaaaacacgactgcagatttgtcacatgtaggaataaacatgtattaggaccgggaaaaaaatcagaccaagagactcagctggacgaaacacatgcttccacctttcagagactggaaatatggatcctatctttccaagtgaaactgacgaagagggatgaggtggttggccagataaccacactgctgttacatggagcaaaatgagataaagtcagggattagggaacctcatggaaaacactgtaaggttgaataataatttatttagaaaaactaaaactctatacaaagccatttcacagagcaaaacaaaacatactgcccacaatgaacgtgaccctgtgtcatctggtccatcttaaaaacactcataagaactctgggtagagaatttttgtccctaggtacaaaagaatattttaagggtgctaataactttagcaaagaaataccttagaagtaaaaataaaaacttgtcatgaagttattgcatttcctaaccatgagtgcataagactagtatttttaaaaggcaaattccatccagtggccattaaaaaattacatttaatagtcagacatgtaacagtatatctcgtgatcagtaacattttgctaatatttcatactattaaaaggcgcaagtttccattatacgttttgaacaaacttaaaatagctactaacctcttttttcccccacatatttctggaacttgcaactatagcatacatgttaaaatatcttactcccaatttttcaatctggctttttgtcgtaattttaaaatgcaagtaaattttaataaaggtaaaattattttaaatagaacatgacttaataggatgatgacccatgcaatagagccatgacatttttccttgccattattttaaaggaaataaattataacatgatatttgcatgaatcataaaatgctatcatttaaaaacactcctactgaaaatgtttgcagctataaatttaaagcctcttcatcttcctgcaatatctttagtattaaaagaactttttaaattcttttctagcatttgtgctgccagtttcataaaacataaatccttctatgaaagcatatgactcttgctaaataacatcggcctgctccactttatcttctacctccaggaaagtcatccacagtagcaacagctataatcaattctcgcaaaaaaaaaaaaaaaaaaaaaaaaaaattctatctttttataaaagcaaaacccccagaagagttaattttaaaacagaacatgctacatttttaaatcctttgaggtttaatatattatgaaagcaaatctcaggaagcaatacaattagtcttttctctcggtaaacaattttgtgttagagtctaatgctgagttgatttatgtaaatgtgttacttagcctcaacttaagatataaatccagagtaaacataacaatggcaatcccgacagtctgctttgccaaatcagaagatttagtcagcctagactaaaaatgaattaagattatattgagagtgtcagtcctaagtcaagaaaacatgcccagccagggcacgccagggagaaagaagatcactcattaacgagccagcaatgctacaaagcttttgctcgtctgggaaaacatgttcccagttttaaactccacagcaaatcaaggcactctttttaataagtacattttccgtctctttccccctcatcaatcccaaaaagaaactcagcttctctgtgtattatctgtgtaactctacatgtcaaactacaataggccttgtatcctttaaggtaacatgggccagtgtctgaggtggagtggaagactcggggctgtggggagttaatgcctcccttctcaaaataactttcaagttgtctattaacaactagttcccataattacatattaaatttctttaccatgataggttacagttatacatcccaaataaatctgactgtggagtacctgccggcagatttctgtctctgtttccccagacacattgacacacagctcagagacaagctggtcaggcacgctacacagaggtccgtctgtcctcgcctaaaaagtaaataaattattttgtgaaaaatatccttagcaaggatcagtattattgtcagtgtgactttaaaattctaaaggcatgccagaaagagggctacataaaattcagcagtttccagatcatacacagtacagagattctcatacccacttaatctcagcacgcatctccacccctacttccttcccaatggtatgtggtcttgaaaacacaaatgttcacgtttcctgaagctgagctgcaaaggaaaagtctcctcccaagaggcagagctgtaggcttttggtgcccccgaaattgttcactacagtacaacataatgtgacactcaccacaattagccacagggaaacagtctttttttcacctctgatgtcatataatagatttgagatcacatcagtgagcaatgttatctacaagtatttttggaagtcttgttaaaagagccacgatactgcaagcctaacttgaagtgtaaatggtgaatgcttctctatatctcatcttgaccactactttactgaagagtgaaaaatgacagatgcaaattatttttcagaaagtagacatttccactggtagttcttcctcctaagtgatcttttcttctctctcatgctctaccccctttctctctctagcattcttcctccctacacacacacacacacacacacacacacacacacacacacgaagacatccattaatattaagaacagtcttccgtaatgtttttcagaatttctcaggggcttaggagggcggcagccgtgccaaaattacaagctttcctctagtcagaagggatgtcttttcaaagcccagccctcatttttcagtctgatgtaagtaaatttacctctgtgtgctgggctgagcagcttttctttgtcgtttttgtttttctaatagctgctgctctggcagagctattcatttcaaagggaagttagaagcattcttcactcttccccttttagattatttgcagttactgactcttctgaaatcttagatttgaacagaaacctaaagcacagcaccattttaaaacagcaaatcaccagcattcctgggatcacatttctctagagcaactatccaacatgaggcacaagaactaagtcgaactgggctaaaattgacaaaattaaagacaaaagaattatctcttttaaaaattggggcctactgtgctctgacagcatgctaaaggacaaccatcgtttggaaacattgtttcagaaccagagaagaggtggtggagttctgtttgccagttagctaaattaactgatttcttaagaaatccaagtgaactgtatagtaaggtggtcaatttttggaaacattgtttaggcaacagataagagatagtgaggttttgttttgaagttaatttacttcatgagaaagtcaaatcaacagtcatagaccatgaagctgataagatctatgataaaatccagtgggcgaactatcagtaagttcttaatttgcccacgtcccagtgtattcaacgggcttcagttggcaatggctggaccttgctcttgttacttctgaagggagttgttttacgtggacaaggccaggatcatggtctctgagtgctccaaggggttaacctctgtgaattctacttctgtgtcacatatttaaatgagtaacttagagttcaatatctttgtgttcaactaaagtcaacttcttctttatcagccaacattctcttactctaatcgttgaacacacttgaattcatatcagttctgggattttcgtaaccatcaatcataaagtcatagtaagaagaagaataaagcgatatcagtgcagttgaggcaaacagggaagaaaaagtgcacggcgccatggttaggatatcatgccaggctaggaagactctcattaacatctcctgagtcatcccattcacaagcagtatccttgaagaatgatatctgtgtatataagtgaaaaccctatcacacccaggggcttatatccttggcatcttaatttcctagttgtgagtacttatctaaaaggacatgagtataatgctatcctatatggcatactaagaaactgatgtaaaactaagtctgcaggagaaaagagatgctacattcctgtggcaattttcaaatggcactaaaaatagataaatacggcagtaagaactaagtccctcctccctcacttccctatctctatttttcttttacatttgtgtgaattcagtaaccataatctatctaatcctattatgccaaaagactaaaagttgttgatgttcaaaactctaccagtataccaaaaactctgaaactaggaaggaaaaaaaaaaaactttcttacccttaaccaaaaatgaagagtctctcaagcatatatggatagcttgacaaattaccaatttatactgaaatatgagaagatgttcactaagaattacatgactagatactgcaggggttttttgttttgtcttgtcaagcaaaaaaggtctaggtttgccatactccattttttggtatgaggtggtgaatcaagcacaaattttctttggacttaaaacatttaaaatgcagtggaaaaacagttggggaaaagatactgttcttaatccccagatctagactatctgttggggtagttgcttcccaatcctattttctcaattgtaaaatggaaacaatatcttatccaattgaaataaatattaaataagatactttaaacaaaagataaaggtgctttacaatttacaagtatgaggtataacttaaacagctaactggaagacattaacataatctacatagaatgaccttcagagcaatatggtttgcaatttaaggaatgaaaggaagataaattgtaatacaaatgtacctttctcagagaaggctgaaaggtacaacgccaaaggcattatctgcggactcaggcttcagattacctttgccacttcctacatgtgaaatactgggtaacttattgtaaaattctgtgagctctaattttctcatctttagatgagtaataataatatctatcttgtgaaggttcctgcaatatttaaataaaatactacacatagaagtatctgactttaaaaataatattcatgcgagggaaagctgatcacacgaaaggtttcttagggactgtttgccttccatatctgtcttattaatatagcttcatgcagtcacctaaatatcttcaagtattgtaaactgaattcagattatgtgcttttttaaaaagtacatcttttctatatcaagcagaaatcaggccacaaaaaaatacttctgtaaaaagcttaggaaagaataatttttcaattcaggaaatttcttcatggtgctacgaagaacttttcttgtactgaactgctatttgtgatccacctgttaaaaaaagctcaaaacacatttcaaaaacaaatagaatgcttaaactttcttaaaagacagaatgttttacatgttgtattttgaggagattttttttaaataacaagtttttacttactcatctttaaaataaaagagaaagtaactgcccaagaaacagccttatcttttgctttctacaattcagaattttgaaagaaatcctcaaatcctccaaacaagtgtaatacacatggtttgctggcagaatttattccaagcatctccaggcaatatgcatgtgcacccgcgcacacacgtgcacgcacacacagacacacacacacacacacacacacatttttgaatcattaagtcatttggaagaatctccagaagtgtgccgaggcatgtttttggtgttttgccaaattatgtgcttctgtttgtggctttcaaatatggattagacagacgcacaagcatgtactgtttggcaagtagcgacaatggtctagtctgaatttagtaatttaagcttttcattagtcctcgtaggtgaaagaaagaattaacaacaacttgtttgagctctatctttatatccctttgtcatccattcctgttcacttgccatagattagaagccaaaggaatttcagatgtcctctgcagatagacctaaagtaagggcttcaaacagggggttcaaatgtcaagtacatttaagctggaacttgaacttttactcatccttactctaaggctataactctgcttttctgagttccccattgtacttgaacatccagtgtaccctccttttttctcacaaaaagtacagatagaaattacctaaagagataaaaggtcacttgagatttctgtttctcgtgacttgaaattaccatgcacaacagtagacttctacatggcaaagcgctcacaaagatgtttctgtctcctgtgatgatctctgggggaagctatgtccctgccaccctgcctcatgctgtagtcactctaaacttcagagaccagcatcttacgaccatgagttttggtgctaagttcagaaaaattaatcctaaactgtcacaaccatcctgatgaccagtatgtctttctaattagaatcaatgcagtaatcattataattggcagtccctccccagatcacgtggagaacaccatgggaagtgcagttgacttgcagtatttgatattttcttctgttggtaggtaaaagtaatctgatgtccaacagaaaagttcacaggaaccatgaggtaaaaaggaccaaatgttgacagtggtccattgttaattgagtcgtgcgaagctacagaaagattagtttatacagctgctgttatttgtcataacattcctaacaagatacacatgttcaatcagtcttattttgcacctccaaaactgggccatccaatggtctgaaacatgtggaaatcaaaagcaacagtgtacagaaggaagaccatgtatcccctcaggctgcctcaatggctgaggaaagaaaagaggcgagcccctgagtgagcggagcctagaatgtttgggtttggaggttagtgagtaaaacatgaacaatgaatgtgggcgggaagctgggacagaaccctgttagggtcattactaaggtataatgttattgactgttttgtggggaatttagacttttaaccccaccatgattcagaagcagtgactttcttgggacaaactgaaaaacgaactgggggaaaataattccagtcagagcacaaagctaaccatgtcacttgtccactgtattttccagcagtagaacttcacgctacttataaactacaggcatactgaggggaaaaaaatgtgttaactaactttaggaaactttcactcaaacacctaagctgaaagtccacaataggttcaatacaaaaacattatcagtactatctataaaacaggtgttaaaaataaggtgtttcttatcctcaggaatttttcattttagtgaggtagggagaaaaatatatgcatacacacacagagagagagacggacacagagagagtgtgcctacaattcacaaagccctttcacacacgttatcaaaatttatcctcaggagtgattgttaacaatgccatcattatacagacggcaaaaccgaagcacaagtcccagtcactggtaatggaaccaaaaatggaagccccgtcttcccatcatatcccctaccttttctacgataataagaggatattacatctactaatcactatgatgaaaaaagtacatcatgcctggaaactgaatcctgttttcaacactgataactagattctccaagttgtatccccttcccactactttcacacaaacattttacctaagacttgaccacctgagattgagaccttattaaatcctcatcaaaaagggaaattaaggctaacagtgatcagactgctccatagagaaggcaggtcaaaaggtacgacttcaaagaaagaccctcaaggcaacagagatcgatataatttacttcagacaataaaacataaatctaatttgaaggatgttgctcatctacaactcaaagcacctaagatattttccaggatggatatttatgggccacaacatgtactgctgctagtctgtatttgctccttctgcacactcctttcacactcttcatctctggttccttatcttattatgaactggttgaagaggccatctcagacctcaatagaaggtacacttaccataaagctcccaaatgtaaacaatggtcctgtaataatgatgtgaactcagaaggtaagaatgatgtttagattccttttgcatatttctcatctaaaacaattttccttccctcacatctttcgtgctttgattaaagcaccaaaacacaatgacaacacaaccagcgggattgctctgatagcagctgaagtgcccattccaatcgtattaacttgatccaagatggtacttcaaaatgacacactttggaaatgacaggtagaatccaggattttatttcccaggaagaggaattaatctgagtcctgtatatctagtttagtacaaagtctgctaaggaggttagtcctatcctggatcagcctcactaagccagcttaggggctgatctaaaataatagtttaacaaaatgcctgtgtccaaaggctgattccaccacttgctagttgtgtgaccctgggcataatttttctgttctttcgttccctcacatgtacaaaggagatactaatagatcttgcctcatggggctgatgtaaggaatagatgaaaatacgcacacacacacacattcaagtgtttaaaagagtatctacattcaccacccccttcaagcctttacttaaatgttgccttaccaaggaggacctatcctaatcattttttaaatacctcaatcttctctaaccctacactcacactttacttattttaaaactagattagaggcagtattttctatcagattagtgctcctgtggtcagtattcaatttataacacaccttaaaagaataaggcaattcattgactagtcttctcctgtaacaagtagctcccagggaattccacttccacaggagacaacgttaggcaaggggggactcaggatgacagctcagtgtgggtgcataggaggtgtctgtggttccttggaggatgcacctattttgtaaataatgaaatttactattttacgagtagtaaaatagggaaaagaatcctcaggtatagaaggtggccagggagactacagaccgaactgataactggtttccttggaggaagactaggattcttttatatgttatatagttgtgatcatttaaaaaataagactttcttataattttctggagattcattaaactacaatacttcatatgcaaaggcaattatggcaatacataagttacatagctctttgtgccacaatatgtacggtgagccaaaatgggatattatatttttctagaaaaatcatttttaccctctcaaatggttgtgagagcagcaaaaataaaaacctaaaatctgtattgtggttgctaacttgaaccatgccaatgaacattcaaaagattaatcaaaggcttgacagttgttaacagttcaacatggttcccataattatccaattaaacatataatgcaaataatagaagtcttatgggttccatagagcatgaatatcaggctgcttcagaaaactattaactgtaatgtactgtctgctgagtctgaagaaagtgaaaggagaactagtacatttataaaggaaggcaaggagtagaaaaatagagtggagagacacgtaactcaagcactctttatgtggtcatataaacacaacagacagtggtaaaatccagaaaacaaaatttaagtaacaattattgtaaaaccaaaagaatgtagagaaatgactttaccctataattcctactggctgcactatatccacagcatacttcaaccacacttttctagcttgctgctaagttagaaacatggatgtaattacagttgttggcttttgactctgtctataaaccatgcagagataaactgctattagtgaacataccaactccatatagttgtgttttgacattataggtaaaaacaatgagaaggaaaactaaccacagcaattataaacagcatgctccagggcatgtcaggtcacttatgaccttgactaaatgattataatccttaggttgtgttctcacacgttcacatgcacacacacacacgtgcacaccccacacgtgttttttttagggaaattaattcagtgaacataagaatgactaaatcccatatttataaatgcccagaggaacaaaaaatggatgctgcataggtcaaatatctgtactttaaaaaatcttattatatttcaaaaaaccaatgtaaactttaaaggaaaaactttgtggtaagtgttcattctaaaaatattctattccacagctctgtctactcagggggcaagaagaattgcagaaatttgattcagtacaaaaacttctgctactatataaattggatttaagttacattatttggagggcaatttttaaatatttaaaccattcccttacactgataacattttttcagtaaccattcaactatttacctcattttatttgctacagacagaaatgctgcattcatttctttttgtaaaagtcagtcttctcctcccctactaaagtggtaacaagcaatatcaagagggcaataaatatcccataaatattattaaagcatgatgttctcagataaaaaatcgtattgtgtttaatgacttttcttctaatatacaaaattatttgtacaatcagtaacagtagagatgtgaaaattaaaataatgttatattacacatggtggaccactttgcaaaagtccaaattacaagtgatgtgactttctaatgtgattactcacagaaatggcagttgataaacatagtctttagagtgtgctaaggtcattaaaacagtctcatctatttgcgtatttcttcaaagtgtacttttttaatgtgcctttcttatttggtcttcttaacaatctgatcaggaaggcaagagtagttgtcctttttacagatcaggaaacaggttcctgaaggagggcgactttcccaaagctaccagactaatgagtttctgaattaggccgcacagccaggtgagctcctcatgcagggcttcagacctgaacacctgggttcaaatacttgttcctccttttaaccactgttgtatgaacttcggtcatgactggctctctctttgtctgagaactttactttccatgattataatagcttccacataagttagttgtgagaattaaataaaacatgctatgtgatgcccttaacacagtcccaggcacatagtaagtgcttaataaatattagatgttgcggctgttgttactgttactatcatcttagaactactctggctaagtttggcaaggttaaaggattaaataaataaccacataaatatcaaatccagagattaacatttagcaaacattttagtgcacatttttaaagagattaacatttagcacacattttaaaagaaaacgaactgacataactgggtatcactgtgactccggactaggggctcttggggaatgactcgcatcagccattcttaaaggttttctagcaaaacgcttgtgtatttgtatcattgcaccactcactggacacaggttgaaggaatttagattgagaaaaactatgcaaatcaaaactgtggtaaaatgcaagcatactagtgtctgtatccactttatcttggggatcaaagttcctctgttttaactgccacattccatcctggacctaatagtttctgtgtaactaactggcaagtctagcatcttgactgaaagttcacagttaagggctctgacataatgtccttgaggacaatggactcctctttcagggcaagagcagtcctgatcatgctcagggctgcatgaactcaagttgatttggcctgagccatcactgctctttttaaaggaaatgaaatcagaagagaaaaatatccatattcacgttagggagcaaatatataaagtcagtatgtttaaatgttgtgcgttggcatccaggaacactcaagaaagctctgttgcttgtagctcactgagggacagaggaacagtgtctgtaggacaaacagatgcacatctaagcaagtagaaagaagaaacatttacagtagacaggaaaagacaaaccatacaattatttctttgtctaggtaggtaggtaggactacactgagatctcatgagagttctctaactctgcttcatacacacattattataaaatgtagcttataacccttggagatgcagagaagacccttttttaaaaaatagttttactggagaagtagtgggagtgaagctgggaatatgagctgggaaggggcagtcatgggttgaattctgactctgcctcttactagctttcggattggagagttattcaagatatttaacctcaatttctttatctattatttgatgagaatacctagttccctgggtaactgtaatcattataataaataattaatggggggaatgggacattttgttgtttttactattactaatattgctaccaattaatactaacataattataaaacagtaataataaggaggattgctgtctttcagaagagaaagggaagtcatttctggatctttccatacatcttctttctcactaagattcatagccttatctaagaagaaaatcaatctttgaaaccaaaaaaatgaatgtaatgtataggaataaggggtggcggaatttttgtcctgcaaacttatgatgatttacaaacctcataaactcttatctaaataatccacaaagtgagcactcaaaattcaaaagtttttgaattaaaaatggactctgtttagaaagatgcaaccaaaaaacttatggaaactaaaatatacgttctttgttcatctatttccttcagaaaactttcataacagaaagagcccagagtccatttactcaagtgtacatagatattttatttgaaaaatatcccaacttttcaaatcaataagaaaaacagaagaaaaatttattctaagacttctaaggaaaaccattaatctagcatagggtgagtgggatagggaagatctttatcataagtcaacaatgaagaccatgatacctattcttgaacagttggattcctaagtatggctcttgacttgcttaatcctctctttaaggacattttatttgccctatgtagcctttgtggactgcacaataaacacatccaatttcaaggtctcctacataagcagcatagagcaagagaaaacaaaaaatgagaaagactgcttagtttaaaagatttgcttggaaatcactaagattttgtatatcaaaattaataaaactgaaagcagtaactcataaattaaagataaaacaaatgattctttccaattttcttttcttgagacagagtcttgcactgacacccaggctggagcacaagggtgcaatctcagctcactgcaacctccacctcccaggttcaagcgattctcctgcctcagcctcctgagtagctgggattataggtgcacaccaccacacctggctaatttttgtatttttagtagagacagggtttcaccatgtcggccaggctggtcccgaactcctgacctcaggtaatcccccacctcggcctcccaaagtgctgggattacaggcgtgagccatcgcgcccagtcctatttcaattctttttagtgtgtcaataagtgaaatgagttttttttaatatgtagaggttatttcagactatataatattttcttttgtctcttttaccctactggggccagaggaagttcattatctagaattacagttaagaaagaagtccagcgataactgcatggatcaaaattctgactctgtcacttaactagcttgccctcagagttctcatttgtgaaagggcagtaaagtatctacctcatatggttaccagggaataaaggagtcaaacaggtgactttgcaaacaatacctggcgcatagtaaatgctcactaaatgttagctaaatggcaatggtcacatgtggaaaagcaccacagctagaaaatcctacccaccttaagtgggtatcacttaagcatcaggtcactatgtaaagccttaacttgtaagattggtattatctccattttacacaagaagaaatggagcctctgggacttcaaaacacttgctgaaagttatacagttaaaaaatggcaaaaacaagattttagatagtactcctgatttccaactttttgactatttccagggctccttctagcaagttccaacgccatgcacacctagtcaccgccccttgatgatgggacaccaccagactgacatgttcactgcaaaacctgcaacaagtctgctgacatctgaggaattggagaaattattgggtgtaccccaatgccacattctattattctttaatttgttccattaagtgcaatcatcttcaggaagcctaacacatactcactattcctccaagtttcattacagttcttgcttactcacttttgaatgggagggtgctagggccactcagaacccaatgcaattgctccagttaggagcagcgcagagtccagaaatacatcctgacacatttccaacctcctgcaaaaaaagctacatgctacaagatgtcataacaagcatgcttgtatgcttgttatgtataactaccatgtacacactacaaaaatattttttgtcatacagagaaaattatacttgttcatcacaataatccattctcatgatctcactattttctcagaagttgtcacaagttttcatgtcatttctttcagatgatgtttgtataatcactaccattactctttttataacttattaagcacttaatgggaacacttaagaaaaaagaacaacaaaaattgggtaattcttcttaaactgtctctcactactataaaatctgtaaaatgtctgtcttctctatattgcaattttaggacctggcagagtgcctgatacatagtaggtgctcagtgaatagttgttgaatgaataagccgcttcactgcagacagaatggcttttaaatgccatcataaaggggcaaactgagaaagatttctttttaaatgtcagtgttcataatctccctacatgtgcacaacataatcaacactgaactaaagaatcaacaaaacccactgtatatcaccttataagagaacaaggggaagagaagtatgaaaataagaaaacctgatcactgtcatctaagaactttcattcactttttatttgcctgaggagatggggaagtacagaggaactgagaatttcacaaactaggttcaaatctatctttgggtatatgatttgtaaccttaaaagattgaaagctactttaaaagagctattataggccgggcgcggtggctcacacctgtaatcccagcactctgggaggccgaggcgggcggatcacgaggtcaggagatcgagaccatcctggctaacacggtgaaaccccgtctctactaaaaatacaaaaaattagctgggcgtggtggcgggcacctgtagtcccagctactagggaggctgaggcaggagaatggtgtgaacccgggaggcggcttgcagtgagctgagatcacgccactgcactccagcctgggtgacagaccgagactccgtcaaaaaaaaaaaattgagacggagttctgctctcgttgctcaggccgcagcgcaatggcgcgatctcggctcactgcaacctctgcctcccgggttcaaacgatcttctgcctcagcttcccgagtagctgggattacaggtgcgcaccaccaggcccggctaattttttgtattttttagtagagacggggtttcaccatggccaggctggtcttgaactactgacctcgtgatccgcctgcctcagcctcccacagtgctgggattacaggcatgagccactgcgcccggcccacagttttcattttacacttttttctgcaattacctatgaggaaacacctatattctggaagaggcatcatttacagagaacaaaatatttaaagctgggtgttattttattgttgggtgtgtcactagatcagcccattgcttttagcagcaaaaaagtataaatttgcatcaggtcagatattttagtctgacaataaaacatacctcatcaaacaaaaaccattttttcttctgctgagttcaacagccacgcttgatttttaaaataataatgatagtcatgtaaactggatgcaaaactcaactcagctaacttaagaatatttttaaatacagtatatttgcagaatattttgctttctagattttttaattgcctatagaattatcttctcaattccaaaatatcttaaaacaaattattgacacatgacaaatatatattgacaattttgattcaagattatataacataaacaattgaaataccagaattagttttaaaagatactttacgaaacattttaagacaatgtgtataggacatacactgaaatctaagagctaaactatatttaagaataatttagatatcagagttcaatgttacgattcaataataaaaaagagattaatcaatcaaagccatttagtattaaatattttggcatctgtgttaaaattcctattagattcttttattaacttttttttaacagaacaccaaatttgtcaccaaaacaaacattcccaaaacagtatatatcaatgccaaatgcagttaatttatgtgaaaagtagactcttggttatctgtttcattttgttttggttttgttacataacccctgagaaaactctgcttaacactcacctcctctccgtgacctttccattgcagtcacacagggttccctcccagaaagctccgcaaatctaactatatatagtagttggtgagagggttagttagttgtatacttgtcccactatctttggtatttttgtttttcataaacactgcaagtgaccatgaccctctcatttctacttgtaaattactcggacaaggccatcagtatttcaccgttttttcctagctccttaaaatattgaaaacagtgctcagtacagtgcttccactccataaatgcatttctcattttttcacctttagttcaaatgttctatattttccttgaaggatatattttcataaatccacaaatgcctacttctttgactatatgatgatacatacggaatcatattaaacacataccaaaataaaaggatttaatataccacatatatattatatcttgtccttttttattagtcattagattttccaaagcgtgtgtgtgtgtgtgtgtgtgtgtatgtgtgtgtgtatatgtatatatatatatatatacatatatatatatttggtatgccaaatatataatatttaccaaaatatataatatataccaaatatataatttggtataccaaatacacatatatatatgcatacacatacacacacacacatatacatgtacatacattaatatatataatcaacactgaactaaagaatcaacaagcccactgtatattgccttatagagaacaaggggaaaagaagtatgaaaataacacctgatcactgtcatctaagaacttatgttcactttttatttggctgaggggatggggcagtatagacgaactaagaatttcacaaactaggttcaatatatatttggtataccaatatttggtagttggtgagaaggttatattttcctatatatttggtataccatatagatatagatagatagatatacacacacacacatataaatacacatatatatgcacatacatatacatacatacatacacacacatataaatacatatgcacactttgaaaaaatctaaagactaataaaaaatgacaagataaggattattatccagggacttaattatattaccagtgaaatgattttttaaatgatgtgtcatttttaatgaataagagaaaacagtcaaaattattcttcagagaataatcttactcataatattgagatatttcttccaaccttatttgtgggactaaaagtcagtgctattggaaacataaaggaaaaaaataaacacatcaccattccagaccatgaaaatgtttgggattttaaagtcttagttccttgcataaataaataccatcaccttgaacactccccgctaggcaacagttacgagtatgttcacttttatctcccattatgtttgtgcctgggattgtcttatacccaaatgaaagacctcatgaaaaatggatagtagtaaagtatactggattgtaccaggaaatttatacaagaatctatcatgtctttgtactctagggaaggttatttccttaagtaactcacaaatattgaaacaggcattgtgattagctgtggctctataccattcacattaggagtggattttgagacattacatagcaattacagtatttaaatttttgccatatacctaggaaactggaaaatttgccaaatttaatatttttctccgcactttaggcatagcattgcccttaacttaaagctctgcccacaaaagggagaccaagtcttctggaaagctcagagaaagtattgcacgtctacaatacggcaggtgcggcggtaagcacttcacaagtattttctcagtttaccctcacaattgccaaataaagtgcatgcctactccagagctcaggaaactgaatcttagaaaataaaactaatttacccaactacatagtgaatagtataaaacaaacattaaaactcacagcaagattccagaatacgtgctattgctaatacagaccctgtaattcacatggttttattttactcattcttaacattaaaaatatacacataaagtggaaatgtatttctaaaacagtgaccaatcactagtgcatatacaaaagaaagaaaacaagcctcagtaaaaaggagattttcctagtttgaggaactttcttgtgttacctcagtaacagtaatctgatttgcccctaatgttctatattcagtataaataacttgcatgcattcatccattcattcaacaaatacatattatctattttatagtatgctctcataacatttctattgattgtggtttcctgtacttgcattgtacccatcttttgttcacctatttttccatcaacaattgtgcctgaaaaacatgctttcaaactttcaccatatactgtcaaactagaaattagctactagaagtagctgatattaaactttttctaatactctaatatctctgtttcaatgtgttaatctttgccttattccagagtctcttgatatacataagcacacacagggcatttctaaaacataaattatagacaactctttcattttataaaagaattcttggccaggcaaggtggctcacgcctgtaatcccagcacttttgggaggctgaggtgggtggatcactcgaggtcaggtgttcacaaccagcctggccaacacgatgaaatccagtctctactaaaaatacaaaaattagccaggtgtggtggtatgcacctgtaatcccagctacttgggaggctgattcaggagaattgtttgaacctgggaggtggaggttgcagtgagccaagatcacgccactgcactccagtctgggcgacagagactctgtaaaagaatttctaccttaacaaaaagattcattgaaagttgctttttgaaattaaattccccttgtaaatttcatatgttttatttactaaatattaaactaataaaaaaattctcagaaacatctcttaaataaaagagatatggatgtttgttttaaacttaaaaaaaaattctttaactgagatgatacatgccacacaaaggaaaagggagatgtagtaattatcaagctaatcggaaaattacaaacacccaaaagcagaacttctaacagctcctcataactagctctgaccttttctttaaaaatctgactttcagttaaaaaaaaaaaaagttttcttataacaaatctcaatcatcttttcttatgttattggaaaattggccatatatttttaatgggtcctttctgtttttcaaccagcatcaaattttggtattagttgagtgcaatttagtgtatcttccatccacacacaaaaaaagagaaagaccatggctgcagattgatttcgttagaatacttcctatgaaaatgtataaaagaaaaaacctagtctcttgaattaatttatcttaattacaaatgataatacaagatgtttaatcattatttttcttctattttcctttaaaaattgctgccatgttttcacgaaataataacctttcattattttttgataatttacgtttatttttcctcctacagcagtaaaagtaacgcatccaaagaagcactgggcctctcttagactcagtatcccaaactgtaaagtgagaagatctgtagggattttcccggctctaaaattctacaagttaaagacctctttcttaaaaagtaagcttttatctacattgaaccaaatgagttaactattggactttgaaatgagcaacatgaaagtgttactcaagagtcaggttacacattttctatttctctttaataaataaaatgtattaaaaccctaaatttaacaagcatgtgctaaactttattaagtattgcttactatgaagaggactgctctctgccaagataaccagaaaccaaattcctaggatgctagagctaacagggatagtggatgtcctctaggccaattctcttccctgacagatacagaaactgagttactgagagggacaaagtttcccaagcacctgcaaacagtaggaccagcaatgtttttctcttccacttcagcaagctgcttcaatcactatatggcgtagagtgaatctctacatcagtaaacaaaggaatggaagaaggtaattccattatcaggtcactaaataatttagagtctaatttttctttttttaatgtaaagaccttatgttcagaaacttacatttcaaagtacattaagtaaaattatgtccatacgcagatatgtcttctcctatatgcatcttaataaacaaaaaaaattatcgtcatcccctacaaaacaaaaactgaaattaaaagaaagaatagagtaaatctaaattgtatattttcattccttctaaaaggattaaataacagaattctaaatggtttgtttgtactttccatgcaatatgtagattaaccatgaaattctgtttgggacactttgacatctgttttcagtgcgttacaatgaaatctggggacttgatacatacatttgctgtaataaaactgtcactaatcagtgttttccaaaatattgcccataactattactattcagtagtctcatttgcatgatctaatattgttgctacatcatgtttttccctgacaatgtgttagctagtcccaggcacatggtcgaaaatggctgcaaaccactcaataatcccagcatttccatagtactctgtatatatgcacgcaatctgtcctagaattgaaccaacacttcatccttcatgaaatattttctctgtaactggaacacccaaggttgaattcacatccctgagtatgaaaaactcaacaataataaagaagcccatggtgaggaggaaattacgcctcatgggccttccacaacaggagacgcaaacataatccttactcagaagtcccttcaacaaagctgtaatgatgatgctttctgaacataagtgcggagtctatcattaacttagaccatttctatgaactaaagaataagactggactagactttaaaacggagtctacttccctttctctaggattagtagacagccttatcaatgccagataccaagagccacaagttcacaagatattaacacaaactcctggatattagattgaaaaactgtttccgtttcatattgcatatatctggtatgtcatgtacaaaatatggatctcaggggaaaagtaagtctgacagcccaaacatggtattcaccaaaaaacaaaaccttactaaaaacagtctgtctacctatgttgattctaaatgaattccgtattttatcagtacttggcattatattcatattgctcaacagtccaaaataatttcatcttgtcctcccatgaactcatcttaaacccaaaatatgtttctccatgcacatgttttatattatacgaatgttggacacgaaaagcagattaattgtaggccctaatgctgtgtttgttagtactaagaagtcattccaaatgttccaaaagggattaatgtagtataacaagtctatttaattactgtaagaccagtgatcctcatattactataagcagcttttcccttatttggagactgtaaatagaacagaaattgttacatgataactataagtcatatcctaaaatgttgatgctttaccatcaggaataaagaaatatgcaagcatctctgagaggctatgaaaggcaactagaatttaacaaccatgtatacgctcccactttaagtgaacatcaactttaaatcataagtgtaagcaaagcttttcaaatacattagaaagacatcatatcaaatctttctgccatcaacagcaatcccagtttacatatgtttaaaaactgtggctgcactttgtttcatgtatatgattttcgagttttgtgtatcccatgaacagaactgctactaaacaccagtgtgttatcaaaaagaaaaggaatgccacagattattaaaaattatgtgccagaatccaaacaagctaatcaatgtactgatcctgctttccgtacaccctagttaccctttaactaatggacaaacagtgaaataacttttcctattaactcctggctagaacccctaggtacgtgatacacttattataaagtgctccatataagaatatgatgcctttttaccctacgtcaatgtgacacgtgatttaaattttcctagtagggattgtggatatgagctaatctctccactttccaaacctcctgtgcaaagtgaggggtgcagttcagtggccgtagggaaacaagcaccgaaactagttcctccaaggacctccatggacacaaccaaccagagctactgaagtcaaacacggtgatcccaaatcacagtttcgtaagaagtaaatgttgtaaccattctccacttggcttccagttgttcttagcaaaagtgaagtcaatttcagtaataaatgttaacttatttcctacggagctcatttaattatttaattttcttaacacgatagaaaaggaggaatgggaaagagtgacttaaaggagaaaaattaaatggcaataaaatcaaaacaattcatgcaactgattaaacggtttgaggttttgactcaactaagggtcatttttaaatatgatactttcggactttaaaaagagtctgaaaaccagcagcatgcttttttaaggacaatccagttggccgggcgcggtggctcatgcctgtaatcccagcactttgggaggcccaaggcgggcagatcacgaggtcaggagatggagatcatcctggctaacactgtgaaaccccgtctctactaaacatacaaaaaaaaaactcagccgggcgtggggaagggcgcctgtagtcccagctactcggcaagctgaggcaggagaatggcgtgaacccgggaggcggagcttacagtgagccgagattgcgccactgcactccagcctgggctacccagccagactccttctcaaaaaacaaacaaacaaacaaacaaacaaacaaagcactatcccatctagccacatcatcatcacttctgccgaaacaaatctaaaacgtaagtgtagttctcccaaatggtggcaatttaatttttttgtacatgacagttttacacttttattggagtgcagtgaattacgagtacttgataggacaccctttacccacaccaaaattgagttatttattcagagagccactaataaaattatttgattccttcccttcaaatatacctagattgatcaataaatttagtctctggtaaatctgagacaaaaaggcttctaaaaccatacaatcattctaatttaaatgggttttaaaactacacacaactagctaacttcatgtgcctacacaaagagttttcactaacaaatattcacgcgcactacagtgagcaggacttcgatttcctctttggtatgtcttgttacctgagataaatatgaactaaatgatgaccctctgcttcatatccagtcattcctttttttcactactggatagtctccctggcagtctacattatgctattttccttcatatatagtagtaattgctattattaacattattgcttttacttacatgaattatttcatttaatcctaaagcaacacagtgaagtaggcattttaatcctcgatttacagaacagaaaagcaaagcacatggagctgaagtgacttgaccaaggtcacaaagcagataaatggcagagccaagactagaaccccaaatgtcaaattctatgcacatgatttttgttacaaaatgaatgtttgggtcttccccaaattcctacgttgaaatcctaacccccaatctgatggtattaggaggtggggcctttgggagataattaggtcatgagattggagctttcataaacaggattagtgcccttataaaagagatcccagagagctctcactcttttgctgcatgtacggaaacaaggagaagttggcactctgccacccggaagagagccctcgctggaacttgactatgctggcactctgctcctgggcttccagcctccagaactgggagaaataagctttagtgtctgtaagtcacacagtttatgttattttgttatagtagcctgaactaagacattttctgtgctctacaaaaatggaaaaggcagaagggggatatgctgaacgtcttaagcaattcaaaattcaaaggatgacagaatactttaatttgcacattatttactcttcagtctaagaataagccatctttcttaagtaattcctgcaagatctaagccccgcctttctctttttcttctaacttcacttcttcaactccctacaacacgtgtgtgcatgcgcacaccccctgctccctgcccacacacacacccaagttggataacacacaagttggactagaaactttaactcaacaggtgagatcaccttaaaattctttcgatgtaggaactgaggtagacgtctggagaaaactaaagagatttttaaatcctctgggctggctgctgttctcatatcacagtctcactgtcatctgaccccttagcccaccaaccacatctaaagccaactccacattggcgctgcccctgaggatgctaatgaaccggcagaaaggcaaaagagatattttctattctagactagtttttacaggagaagagagaaaaactgaggccatggactaaaatgagattcagagcacttcattcaaccttcctcctttgacccctatgattctggattatcaacatgattcattctgaaaagcatttaaattccttgatcttgtgaacattcctgggggaaaaacagtttaaaacacaacagtaacaaacaaacaaacaaaccagaaagaaaagaaagcctctcacctgctattttcagatattttctagatgggaatgcagaaatctactgcttttttcccaggttctagcgcctgtagcacattgtctctcatctgtcagtgtatctacacacatgtataaacagtacgcaacacgcaagtaaggaaatgtacattttaacttaaacttccttttttcctctaataatttaaaaataaaatgtaacagcttggattttaaatatttaatctggcaaatataggaaaatcatgaactataatgtcatatttggcaaagaagagtttggtaggataaaaatatctgtgttttaacattttagaaggcttttccagtattttaaaaataaaattatttcactgcttcagaagagaagaacggaggtaaaattcgctatttttgcacatgaggttttcatgaagagtagaaaaaaaacaatttttatattcattaaaataaatagttatttttacatgctggcaaaagtccccacagaaataaaatcttcatatttactaatggttctctactatgtcatgaaatttagctatttaagtcacaaaagataggattcccttaaaactataacataagatggtatatataaagttacaacattaactcatttgtaaagaaaaaaatgttggttttaccctacatgtttagtatacagattttttcagtactagtcaaagatttatagtgttaagttcaaaagtcagttgttttcacatcggtaaccaacagcataactaaatttcccacttttacctcatattatgacaataaaatatttttatcgtagcagctgaaaatgctgaaaagtaattattaaagaaaccataaatataaaaagctgaaaagtcaacctcagacgagtgtggaaaaggaaattgtgatatgtaccatcataaaacagagaaactgaaaatctaagcagaaaagatctaaatccctccaaatgccagaatactatgccccacctcttgtagcaaggagggctgcaaatttgtccccatcactgtcagcaaacaaaagaaagtcacttctacagccagaccatgtcaaacagaagacgtagctactgcagacggacgccttgaatccactggtgtgtaaagggcgggcttgggcctttttgtcagctattaccattaaagaataagaggaaacagtgacattattacacaatagaaaggtcaaacagcttgcagccattccatgacccaaacaagtcaaggtcaagggattcaggtagcaacttagccagggcgtaagttacagcgcaaatgaattgttttaacacatcagctttggtcaattaaacctaacaaggcaagttgcatcaggtagcagggttcctgacaccaaggccagaagctgagaccgacctcataaaacaaggcttttaacatagcatagcaaatttaaggtaatccaaccagaaactgcagatgtcagaataataaaatacaagttgtcctacgaaggaacattttttacacttcagaattcactaatagaggggtatagacttcatattgacgtgtcattagcataggcataaatgtaatccaccactcacatgaattacagaatataccctacttcaaataactttttcctaatatctgtgctcatgattagattttttgtcccaagctctaccattccgttagcaccaatacatttatccatgtatttttttcaaaatgagtatgaaaaatcaggtttttaaaaaaacagttcatcttcattcagcatgagactatatatgtgtcgcttaatattaatggatgcttgttaaatgcttttatgtagttttatgagagatgtgtacttcaaaattcaatgaatactattaagttgactattttgagaaatagactattttgaatggagttgaagctaactaaaattttaaaactgcatgtatttaacatgaaataattcttttcttaaaggtaattcttattttatttcgcacttgtttaaacaaattccattttcaactggtttatgcttcatcaataacttactacatgttctgaactgccttaaaataggattctgaaaatacacaacctccaggcaacttttgatagtaaaattacttcatccatcaccccatatttttaattatatagtccttgttcagagatctttaatttgtcagtgattcatcagtgctgtcctgtttaagctatcatcataaacagaatatgtgtatctaagtgttttactataaacaatatagttatgcatgtaatcatctgctttcccattttagaacaattaaattttgaaggttttttaaaaatgtgtggctttcaattcagcctcaaggactttccacctcacttgttagccatttcttccaattttctgaataatataacaaccaaaaagcccaaccattcaagtcctattagtctcactctaacgttcaatctaatacaagctaatcccacagactcactccttactacaacgcacttagttttcacaagttctctgcagtttgatgatttattctctatgccaaattctaacaactaaattcagttaaattaaccgcatcacaaaactggagttcaaggtcccaagaatttactttaaaatgagacaacataccacgttgccacagaaaagtgagcatgatcagaaggaagcgtctcttcttgctatgcttggcactggggcatgcagccgtaataactcaagtttccgatcgcataaccactagtccttgagatttctaaaattattcctccttcacaaggatggagggaaaaaggctggaaaatttgctttgaacattatgttggctaatcatttgctccgccatagcacatacataggaaaaccccttaagtgccgcaagttctactttcatcaacttcaaactggaaaatgctattctttcataaaccaaagagaaacatttacccagaagctagtttcagagccagggatcgcctttgcccataattttcaggtatttaataattgaccattttaatgagtgtttcatgtgctctttgcactctttgcaaacttggagcttcaaacaaagcaataactacttctttgattataagtccattatcatgtaagccaccatgataacagaaatgaaaactaacttatctcaatttttaagaaatcctgtgaattctgacataaccttccgttgggtccctctctcttcaggtgctgaaattctaactggccagcagtgatggcaagagcgctagtgtcagaaagcaaacggttttatatagcctaccagtctagtttttcagtttaatctggctgagtgagagcttatgaggagaaagaccttgctatattgggtatcttggattgctgtttcaaattttaagtgccaaattcaaaagcaaaaagttaatggaggattacaactttaacttccttatgacagcttcttcctaaattccaaatttagggaaaaacaagtaagtaaatgaaaaatcctaccaaatctattacgaatcttcatgtttggaagtgcttcttaggtaccaccttagaaaacagtaactttaaagaactaaagctgtagcaatagatggcctctctcaatggctcctacccagctttaagtctccaggcacaggcactataactgtgcctatcaggaaggcattcttcaggagacctgaccgtcactcctgtcactgcaatgcacagtcctctccaattaccacgattctcgaacaatgcatattattttggttcttacaaatatggagatatttggaattattttaccacacaagagacattgtgcactaaatctgtaaatccaaatacataatctaactatttttcattacaaaatttgtagtgctgtatatacagggtggggggaaggatgcctaatgctgtcagtagaatattttaccaacctttgctgcctccagaaagtggggcactatatatttttaaatatttgaaaatcataattgatgtaacaaataagcgtcccatccctccctccctctctccttctctccccccacccttccctttgaaaaatgagatcatattaactgcaatgcaagagcttagtttgccatatcggaacacagatgccaagcttccccagctggcaactggggcctcagagtttaactcttaaattgtctgttaaagctatcttgtggcagagacctcatggcatagagggtgaacttctggtgggagactgtgttttcttatcagtgagaaaattgctaagtatcttatctcacaatatatgttcccacaaaggtctcattaagcctaggagcaagacatgccaataagagcccttctttatcttgtgaattgtgtatgagccagaatgcaaacaaatgtgcactagagttcacaagttcagtcaaggacaagttgctagatgggaaaacttaacagtgctcccctaaatcaaacatgcataccaagtatttctcctacacacaaactcttatgttcccagagcatttcacagtgcagacacaccaaatcatcctagagagcagcctcattttaatcaattatgaaagcttattttttcccataatgggaaatacctgcagatgaagtgaaatctattaaaatgttaaaatacactgccaacttgcaaacaattatctacttaagcttttcataaagaaataattgttacccaaaaggattctgaaattcagtaactgtaggaagaaaataattcttagcatttgcttcctcactaatgatatgtgacaaccaggaaggcttctatttcaaaaacagtaataatgattatgacttcccctgtaaataagtcacatttttcacaacttcaaaatgtacttcaattattataacatttaacaataaagcaacaaaagtggccacccaacaagagatcataattttaagggttcaacaaggctaaaggaaactactttttcaggatagcaatgaggtttctgggctctctttaacactccaaaacatgtttaataagagtgcaaagtacagtccaaaaatcagttagggtgactcattttaaactctaatctgttacatacacgacaacagttgctatctcttgagatctttaaatgtcttggtgtgttgtgacctctctcttcaaaacgctttcctgcctcagagaaaggccaatcccactcccgccccccgactcccaccaccaccaccacccccttccttttttccccttcagacaggacacagtctggcaactcaaggcctcccataggccagacttccttctgtgcagccctttgggtagaactgctaatccttcttattaattaacgagataacggtggttaactgaaaagcaatattaacgctaactatctaggaaactttaaccaaaattattttaggcttttggttgattttcccagtgtacaaaattgtgcactgagaatttcgtaacagtgtggtgcagaatcgagaaattccagaatgactgattttacctcagaccttaacgcataggtctcctctttaaagttttctctctctctttttaaacatgtattctgttacacatttctaactagagaggaaaactgaagtcctctcaaaatgttactataaaatttgcaagagtggcaagtgagggaactagaaattgcatagcaaataagcagtgatgtgactgagagcaacagtcagtcataatgaatgcatcacatatcattacgttaggtttgtcctccacacacttgtcatagcacaccctgcatcctataggacacttacatcccaggaagctgtgctgtgcaaggcttgcctggtttttgtttggttttgtttttgctttgctttcatgaatgcagtaacaaaggcaatatggggaataggtaacacctgcccaagaatcattggacgtctttaatatctttgggaaaatagataccatttagagctattttttctttaatctgtcccagtttttttagacaaaacctaaaaaaaggaagagttttatattagctaagatttgctgcagcaaacaagcaagcagctttcattcagggattgtcaaaaactttccagtgtgcccactgcaatgcggatgccaaccaacgaatcaaaggcattcagcaactagacaaagagggtctgatgccaacctcggtgccactggcaaccattattggcatcaaacacagtgtctgccttttttttccccctcgcctggcacttcacaaacaaaatggcggttcttgtagcaacgaaacagccgaagcgcagccctctgaatcaataacatcaaatgactttatggatttaaacgcagttactcccaaatgatgtgtacattttaggtgaagtgcagggagacatttaattttataaacaactatattgaacatcagcctttgctaatataaggaaatagcaaaatggactgaattgcggtcaaccagactacatgcatagtagccgaataacaaagagatttagctttaaataaaatactgcctcatggccacgtgatgcaaaagtctaatgaactatatatcaaaaatgatttcaaaaagcataaattttttcccaaaccatatcagatgcagatgtagcactatagcttgtgtcaaagctctggtaactcttcccacatttcagaaagatgaggctgctgggcatgaagaaggaaaaaaagtgtgggttgaaccaaaagagaaagagggaaaaaagaaaagcataggaagttggtcaacaatgaaactttagtacatgttggtctttatttcgtcttccagaagagatgcagtgtgtgatcttgtataaataaccaagaggactattgacatttctagatctggaaattgtcaatatattgtaacatcactccacactgcaatgcggatgccaactaacaaatcacaggcatcctgagctaaacaaagagggtctgatgccaatcctggtgccagtggcaaccatctttggcattctctctgttctttctcatgtttttctcccagtcatttagaagtggggagagagaaaaagggggaaacgtaattttgttgctctttctgctgcaaacattacatttctcttttctgatttttctttcgtgttttcctttatacttcttttcctgatttataaaacagacttaggtgagttatcatgtacttagaagacaaataaaaagtcatcactcgcgatatgcagccctctaactgaccggagaattatcttttaaaatctgccttctttaatcaattgcactataaaatgacataattaacctacacttgacaaagaagaatatataaattttgaaaaggggaaaacacaaaagcatcctgacgtgagtttttcaaaggaagaaccaacagatgttaagagaagatgatgcactggcaggtagcagaggatacaagttatatacacaagataaaataatgaaaagttcttacaatagagattgttgaaccaacaacaaaatcaatgttttatctaaaaccatggtctcttaagagttgcttaaaactttatagttatcatgaccagtggtgcaacatggaaggcatttatgcgttttttttcttttttcaatctatctctacaaatctttattgtcagttcatcaaaactaagagagctggctgccttccccaggagtaaatgtgcatgcaggcaggcacacctcaaaacctagccttcaagcaacttaaaatgtgagcagtagtgaagtggttgcaaatcttccctccctgcactaaaaagttacatgacccactttttgaaactttacttccatccttgactttcacaacacagttacaacacatttatagtcaatccaacacatatatacagcccaccttaaagtgtcacctcctagacatctgtcaatcaaataagtgtcatgtgttactgagttttattttaggacacatgggacaaaaatattattttccccaaaccatcattatttggactgtaattcttaaatgcatggaaatattaaatgcaatgtttcattttttcaggaaaaggtaatatttctaaaagtgcaatgtccaacaccattatttaaaatcagactaaaaattctaaaatgacacttaagcctatctccaaagctacaagaaaatcaagacaaaaagcacatagtgagggcctagaattcagagtcaaaaaagtaattttgatttttttgaataataaagctcatagcagtttattaagtcccacatttatataacaaacctcaggtaacagtctgtcacctggctatctgcaggccatttttcctcccaccaggccaagtttggaaatgacctaccatctgtgacagctcaaacttcagtctacttttggtatgcggctttgtaaaatgattgttttactatggattgttggtaatgcaaggacatctatatcttgatgcatttatttgaagaaaagaaattcttacctacttaaggaaaatatattaagaaaaataaaaataataaacatttcattaactcaaatattcagtaataacatcatcttttttaattatttaggtaaaatgtataccattctccttctcaggtattttaaataataggtatggtatgcagtttctgtattctttttaagatttatcttaaaccagtgtaaccagtccactttctgttttttgttctgtaagcagcgctgcgactttcctcctcggtaagttttatgaatttacatacaagtaaactaacattattaagtgttcccaagtaactctgggaacatactataaataatttaaataataactcaattccatttaatcgacagtgaatattgcacaatcaaaagtgatgatagaaatattaaaattaagtaaatctaggtctacgtaagatatacttttgatattatctatcttaagcattttgtaatagtaaacattagttctattttcagtgcgataccactaagttcataaacaaagtccctctacctcattaattaataaggttaatacaaaaattatctaggatggtttggctattcataaataaagttatattttcaaatcaggaaaagattactagattagatgcaaaaatgtagcctacgacagaaagtatagtgtaatgaactatatttgttagactaccctatgtctttgaaaaacagtattattttaaagatacttgaaaacgcacctctttgtggtctttcttaaatatccaagcctatccaggtacgaaagctctgtgtctatttacatggctcgcacatggcagcggacatgtgagtgaaagcggacaccctactatacccagagagggtggaggatatctaggggccttgaggaccatctaactcaagccagatactctgtctacggagatttgtaggcggtgtttgccgtgctagaaaaaagaacaatctgctcctaccttgctcctgcacgtagtatgccaaaaacaaatcaagctccttaactgatactgtgatatgatgtggctggacacaaagtgctgggtttgtgcaatgtggggatttcatgagccgctctccatcggtactttccaaggggatgcctttgaacaggatcaccatgactagatccagacgccagactttgtctgcctgtcgcaggcagtcgattctcctaatcttacccttctggtcgggattggataagacacagcacgggtgcttcttgccagtcacggtgagcacaaagtcctctcgatactcctggcgaatatctttgcgcagtttggcaaggagcctggatgcccacttctgtttgatttcaggcttttcactgagaagctcatctttgactgctctttcttcatcctttgacattcgcttctcatgctttttaaagtacttgcgttttcgagcctgcaggttgaaccaagtataggcaattgcacggacatgtggaagaagtgcctcgatgaatgggtgaaattcatcctgtggaagacagaggggtgaggaaaagatgtgcatagtcagtttaattttaaaagctcaaaaaataagaaaagaagaccacaacccgtttccaattcagtacaaaaagttatacatgaaaataacattcctttcttatttaaaattatcaaaataacaggacaagaagaaagtaaagtatgcccagctgtcccctttccaccaaaattcacaggtcaattctccctcctataaaggaaataaggtttatattttgtattacactctggccccatcccccttgtttccaccccaatgccatgcattctacattctttaaaatataggcaactaactaaggtgcttggcacctaatatagtatttcaatatttgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtggtaactagagaaaccggtatacagtgagggaaagtgggcaaaggacacagctcgtcgtatcagtgtcctgaacagaaggtttccatactttgagcagtgcattctctccccacactaccaacgccagctcccaacacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgcttttgtggaatctatacaattcatttgccatgtagatgaattatcagttagaactgtgggtgcatatatgcatgtgcatgtgaatttgcagatacatagattatagagtaccaatcttttgaattaagtagtttacctttaggctcctgcatttttcctgcctgtttcatccaagccctttttttaagggaggggatcagtgaggaatggtggataatctttacctacagatatttcaagttacttcccagtgcagtcagtttcgttacttcctgatttaggtaaaacctgtcttataagcttaggcctattactgttcaaagagaaagagcttaacgtcctgtacatgcacaccgcatgtacgcaataagccaagatttgaagcaaatgagaacttccaccaccaccacttttctgatcatattgactatactgtcagcccaacgacaaaataactctctgattgtatcccaagttagaatttacatactcatgttaatcaccctgaactacgtggaataaattctatttaacagcagactgactaattaattccattaggtaaatatgatgaaagtacaactaatgactctttaacaaagaaggtgtcaaaaatccaatatagatatgaatacattttgaagaagaaattcgaagttttaatgctacagactgcaacatgttagctgtttgcacttcagatatggaaggagtacatgtcccatccaatcaataatgtagttatcaagtgttctaacattgctgtaagtgttccttcaccagaataagtatgaatcaaaattttataacaatacagaatgctgatgattacatcacagcatgaggcatacccaaatgccatagaggaaatcattaaaccgatcagtagtttccagcagagatttgaacaattcagttactatgcgagcacattaaactaggccatggaaagagttaaaccacaatctgttctttgtgtgggaaggcagccctgctcacagcaaccacatcccatgataagacctccctatctccatacactttctgatgccatgcttttagctttcactgtaactacaaaaactttgtttatcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtgacatttcattttcttataaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattatgtgaattcaagtgaagcacttatttgacaaggggacatatcctccaaaaatgactgtaaattgaggtttgctgtaagtcgcatatatttctgtattaacatgcctaaatgtcatctcccaagtgtgactgtttcctaatgctgagtaacactagagtcttaaagattatgagtgacatgaatatggaacataataactgtcctgatacaaaaatatttttttaaaaggtgattaaggttttcaaatatcctaactagtagtggattattacaatagcattaagcaatcataaattctttaaaaaaagcaaaacatataagtgatttaaaaccaaacaactgtatacaaaggtaataggcaactttgctctttcagaatttttagtaaaatgcattgatgttcagtaattctcttttaaaacttcctttagttgaactaaattgacaaagtaaataacaaagttaccaatttcagatataaaaataaagagtcttaattccactaggcatatttatttttcttccgtttccatgaaagggatggataatttagaccaacatagaggtagaagagtaaatactaggtgctcttggcgcattgctatataacaacaaatcatgcaaaaaatgtacctaaagaacttaaaagcaacgaaagaaaaatatatttaatgccatcatgccaattgaaagttatattattaatggtttacattatttttaaacatatattaaatcatatgatagttcttaatttttcctttatatctgatttatactggtgtataaatattggttattgatatgctgattttgtagcatactattttgctaaacataacatttaatggtaggtccttttaaattaagattttttttctaaaacctagataccttattgcaacaattgagatacttttaaaagtttataaccaattaagaatgatactctattttgcaatttacatgtcctgagacatgtttttctacagctactaggctcttgtgatacaaaactactgatctgatacaaaagtgacactattaatgtggcctcacttttataacacctatattacctgcaaagtcacatggagcttagtgaagtgaaaattcttaagctgaaattccttccctggtgtaggccttgttttaatacataagcctagatttatattattaaaatagtagagaatattagtcatcacaagttattgttgttaagtgtgtatctctgaatactaatgtgatagctgaatgattatgctgtatatgatcccaacattccctgtctcaatgctgcaatattatctttaacttacacaaattaagataaaactagtgacttttcaatacatatttggaggatactaaaaatgcaatgtaattgctagcaatgtttctgaaaagctgatgttagaaatatagagaaatgcacaattattcaatcttttacaggtgagaataagtgatgctatactctgtaagtgaaaatcttgctttgatttgttttatttgatcacggtgtaaaaataatatcaagttaacacagcttatcagaaagagaaaaatatatccagccgatgggtaatattaatggtaacttttacaagtaaaggcaattcgttatacctgaaacagtttcatcatatttattggctattatcattcatggcttttaaaatacaaatagctcagcaactcatttttccagttttgttaaattaaagtgcgtgtttacttgctgaaaatagccatatctaagttaatcatactcagatgccaaacaaaatataaacaataaaaaatgtgtcagccaaaaagctacaggactgtatccaatcactgaataagccttatcattgttttcatcttcattcacaatttatgaatgcctcagtccttttgaatcacaatggcttctaattgtcatacaattgaaatcttaattatttgtccattataaaaatgcatcatcgtgatattagatgtttttaaaattttaacacgcccaagactggctgacacttctttatatgactagttttcatggcaatgtcaaagaaaatagttatcaattaccaatggtgacacatcttccgaaaagctgaaataagctgccccatacctttagaggtttaaaatactgcctcaaataacagttctgggctaagatattttagttactttgtcagttgttagttccctgggcagcgatgaaaactgcccccaggtaagtctgttgggtctcgccgcttttctatttgaccgtctggcttaaagtgatacaaatcgtgtttctaaaaagtataaaaccagtgttttatttcataacattattcctaaggtcttaggacaattctcaaagtcgaaaaaaatgaccttacttctaccagcattacttaaaatgccttacgagctacgcccaaatatcgtcaaatgaacaggtttccacaaaaggaacacgttctaaaaactccttaacaatcaccaagaccaactaactcgtgtcaacgtaaatactgcctttgtggtgcggtcactagaaaccccaaagtgcagcaggtcactatggaccagggtttcagatccccaaataaagcaaaggaatgggtccccggaccacaacctccgactcgattcgtcgcccgcccaccgcctgcagcgcagtccagcggcgcccacacagactcgtgctacagtcccctcgcccaagttcactggctgtttttaaaagcttagtcccccgtaaagtcctccaaagcccgagtccacctcaacgcgcgagctgctgagaggggctacgggcaccccgggcggggatgccgcaccacaacgggcacttgaggggccgcacggggcctcgcacttacaggtcccggccctgcccaccccccggcggccttgcccggcccagcgcccgcgctccgtgcccagggcgcggggctgggcgctcgcagtggccgtggcgaggggccgctcccggctcccacgccgccccgcgacgcccgctgcaactccgggccacttctccaagggacggggatgtgcggaggttaactcaagccgctaattgtccgcaacaaaacaaaacaaaggcatttcgggccagagagaaagctcgagaaagcgaccgagacatgtacctgagtgagacagatgggagaatacatcatgacttcgccttaaaacgcactttccgggagatgcccaagaaaatcttcgagaagcaagaatttcatctattcattttacagtcatctgagccccgcgatgcgatcaatcaggacggggctctgcgctggatcaccgcaacttcacaacaaacccagtcctccttaaatagccaaagattcaagttcactcggcgtgctagatttccaggggtgaaatccaatctacacttttaaccctcttgcagtccgagcgcgctggccgtgcttgccgaggccgccgccgccgccggtgttggctgcttttcgcctgggtttggggatttgttttctattttgcagttgttgttgttgttggggtgtagggggtgcgcgaaggttcggtgtgggttggattggggtggtggttggtggtaaaatgctttttcaaaaaaggcggggaggggggcgcgggagggcgcaggagggcgagcgggcgggcgggagggagagcggggagaatgtgtcaccgcgctgggaaagttcaaggttacagccccaagcactgcggcaggatcccggagtggtgatcgcaggcgaaactttgccgcgagccgaccatgtgtgtgcgcgaggggcagcgtgagcgagtgcgcgcgggtggcggggcgcgcgcgggagagggccggggtgggggcggggtgggatgggggagaagggagaggccggggtgagggagggggcgcgagcgctgatctctggggcggaagaggctcgcggcgcgtggtccccggcagcagcagccgccgccgcccgcgccgggtcttcggcgcccggccgcccgcccgcccgcctcgccccgcgtctgacccggccgagcgtggaggctgctgttgccgccgctgcccagagcccaggggtatcaaaacgatctcctgaaaaattccaaacgataaatcccgctctcccgctcggctccaaactcctctcttttctgctctaggctcttttttttccctccctctcttgctttctttcgttgcaaaacttggaagttgaaaaattcaccggttccaccctctggaccccgctcgagctctctccaaatcagacttaaggattgttttattatttaattacacaatcatcgctttactcctcctcctgcaaacgcgcattccttttgcaccagcctctccacaccccccgcccccccaccttcctcctcctcctccttctccttctctccccccacctctccctcatttgttaaaggtatcctaccggtgctacagaaccatgactttttttttttttccaaaatagctcttctttccgctgccctccccacaccagcacacacatacacacccccgaaaacccgccctggaagaggtatttcggtgctcgctgcggactcttttaagccgcgggaacatccgagtgggagaagcaccgaaaccgtctgagcccgagaaaggaacgagtggaaaattccctcacacccaggccgcccccaggccggggctggggcgcggacactcgcacccggggcgggctcagtccgcggagcctgcggctgccgggaaaagggggaggccgagcaggcggggacctgagcgaacttgggctcaagtagttggggcgcgccggcgtggaccaggggggtgcggcgcccagcccccgacggccccgcccggagcccgggttcgcggatagggagggggtgcgggttcgtcccgggtctgcccaccaggggcccgcacccgaggcagtcgcggcgcgcggcgcttcgccgcggtttgccgccctccccgggggtgccccgtgcacgtggcctcgctctgagcgggaggaccgggccgagccgccgccgccgcctcttgctccctccacctcctccccgcgcccggcttcgctctcctcctcctcctcctgcagccccgctggctggctcccaatccccaccccccggggcccggggcgccggcggaaagcgtctccctacccgcccgggtgcaggcggggcggggccgcggcgcgcccggggctgcggggcgggccggcgggcgcgcgcgcgccgctgcagccctccagaggctgcgggccctgagccgctcggcgcccgcgccggctccccaccgcggcgctgccccgcccccaccccgtcgcccgtgcaggctccgagtgaatgaacttgattccagggattttgaagaaggcggttcgccttgcaccctttctgcaccccccgcccacatacacacaccgccccccaaatccagttttctgcttggggtggatggggacgagggggaagcaaaggcctcccagacaatggagggaggaaaagtgagcgcctggggctccgagtctacctagctgggggatccggggggcgctggggctaccgggtcctcgcgggcccatccccagggcggggccgccccgcttccacgggtactgctggggcgtttcgaggctcgcccccgattccccggtcctctttccaccgcttcccagctcgtgatctgtcccctcaactttagcccctctcactccctctggtttctgtccaccgtcccctcttccctcccccagcggacctggaggaaccagtgactttttccttcaccaagtgggagttatccacatcaagcatttcacaacgacacatcaagaaaagtaggcaggttcaagtcaaccatgaaatggtcactttttaaccccgtcctgtcctcattagggaaatgctcaaacacagtccgttttcaaagagcgctcttaatgaggcgagcttgccaagtttaccagctgcagcccccgtaaacccagagcccaaagaagaaaggcgctggggggtggggagttcgggaggccggggacgggggctgctgggactaggaagacaggtaaagtcggggagatcgcgcggacccctgcgagttaaccctttcggccacacgccctgggagcggcctccctgcggtccccgcccctgccccggcaaatcctggagtcagcgttctgacaacgttaatttcctttgtgcgggtcatttcttctttttgaaaagctgggataaagttggcagtctttatggatgaaagaaatgaggtgacagggttaatccaagtaaatactcatttctctcagaaattttaggcaacctcatcttagattaaacacacacagacacacacacacagagaaaccaccagcacgaaagcatcactttgtattgcacattacactgcatcccctttctcaccctcaccagattctgaggggagggggtggggaagctctactgataataccagctttaactactgcagtttccctttgaacaaatattcaatttaactggagttaatttaccataaaagacattccccttggcaggaatgcactaatatccttgaacacacctctttgaatgcctggactctcatagaagccattatttcggggtctctttaaaaatcgagcgcccatctctccttctctccctccctcccttcttccctccctcctcaccacaccacccccagtgaaatcctggcacccagagagcactcctttcagcctgagagcccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtaagaccccagagaagtgaagacgtctggggcctcccaggcccatcacttaggggttcaaatctctttcaattgccccacgtttgagggtgcttatggctggttgcactttgatgaccatagaggatgcttgatagtttttggttttgatttgtttcccagaaaaaggaaaatgagataggagtatggtgaggcgaggaaaaccaaaaaggaatgaagagtgagcaacagagacttcctgaaaaagaaggtttatgggggtgctcagtttctatggctttgactgtcttctcaggccttgcagccatgtggagaatggctgacaccccccaaaacacttcttcttgtccagccaatgccaaggtcattgcaggccttccctggaagaactctagggagttgtttggaaagagggactggtggatttcggtgcatgggatgcctggcttctcttaacacaacacttgtccaccacctttggtttgaaaatctcaatcttttaaatcccaggtagaaggaggaactgagaaagtgcctgcattgtattcactttccattttttctagcacgtctgtgtcgtggtattaagagtggaaatatctctgaaaagcttctgatagtatcaaaatgggccaaacacttcttaaactttggtacttaccaatcctaaactcttcatctctccctcccacactgagagggttaaaagcactggtgtgacaggccactttcattcaccccaaaacctggctgaggaggcagaaagaagtgaatgattctctcagcaacaggaaactctgttatttcagtattcttaaagatctcctccctagatctccttgctgccttataagggaaaaaaaaaagtttcctttctaactaacagaaagtttattgatttctaaatagaatgccagtgcttcagctcactggatttttcaaaacccagttgtatatttgaaataagcaacgctaccacatttgagcctttcactacggatctccagagaggagcttgacatctcaagtatctaatattgtttttcttttaaccttttccttcctaaagaaattgcagcgacaggttgcaaatcctgggcagtttcatgaaagatttcttggaacttaacaaagctgtcatttccaatacactcgatgcctttttttttttttttttttttttttggctcttgcatgtggtttgcaagaaggttcaactattctacacaccctggctgcatcaccaatatcaatatttaaaaactaaatgcaaaagagacagatgacctcctgaccccagaaagcaggcctgcaaaactgcaagtatctactgcaccatgccctgggatctttcctttttccaaatgaaccacaaaaatcatacatgtgtagtctggaaaacacaaatttatatccacaaggaggaacaccaaaaatccactcataaatgcatatataaacaatcaagaagtattgaaagtgcctgtacttgatgagaattgcaaaatcaattttaccagctcaggtaatcaaattacccagctcttaaactactactgagtactactactactgtctactactcttaaacaaaaaacaaaatcatacccagcccttaacgtactactgtcaaattagggtagtaattttttccccaccagagaattcacaactggttagtttccccacccccattgctagccctttgcactgaaatgaataaataaccttggacctttttctcctcctctgggagctatttggtgtcccctgaggacaaaagtaaatgagaaaaatgacgctgttaataatgtcactgccgaaatgcctctactccactgtttaaaaaaaaaaaaaaagcatcccactaagtgtgtctacatttctagcatatttacaagttataatacagttctgatctcaacaccaactgagccagattcctccactaaggttatccggttttcacttctcaacagagatgaggccagtgcatcaacagagattcccaacactgtaagacacttgcttcacagattacaaagtcagcagttgccctgtaacttttgcatgatgtattttaaactttgaaaatagaggtaatagttgcctcacttatccacaatgttacaaaggttccatatactctctcacacagtgtctcttgtctgctgatattgagagagttgcagttattgctctttttcaaaatagctgacctataaagtaaaactatatgaccattttatttctacaggtaaactggcttctattacccatatacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcctcatcacttaggcaggaatctgtagtatattgcgtcagtgagttggagtgcttgacctttgcccacatatgatttaatagggacttttcagcgctagagctttctccatctctcataccattaaatgaaaacatcaaacctcaaatgtaaaactggaaaccacaacgttttgtgtttcacaaactctttgcagtttttacttaggatgcttaaaggtcagtttctttgcctcacaatgcttttcttcatattgtaaatacactggaaagtcacactaattctgattttgattaaatcttgaactcctcagtcatatacacacatacaccctgcttatttacacgtgcattcttttctaaccacataagcatgcgtgtgttactttctggacttattccattttagggctgatttaaatgtctgttcaagtgtgggatcaaaagttaactttttcccgcctattggaagttaaagttacaaggatggtgctataagatccgttcaaagaaagtcagagttaatcttgtgtattttggcgccttttccctgccagctactgtacttggggggtgggggaaaaatacttagagatcttgtctgtcctgtctcaagttcagtggcagttcttccaacccgagcagaagatggccatgttcacagccctaataataattctgatcacgccacttcagcatcttgtgtcaaagtcgaaactggcttccccgcccccttcaatctgaaagctgccaagtcctcacacacttcacattcaaccacaacttaatggatgggatattgtgcattaaaatgtgtctcagacgtattggggaaaagaagacaaggagaacgagagatagagacacacataggaagaggaaaaaaatcggcagcaaaaatagcggggttggggggaaactattaacaggagtggaaagaaatccatcaaaatcggttttaaaaagttggtggggggtgcggaagaaaggctaacaataggatgccacaaattcagggatgaggggatgggggttaggactaaactttagaatgaatactgactttaaacattccaacacaccaatcagagttaaatagtacttctttcacttaaaaatgtatttttaaatgagaatatctgtgaattaaaatggagaaaagaatgcttcaagaggagagaatggcctacaaggtagaactaaagtatcatttgaacagtaatttttttccaccactgaggggagaggggcataaagcagagagttaaagcagaacaaaatgctagattctgcaccgtttggaccacaatgttactcactgattcccgtcataagagtgtgtcacatgtactaaagttgccaacgctaaataataatgcatatttgcaaattagttctgcaaatgcagcactatagcccacaacctgtaaaacaaaaatgacatttaggaaaggggtaaaacagccactttgcaatccacaaacaggaaaagaaaaactgtgccagggataggagggggtgcaaagaacgaataaaagaagcaaacaaaacccatcagttcaaagccacataccatcgcactgtattgcattaaataaaagagatcttgagtctgtaacagaaccctgggccgctgacttgacgtgtctcaggtacagatttgtggattttctcaggggttgttttggtgtcgctttttgtgtttagttaaaaaaaaaaaaaaaaaaaaaaaaaagcaatccgggagtagtcttatgtattttttaattgtaatttctgcactgccacagttcttggcccgagaagaaaaggcggtcaaagtcaagtctaaaagcaggcagcccttcagtctgtctggatttccagctttctttcctctcccttgcagaaggctgtttctcgtgcttgacttgaacgccgtccaggatggtgtgtgtgtgtgcgcccgcgtgtgcgtgtgtgcatgtatgtgtgtgtgtggtgggttttattgttgttttagcggggctgctccaggagtggggctgcgccggtcagatgcagccggcacggccccggggtcgcgcgatcgccccttccccgccctcggattggcctggcccgcggcggggctgccccggaaccgccacccagcagcgcacccttccgcgcccggcccgcgctcctcctgcagtcgcctccctggctttctctttctccggctcgcggcccgccccgccccaccctaccacggccggcctgggcgcgcgggaagcgcggctcttcgcttccgcctggcggcgggaaggaaaccgaaaggaggagccgggggcgggcgcgccgcgatgcatattcatcagggcgcccgggacccgggaggcgggagcgggcccgagtgggtgtggcggcctgcgccgcgcggcgcccctctcgagcgtgggtgggtgcgtgggtagcggtggggctctggtctttgtgcggccgcatggggccggagagcggcgagggcgtgaccgtctcgggggctgctgcccaggctccgcgcgcctttgtgcttcccgaccgtgtgtctgcggcgcgccgcgggcaaggggcccctcgccggccttctggagcaggaacccggccgaaaacgccgcggaaagactctaaaacaacaataatgataaagaataaggaattgctgttacttcctcacttcccgccacgttgctggcttcaacttcgccaggccacgtttgtttccgtgtaggaggactcccgaaatgttcctggctgcgcagcgttatcattaaagcaaaaggaccagaaagagcgcactttgacttatattgataggtagtcacgcgaatatcaaaaaaatagatcagtaatttagaagtgggtgaaacaaccaacaccaaagagataatacaaccccggagttcccagaagtaaacactctagaggagattggatagtgagttaatgttcataaagcaagcagttttgatcagcattttggaaacaaatatatgtagggggattttttttttcttagtttttgagtaatgcaattcttttcatgttaagtatctgtagttatgtcgggaaataatgtttaacagtttaaattgttatacaagtattaaaagtaaaaatataacactagccctaacatttacttagtagtaacccacatacatttagaaaagattttattacagagatcctgactaattatgtaattgcacaacagacgacgatagcttcaggtattctctaaaaaccctgttgaattatgtgattaccagtgagactagaatagctcccgatgaattattcttatctctctactaaatgtgagcacgtcagtattttaatctcaattatgtttaccctcaaagtcctagagaacttaaacgacattgttcgggttcatacctcctacaacacgcagtatttttttttaaaaaaaggcatggccttattaccaaaaaaaagttttttccccttgtatacacatcatacatacgtttggctgtgtgtgaataatatacatagctattttcagtgataataagtgcaaaactaaaagtgggattggcccaattagacttt

SEQ ID NO: 1298 - DNA, 31235 bp, Homo sapiens
tgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaacccttaccaccacctgagcaacgacaaacacatctttgtattgtacccttaaagagcccaatgagcactacatgcccaagagaaaatttaccttctgacggatgctcaaagccacagtcgacaatggcccggagcaactctggcttgagcaggaagtcacgaaagccagagctgtggatggagacataggagcccttgacatccttcttggcaggggcctcagccccatctcccccagctgctgtctccacctcatcatcttcatagtccaagagctcattgtccacatcgttctctgccataactgggccggcaggggaagaagggaagggggatctggatgggttctcgcaaaataggtgaaaacaaggggtgaagagtaggggattgaggaacagcaaaggaaaacaaagatactatttctaacagaagagctggaggggggaaaaaaaaaagcaagacttaatcacgagcacagccttcaccacctcttttccatccccagttcccactttccctaaaccaggaaacttttacctggaaagaaaaacagatacaaaacataaaaacgaaaagcaaatataacagaacagaaaaagcagtaccagggaaagtggttaggacagaggttcccaacaagattagcaatcacagtagcggaaaccagaaaagttggaaggggaagaccaacttataaattcttgatctgaaagtaacagtgaggaaatagaatagataataaaaggtaaaatacgactaataacttagtaaagtggaaaatggagatgacaagtagagtcctgaaaagtcctcaaaggaagactccgctttccctattataatcccaccgttatggatgcctaactcagcagccatcagtcaagggtgatagatgagggtcatcactgcgcaaagcgctcacctttcgaaaagaaaacatcatatggccgccgtccacctcccatagctctcagcctcccacttctcagtatcctcccttccgctgtttaagcaagccttgtgtaattagcatgggggggaggggcggtgcaagacaaatggctcggccacaaaaaaacaaaattcatgtctccaccctacaataagaaagctaataggtgacagagaaaggcaatccccgcccaggctttaacaggatctttaccaagtggtctcacatcactgttacgctacgaaggtgagactccttttggagaaacatacaatgacaccaatcgtatcgtaaacacttggaaggcactccaaattaagttgggcaagtcaaggtgagaaaaatccaactgggcccagaaaccagctcctcctcccagtcccaccgagggccgagaaagagctcaagaaaggacaaggaaggtgagaagagccccgccctccgcaaataccaagaccaagggacgccgagcgccgcctctcattgatgctgaggcctccaatatgagaagaacccattggaagaagggagcaaaacgaacacaatggcgccgaggacaccatcttggattgggtccccccttagcttcccttccttcccccaggagctctttgctctcgaaagggatgcaagctaaggaaatagcgaaccaactaggccccagcgaccagaccatcgcctgtgaaaagggtatcaggaacccatgtgacgggatgggtgcggagaagcgcagatggaaacggattgtagcgaaggccaaagcttacctaaacagggagagcgcgtatggcggcagcaacagcgacgaaggagggaaatctgccttcacttccggttgcaggcttccctctactccagcctcccgccttcttggctgcaagagcgcaggcgcaagggaccggaaacagggccttccgcggttatacagatccgtgcgctccaggcttgcctttggaaaatgcctgtctgaaatttgttttaaaaccgtttctaacttcactgctaccgccagtaacaaaagatataaaggaaactaacgtctcccccccactgttatctttattctcttatcctactcctctccatgcccctcatctcttcgtttaggtttttgccacgcaggtcttctctgtaggcacccctccatggatgcgcgaggaacgagtgtggcgaaggctgcgagttcccacggggtccttggcccggtagtgaaggtgacctgaggactgctgggcacgcactaggaaccggcaggccctagctgaggggagggaggagggaagtctcagggaactggattgctcgggggtgtttcccgactctttcccagtcgtggggctggtgggcggtattttcccaaaaggatgctgtccgaggtagctgatgccctagggccagtgagtcaggaaggtgttctgaatccgagcgggaagacggggtctggattcggccccaagtgttaatagtagggcttgagggttatactacattccattaatactgtttttgtttttgttttgagacagagtctcgccctgtcgcccaggcgggagtgcaatgtcctgatctcggctcactgcaaccgctgcttcccgggttcaagcgattctcctgcctcagcctcccgagtagctaggattacaggcgcccgccaccacgcccagcaaatttttgtttttttagtagagacggggcttcacccatgtatgacctcaggtgatccacccacttcggcctcccagagtgctgggattacaggcgtgagccaccgcgcccggcccattaatactgttaattcgagcagaatgttcttggccccgccccaacagccccattgttcaacctggatttttttcctgaatgaaacatttgctatccccgtctttgagatggggagctacaaaagtaagacctgatgtcctgctgtgtaataaaacaacaaacgtttggccctctccctgttaacatacttaatcatttaatactaaggagtaggtaccgttattctcatcttattgacagaagcgaagcaaagcaacatatctcaagcagtacggctggtgaggttacagccaggatgcaaacatctctcattctctattgtattctgcctccctgctcaaagaatctggttagtaaatacactgcaggttaccttattggttcaaattcttggtgaagtaagcttgtcttcagtgacaaatgaagtaactaattcaagaatggtgtcatagaaggtattttcccaagtatcatttaatttattcaaaagtatttatcaactgcctcccttgtgccacatgttgtcctaggatctggggacacaacggtgaacagccctgttctcacagtgtttacattacaggaaagaaaacacataaacacaaatataatgtcaagtatcgataagtggtcagggtgcagtggctcaggcctgtaacccaacccttgaggaagccgagcccgaaggattgcttgagcccaggagtttcagaccagcctgggcaagtgagaccccatctctacaaaaaattttaaaattagcaaggcatagtggcactcgcccgtaatcccagctactcaggaggctgaagtgggaggatcatttgagtccagggggtcaaggctgccgtgagctggaactccagcctgggcaacacagcaggaccttgtctcaaaaaaccagtagcagtaagtgctatgaagaaaatgcaaggtaaaggggcaaagagcacttgctcctacactccagcttttctctacagttgcgatctatagtcctcagattcccaaatgaggaaccatgtttctcactttagagaaataataaagtactacttgttcttgtttctccaagaagtttcaaaggatagccatttgggctgtttagggaatatgtaaacaaaaaacaagaaagtgactgaaggccaggcacagtggctcacacctctaatctcagcactttgggaggccaaggcaggtggatcacttgaggtcaggagtttgagaccagcctgaccaacatggcgaaaccccatctctactaaaaatacaaaaaatagccaggcgtggtggcacacacccataattccagcaacttgggaggctgaggcaggagaatcgcttgaacctgggaggcagaggttgcaatgagctgagatcacgccattgtattccagcctgggcaacaagagcaaaactccatctcaaaaaaaaaaaaaacaaagtgactgaaaatgagaaatgatgaggcaaaaggaggctgcttcaactcaccaatttatttgccaataattattttattgatactttttttattgttacaatgggaaagtaaggtgtcaaggatatagaaaggaagggcatgcatatgagggaacacagtatcattttagatcttagaaagcaatgagcatctgataagtctttggggaaataggaaaggaggaaaatctaataaagacaaagatcagcaaaagaaaaacaaagagaggctacaaaatgcagttatctacctggaattataagagaggggctaaatgtagtcatctcctctttttggagatcagaaggtctctgggaaaagagaagaaccaatttttcagaaaataactagggtcacagaatgaacaagtggaattagagagccagtgatggacgtgaggaaacagctgtgtaggttttgaccagtgagcaggtggtggtaatagtatcacagggttgctacttactgaatcactgctacaacatgcaaggaactgtgctagactttacagaatgattcctaatcattgaagcaaccctcacaaggtaggcattattatcatcccagtttcacagaggaggacatcgaggctaccaagttaagtagcttgtcctggtttcacagccagcaagtgacagggtcaagagagggacccacatcggccagacactgaagtcaggatgttttccacattcctacttccccatattacaaatttcacagagggtttaggtgagaatgacttggaagtttacaaagtcccagtgagggttaaagaacaacaaggagattcagatgtgagcaggatatttataagtgtcacaggaaaattattggatcctgcctcccaggatttctaggggatggaaagaagacagggattatggtgggaggtgattttgattggaggatttctttgagggagggaactggcagaaggagtcaggccctacggtggccctaggcagaaatccggtagttggggtggacctggggcctgacgtcgcagaccatgccaagaagctgggccaggacacgctctcggtttctctgctgggagctctgcatgccctgcacctggcgccttgtagcctgctccacctcagcagacaggttcccctgggagcccatggcctggggggtagggagaggggtggaagagagaaagggaaaagcagaaacagacaagggtccaggcatatgaggggaaagatcctgaaacaaagcctagaagaaaggccctctcagaaaccacccccatcccacagaaatatcccaacaccaaagagatcaacacagtcccctttccccttagacctaacatgcaacttcatcctaaaacagaccgtaatatccccaccacctcaccatccatgaccataaaactctaccctccaccacaaatgttaatcatactccacatagatgttatactttacacagactgtggcattccgcccacaagctctatgtggccttcaaaactcccagactctcctacatatcatcacaaagtttcaccaatgttgtggtccctgccagggtcccctcagcctcagccctctgccaccatattttcttgttgagtcacccttacacacctcactagatgcacccaccaacttgcagtggggtctcaacccgactctgcctcaactcaccgcctgctgcttgctctggaattcgtgctctcgctctctgcggtattgctccacctccatctgtgcctcctcctttgcctgcttcagtcgccgggccttccctggaggcagaagaaaggacagtgagtggggatggacccacacacacacaatgtaatagcaggagtcagtcccttccagaaagttatacagccttctctcagccaaccaggtgccagattctaatatccatccatttcttccctcctaaccagcctccagaccctagctgtctgtcttcccgccagccttgggttttcccaaaatgtttgctgtcccccacccccaattttctttccaaactcctaagggaggaaagaggagactcactctttctggcatctgccaccttctcagctgcccgcttctcagcttgcagaagctgctggataccttgggactgactggccatttctgttgttatggccgatgctgttttgaatgctgtcaaagtaccagatggctcccaccccccaccgcttacttctcctcctccagctcgttgctgcagtcctccactacccctgggtcttagtgctcccctgctcactcagcctcctgcaccgagtgtctctcccaatctcatcctcctattgatgactggtcctcctctccagcacttcttgctcaggcagtacccaaaggggccgcctgggagcagcagagaccaggcccaaagctgcgggcttacaacaggttagccatcccagtcggaaaggtctagggatgaggcaggggcggagacgggggagtactgaggtgagagaaggagaacttgattggtggtaacagaggaagcataaagggttgtgaatgcggtgaaaaggtaaggatgtcatcatgcaacctgtgttgggaaaagagcattctgggcttaattctaaactaactctctacctttctctctctctccaccatcccgccccctcccctgcctcccgttgttaacatctccatctttttctacatatttctcaagtccaaatttttgcatctcacttgccccatcctacgatagtcttcttccgtcttttgtctgtattttttctttttttttgatctgtccctgttgttgtcccactgtggtttttgtttttgttttccatgtttaatgtgatttttatcctgtctttatctcctctattttctctgtcttctcatcttttcgtccatcactgaaccatctcctctctctgccaagttagaggaggcgggaaaaaacctccaaataactctcttttctccctcccctcccctcgcctccttttcctcgcctccagtccagtcttctggtttcagacggcccctttaatttaagttccctagtttcccctgggagatctggccaagaactacccggtcggggcggaacgacatccggtaacgcccctcacagttcacttccgtcctccacctgcgtctctgcttgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccgggtacatgatattcaatttctagatcattattggagattatctgtgactttttaaaactcagatttctgctgataaaaattttccccatccggccctgttgggtttttttaaagttctttgttaaaaattaaaaatttacctgggctcctgagccttaaaccaattatttacccttttctcgaattttacattaaaaaaattaaacctctgatcctatcacccccctcaaaaaaaattttttttcaaatctatcatctgataaaggatcagggttaggttaggcctcatctcttgctgaagatattaaaaaaagacggaaccaaagggagaaacaacaggggatgtcagagatggagggagaaggaccagccaaggctgaagtcctgactgctgccttttttccttccccagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtgagtctgctcagtggggaacaaggtcataagcagctgaccagacctgaaatgaaagccaaccaatagttgagaaataagctggttatttggtcatcaggacctagggaaggagttaaccaagttggcatgtggctgtcatttgtccctttacattactgagctaccattgtctgaagaacccaacattccccaaagatcaactggtcttcaaatttcacatctgtttagattagtagctactttgtttcttgacagattgtttgctcgtagccaaaaagtagcatagaaggtaggctctggagttagattgcctggattcaaaccccagctccaaatcccagctccacacttcatagctacgtattcttggacaggttacttgaggcttagtttgcccatgtgtaaaaattaaaataataacaacctttgctatgtgccagacatttcttataaagtaacacatttaatcctcacaacaatcttaggaggtgagtactgatattatcccccatttcccagctgaggaaacagggcatagagaagtcatttgccagagttacagttattcactggtagagcagagattataacccagatggactagatagagtgtccatgcttttaacagctacattgtcctgtgttatacattatagcattgtacattgattgtgcccatgttcagagtacccatgttgtgccatatatgttttgagaatcaactgacatagtacataattagagtacctggcacacacgataagcacttggtatatgctggcgattgttgttcctgtttctctgttttttgtttttgtttttgttttttatgaagtttcactcttcttgcccaggctggaatgcaatggtgcgatcctggctcactgcaacctctacctcccaggttcaagtgattctcatgcgtcagcctcccaagtagctaggattacaggcgcatgccaccacgcccagctaatttttatatttttagaagagatgggttttcgccatgttggacaagctgatctcgaatgcctgacctcaggtgatccaccaacctcagcctctcaaagtgctgggattacaggtgtgagccaccacacctggccttgttcctgtttttgttatcaacaggtccatactcccttaaccacaattctaaactcaaaaacactctgagaaccaacatttttcatcaggctgccaccaaaattcatttggtgacagaaacctaatctgaactaaagtaagactattatttattttcatcctactgatgtcaatattcatacatttccctgcagaaacactcatgtgtttggttcttgggctgcctaggccctcctgggctacctaatatagagtgagtgtacttttaggtcagccctatcaagtcccaaaaacatttgaattctgcaaaacctttggcactgaaggattcaaatggggaacctggtgatattataatagtggtggaggccaggtgcggtgggtcatgcctgtaatcccagcactttgggaggccaaggcagtcagatcacgaggtcaggagttcgagaccagcctgaccaacatagtgaaacccccatctgtactaaaaatacaaaaattagccaggcatggtggcacacacctgtagtctcagctacttgggaggctgaggcaggagaatcacttgaacccggaagacagaggttgtggtgagccgagattgcactactgcattccaacctgggcaacacagcaagactccgtctcaaaaaaaaaaaaaagagtggtggaagcagctctttataggtagagccctgcttactagaataaaagctgaaaccttctttccccatctagagatttccttctggagtaagaacattacaggaaaacctctagatccagatgaacaaccctaacatcccccagctcaagtatagacagaaggcccctcccccaaaactcccccaaatggtcaaaaaaccccctatttaaaaatttcctttaacgtacctgagataggctagcatattcagatttgtttcttgttgtttttacttaaaacagagtaggtttactgagtgcaggcatctaacttgacagctcatattgtaagaggcaggaccctggaaggcaaaagagcggattaccccgaagcagacctgcatccagaccccagctctgccatcaacagggacatgcagcttacctctgtgagcccaatttgcctcgcaaaaatgggagttttgttttttgttttgttttgtttttttgagatggagtttccctgttgttgcccaggctagagtgcaatggcgcgatttcagcccacctcaacctctgcctcctgggttcaagagattctcctgcctcagcctcccaagtagctgggattacaggcatgcaccatcacgcccggctaattttgtatttttggtagagacggtttctccgtgttggtcaggctggtctcaaactcccgacctcaggtgacctgccagcctagcctcccaaagtgctgggattacaggcgtgagccaccgcgctcagccaaaatgcccctgatagtgtggtagggatttcctttattgtttgtttgcttgtttgttttgagacagggtctcattctgtctcccagcctggagtgcagtggtgcaatcatggctcactgcagcctctacctcgtgggctcaagcagtcctcccacctcagcctccctagtagctgggactacaagcacacaccaccatgcccagctaattgtttgtatttttggtagagactgttttgctatgttatccaggctgttctgcatctcctgagttcaaacagtctgcccacctcggcttcccaaagtgccgggactagaggcgtgagccaccacacccaactccattgtattgaattttaagaagctggtgagactgatattatcccatttacagatgaggaaagcagggcccaaaaggttcgggaacttgtctgaaatctcacagctctcaggtcattgtcttccaaagggggacccaagctcagtgccttcactcccagaccctggtgtcctctctggccttatttactcctggtcctctgccagccctgccaccagatggccttctaactccttggttgaaaggcccatctcattcagcttccagcttcctttttcttttccttttgagacggagtcttgctttgtcgcccaggctggagtgcagtggcatgatctcggctcactataacttctgcttcctgggttcaagcgattctcctgcttcagcctcccaagtagctgagattacaggcacacaccaccatgcccagctaatttttttatttttatttattaatttttaaatttttatttgtttatttatttttgagacggagtctccctctgttccccaggctggagtgcagtggcagtatcttgactcactgccacctccgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcccgcctcggcctcccaaaatgctgggattagaggcgtgagccaccgcgccaggcctaaagggggcatttctaatactggagaaaggtgaacttttttttttttttttttccgagacagagtctcgctgtgtcacccaggctggagtgcaatggcgcaatctcagcttgctacaacctccgcctcccgggttcaagcaattctcctgcctcagcctcctgagtagctgggcacctgccatcatgcccagctaatttttgtatttttgtagagatgggggtttcaccgtgttggccaggctggtcttaaactcctgtcctgacctgaggtgatccacccacctcagcttcccaaagtgctgggattacaggcatgagccactgtgcctgaccaggtgaactattttataaataatattggaacatttggctcatctagggaaaaacaagagtcccacctcacacctaatcaaaaagtaaattccagcagattaaatacctgaatatgacaggaaggtacacaccaaattcatgggacagatggcctggggaggaatgaaacttggaaggcggtatcacggtaaactacctttatctgtgatgattttatttccttaaaataaattatactacaaacatgacagtacattaacaaaccctgtggtaggaatggggttgtgtattgtattatactttgtatttttgagagttttttaatttcttttttgttgttgttgagacagagtctcactctgtcacccaggctggagtccagtcgcgcaatcttggctcactgcaacctctgcctcccgggttcaagcagttctctgcctcagcctcccaagtagctgggattacaggcatccgccaccacgtcaggctaatttttgtatttttagtggagacggggtttcaccatcttggccagactggtcttgaactcctgacctcatgatccacccaccttgggctcccagagtgctgggattacaggcatgagccaccgcgcctggccgagttttttaatttctaaaaataaaaatgagtatacatctaaagtagtagaagaaaatgcagagaatgttttataatcttaaaatagagccttcctaagagtgaagtgaaataaaaagtcagaaaataatatattgatatagatttaactacatgaaaattttaggccgggtgcgatagctcacacctgtaatcccacactttgggatgccaaggtaggcagatcacttgagccaggagttcaagaccagcctgaacaacacagtgagacctggtctgtacaaaaaatacaaaattagccaggcgtggtggtacgtggctgtcgtcctgtagtcccagttactcaggaggctgaggtgggaggatcgcttgagcccaggtggggcagagtttgcagtgagcaagatcatgccaccgcactgcagcctgggcaacagggtgagaccttgtctcaaaaagaaaaaaaaagcttttttaaagatagatagaagaaaatgtttgcaatatgtataacacatacagtatatagaaccctcatatcaatatatataatttccaaagaaaaagtggataaagaatatgagcaattcattcacaaaaaatacaaatagccaaaagacatgaaaaagaaaaaaacattgttaataaaataattttttaatctatccaactggcaaaattaaaagggttgatgatattcaattttggtaaaggaagacataggcacacttgtatattggcacaaacttattgagagcagtttgaccaaattgcgcatgtcctttgactcagaaattccacttatgaaaatctacccccacagaaagactgtaagatactcatgaggctgaacattttttgaaacaaagtctatcgatattggggtaaggagatttgttttgtacacacagtggaacactaattataaagtcgtcaaaaagtatgaggtagactgtatatattcctgtggaaaaatataaatgagatgttaaatgaaagaagcaagttgccaagcaatatttgtagtatggttacatatctccaaataaatgtgtcatatgtatgcttttaggtacaccaaggtgggactggaagggatcacagtacactgttaatagttatcaaatttgttcgtccttctttaaaaagaaaatttcaacttaattatatccctttcacattaaaatgtcaaataaaattgggggaaaagccacctacagccccaccacccataggctagaatttttacatattttttgccagtctattttttttctttttttttttttttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacaggatttcaccatgttggccaggctggtctcgaactcctgacctcaggtgatccacccgcctcagcctcccaaagtgctgggattacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttagtaaagacgggttttcaccatcttggccaggctggtattgaactcctgaccttgtgatccattgtcccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgcccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccctctgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggacgctgaaatagtttgtggagacacaagtaagaatttttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcttgatctcctgacctcgtgatccgcccgcctcggactcccaaagtgctgggattacaggcgtgagccaccgcgcctggccgagaatattttaaactaccacacttaccatgcatgtggtaaactatcagtctgtatttatcagtgatggttatttcctaatacccaggaggcatccatgtgagccacccttccattgctttaagaccaagggagcgagtgaccagcaggattcaagatggcagctctgccgaggagtgggagtcccagctaacttctgctccctgctctcccaccaacagcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcactcccagtgtctcctctgtctttttccattgctgtggttttcatcacccatgacatctcctttcccgccccgcctgctgaaacccacagctcccacacacctgcaacacacacgcacacgctaacacgggctctgagctggaggcaagaagcctctgcatgccccctcagttcagccctaagaaggcccagtttgccatccagtctcactccactccctacactggggtcttgtccaccctgcaatctgtggctggagaaatagatgcgaacagaggcaaaaaggggaacaaaaccagtttccctcccctccctggctccccaagctgaaccacatcctcctccccacttaacacccccttcccccaacacagggctttccctttgctgagtcactgaatgagcgagttgggggtagccggcgctggggggccatgaggaggctgggggaggatggggaatacaagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatctctcttcctccagggccccaatcctcatctccgccattcagctgctgccccatcctaaacctgagttcatctctgggcagcccaggcatggccttccctataaacatttccttttccaagaaccagtagttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccagagcatcttatcaatcagaaacttatctttcaggttttgagcccagttctctacaggagaatcccaggagtggaagtggaaggcagtagaagacagggagggcacgcctctgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggcccaccggaccacagtcttttcaacgtcccttcctggtgtctggcccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcaggcatcctgtccagcatggtgggggcagggacaggggccagggattcccaaggggtgactcagtgcctgccatgaaacagtgggtaggtggaagtgtatctctgctctctagagctggcaccaggagttgagtctcagtggaggatgcattgggattcaattggaggaacaggcctggaaaagaataatgagattgaagagggtcagtttgaggactcaggttggggcaggtttggattaagttaggaaaaggatctgggagggactctgttcagtgtaggtcaactgagcattatgtagcccaaagataaatttaaaccctgcttcaagcttacaatctagtggggaggcagacccatacctagttaactgattcaaggcatgatgagtaaactttaagatgattacagaaagaggggagattaagtccatttgaaagcatccagggagcctctgaggagacagcatttgaacttgctctaatgaatgggttcactaggtggaggtggatggaaaggttccataggcgaataacacgtcttgagcgagcctgacaagtcagaaaatgcagtatgttctgggaaaggagcgtcctgagggagaagaagcacaggtgtgagggaacatgtgatgaagaaaggaccacagaaagtcaaggtcagagattggactgcatcctgtgggcagtggtccaggtgacgatgaaaaagagggagaacaggtgagtgctgcagtacagacaaggagtaagaaaacggccatcatcttgtgaattaatacctactgtgtgttaaccagcccttttcctaacaccacaaatcctctcaacgtctgtccaaaaggtgggtggtggtggccaggcacctcactcctgtaatcacagcactttgggaggccaaggtgggagcactttgggaggatcacttgaggccaggagttcgagaccagcctggccaacatggtgaaaccccgtctctactaaaaatataaaaactagctgggtgtggtcttgggcacctgtaatcccagctactcaggtgtctgaggcacaagaatcacttgaacccgggaggcagaggttgcagtgagctgagatcatgcctctgctctccagtctgggtgacagagcaagactctgtatccaaaaaaaaaaaaaattattaagcacctattaggagcagggcactgcttgacaataggtataaataataaagtcactgccttcatagaacttgcagtctaatgagacagtatacaaataataactatacattatagttataatgtataggtatgcctgcttagggtaataaagtgctcaatgaaggtttgaggtaccagcatgactctcaggtggagatttccagaaagcaggtctggagctcaagagaagttgggtctggaggaacagatttgggcatcattcccttcccagtagaggttgagcctttgagtggacaggatcttcaagggagggggcggagtgaccagaagagccctgagcatgatcaaaggaagagaaccaataaaggagaggttggggagcagtcagagaagcagggcacggggggcgggggatgccaagcagagacagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcgttaagggggctagtcttttgagacatcacacgaaaacggaaggtgagatagactggacatttgagggagaaatattccaaggaaggatcttttttgttgtttattttcaagaaataaaattgaaggtaaaatgaagatgcttaaagagacaaagataggccaggtgcagtggctcacacctgtaatcccagcactgtgggaggccaaggtgggcagatcacttgaggccaggggttcaagactagtatggccaacatggcaaaaccgcatctctacgaaagatacaaaaattagccaggcgtggtggcacatgcctgtggtcccagctattcactgaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaaccaacctagccaacatagtgaaatgctgtctttactaaaaatacaaaaattagctgggcgtggtggcacacgcctgtaaccccagctactcaggaggctgaggcaggagaatcacttgaacccgagaggtagaggttgcagtgagccgagatcgcgccactgcactccagcctgggcaacagagcaagcctatcccaaaaacaaacaagaaagggagagatagtgaaaacataagcaagaagtggggagagaatatagtaaagatagaggaagtgggatagagtacagataaaaggatcagtcttggaaacaagaaaaagtactgtgagtcagtatgtaaggaaagattaaatataacaaaattaaggaaaaagagggaagtgagatccacacttgatggccttaagctcaatgaaatattaatagatgagagtgaagaacatcagaggcacggagatttagaacatcacgcacagtagtataatggggagtcaacaaagaatgagtaaaagttgtgtccaagaacactgatgactctctgagattagctggccaggattagttataggcctcttatggtgactcagctgtctactgcagcgcttggcagcctaagacaaagccccaagaatgagaccacttagtttacccaagtcaatttttgagacagagtttcactcttgttgcccaggctggagtgcaatggctcaatcttggttccctgcaacctctgcctcccgggttcaagcgattctcctccctcagcctccagagtagctgggattacagttgcccaccatcacgcccagctaatttttgtatttttagtagagatggggcttcaccacattggccgggctggtctcgaactcctgacctcaggtgatccgcccaccttggcctcccaaagtgctgggattacaggtgtgagctacggtgcccggcggtaagagattctaaaatgcagacaaagtggagttgaaattgttgaccatgcagtacatgttaaatcaacaagcaaaaccaggaaagcagaagcagccggaagtcttggtaagaataaagaactgattcaaggggaggcagagagtgggagatgtgaaaagtgagtggttgtgatgagaagggtaattcagagatcaagatcttgaaggcataattcttccaagtgatgctggggtttgaggtacaaccttactcctgggtggctaaaatggaggagggaagaagaggctgtaaaaccagtagacttgagaaacttggagaattgagaggccagactgtaagactcatctgatctgtgtggcttctttttttatttttatttttttcctctgagacgaagtctcgctctgtcacccaggctggagtgcagtggtgtgatctgggctcactgcaagatccgcctcccgggttaatgccattctctcgcctcagccttccgagtagctggggctacaggcacccaccaccacgcccagctaattttgtttttgtatttttagtagagacggggtttcaccttgttagccaggatggtctcgatctcctgacctcgtgatccacccgcctcagcctcccaaagtgctgggattacaagtgtgagccactgcgcccagccgatctttgtggcttttaaagtcactaaagatggtggtaggaggccgggtgcggtgggtcatgcctgtaatcccagcactttgggaggctgaggcgggtggattgcttgagctcaggagttcaagaccagcctaggcaacatagcaaaaccctatctctggaaaaaaaaaaaaaatacaaaacttagccgggcacggtggtatgcgcctgtagtcctagctactcaggaggctgacgtgggaggatcacttgagcccaggaggtcgaggctgcagtgagccaagatcacgccactgcactccagcctgggtgacagagcaataccttgtctcaaaaaacaaacaaacaaggatgatggtagggataagatgtggagaaagactgagctagttatacaagttgttaagagcataataaatattttgatggataagattgtgctgtgaagacaggaaaagcatggcaaatgcaaaaggcacgtgctttgggagatgaggaggagtttatcagtggtctgggggagagaaaataacgacccctctcttctgccttcattcccctagtgatggaggtcgaagaaagagcaaccttcaccacagagaggagtagcatcattaggggaaagccaggtttcaaaatgcccagaggaaaatgctttcaaacatagaagacaggatttgaaaatgtgaagagttccaccaaatattgtgaaatggattggtagaagggtccttgtggggtagggaattgaatccagggaggttaaatcccagtgggaattcagaagactaagtctggagagtttagcttctaggagcaggaggttgttgcctctggaattcagaatggaagatgcactgcatccattgtgaggggaaacaagtgcctcaaaggggtcttatagggatgcacaagataagttccatggctttaaacaccatcctcatgctgaccatgcccaggtttctttctctagcttggaccttgcccctgaaatccagatgtgtatctgcccagtggcatctctacttgcatgtctaatagacttagacttaccacacccaaaatagaattttttagtttttccatccatcagaatcctgcttctctcccagtatctacatctcccacccatcaatccatcatctagtcctgttgtttctacccctggaatgtataatatatcccaaacttgtctacttctctccatctccatggctgccactattttctcttcaccatcaatgccactgccacctgtctcctaccagccagcctaaacacaggagccacagtgatcttttaaaaacaagtccaggctgggcgcgttggctatgcctataatcccagcactttgggaggccgaggtgggtggatcacgaggtcaggagttcaagaccagcctgcccaacatgatgaaaccctatctctactaaaaataccaaaattagccaggcacggtggcgcatgcctgtaatcccagctactcggggggccgaggcaagagaatcacttgaacctgggaggtggaagttgcagtgagccaagatcatgccgtagcactccaacctgggcaacagagcgagacgccatctcaaaaaaaaaaaaaagtccaggcaaggctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgaagtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcacctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacaaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacacacgcacgcatgcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttaaggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcacgtgacact

SEQ ID NO: 1299 - DNA, 45883 bp, Homo sapiens
ctaccttggcctcccaaacgctaagcttataggcatgagcctctgtacttggcctgccttttttttcttttctttttttttttggctccatcttgctctgttgcctaggctgcagatgtctgctcactgcaacctccgcctcccaggttcaagtgattctcctgcctcagcctcccaagtagctgggattacaggtgtctgctaccatgcccggctaatttttgtacttttaggagaggcggggtttcaccatattaaccaggctggtcttgaactcctggcctcagatgatccgcctaccttggcctcccaacgtgctgggattacagacgtgagccaccacgcccagcctagggcctcatccccagaaatgtgattactgggtaggcattggggtgttgaaagctcccctggtggttcaaatgttcacccaggtgaagaggcacggcccctacaatcggacaccttagcctctctaaatggggtcctccctccctctttgtcttttcactgtccctggaacacacccagcttcctgctgttgcatttccgctgttccttttccctgaaaactccacccttccttctttccctaattaactcccacctgccctcaggtgtcagggtttaagacaccccctcaaggaggtctgccttgagcagcccctcccagatgagggggagttttaccctttcacattttaacaccagccttgtagctcttgtcatgtttattcgtctgtgagtgaagactcagtttctctccccacgcccctgctagactgtgaacaccatgaggtcggggggtcacatttggttttgtcattaatttatccctactgcttaacacaggacttatttttgttgaatggacttatttttgttgaatgggtaactaatttaatagatttctttggtatttgctggacaagggacttatagattgcatcacatcaattcaagcagattctggataagacccacctttttttttttttttttttttgagacagggtctcactctgtcgcccaggctggagtgcacaatgtcggctcactgaaacctccacctcccgcattcaagcatgctcctgcctcaggctcccgagtagctgtgattacagttgcaggccatgaggcacacgccaccatgcccggctaatttgtgtgtgtgtgtgtgttttttttttttttaagtagagacaggtatttcacattgttggccaggttggtctcaaactcctgaccttgtgatccgcccgcctcggcctcccaaagttctgggattacaggtgtgagccaccgcgcccggcctcgaagtttttttgtttttttttttttaatgagacatagtcttgctctgtcaccagctggaatgcacggcgcgatctcggctcactgcaacctctgcctcctgggttcaagcgattctccacctctgcctcccaagtagctgggactacaggcgcacaccgccacgcccagctaattttttgtattcttttagtagagatggggtttcaccatgttggccaggctggtctcgaactcctgagctcaggcaatccgcctgcctcgacctcccaaacatggccttgggaatcgccatgtttgggtggacccagttgggtggcctgcatttgcatattaaaggttgccggcctggttctaagagctgctttaaaaacaaaaacctccaggccacgcctgtaatcccagcactttgggaggctgaggcgggcggatcacctgaggtcagcagtttgagaccagcctggccaacatggtgaaactccgcctctactaaaaatacaaaaattagccgggcgtgatggcgcgtgcctgtaatcccaactactcaggaggctgaggcaggataatcgcttgaaccggggaggtggaagttacagtgagccgagatggcgctattgcactccagcctgggcaacagagtgagactccgtctcaagaaaaaaaaaaaaaaaaaaaggtagaaattagagagtatagaagagaggcaatcttggaagaaataatggctgagaattttccagaactgatgaaaaatacatattcacaaagaagcaaagatatcttaagctagataaaacaaaagaggccgggtgtggtggctcgtacctgtaatcccaacactttgggaggctgaggcgggcagatcacgaggtcaggagttcgagaccagcccggccaaatggtgaaaacctgcctctactaaaaatacaaaaattagttgggcgtggtggcacgtgctggtaatcccagctactcgggaggctgaggcagaagaatccctcgaacctgggaggcagaggttgcagtgagctgagatcgcccattgcactccagccttggtgacagagtgagactccatctcaaaacaaacaaacaagcaaacaaacaaacaaacactaaagaaatccatgcctaaacacatcatactgaaatggcagagcattgaagctaccgaggtctattatttatctttgcatcctccagagtgtagcctggactagatgctccaccaattcaattacatcaagagggtgggtatcccaggttgagaccacagacaaattaaaggcaaggaggtagaaacaaatatggctataagaaggaaaagcatttttctcacctatctgaggcacacaacctggattgggggaaagtgaagttgaaaatgagagtgtgggagagggagagactaggtggagagaatttttgtttcgttttgttttagagacagggtcctgttctgtcacccaggctgtagtacagtggtgtgatcgatcatagctctcatagctcactgcagctttgaactactgggctcaagggatcctcctgcctcagtctcccgagttgctgggactacaggagtgtggcaccacagctgggtaatttttgtgttttttgtagagatggggtctctctgtgctgcctgggctggtctggaactcctggtctcaggtggtcctcctgtctcagcctcccaaagtgcttggattacagacatgagccacccacacctggtcactggggaatcctgagtgccctgcaaaacagaacacaatgggctgctcaacagtagccatggaaggttctggaataaagttcccagccggtccttctgtgggtgattgtccattttgtggtaagaggcaaaggggctctaacaccagcagagaggcagagccataggtgggagagtccctcttattctctctggttgggtcaccaggtgaccccataccaatcactgggattgaagaataaggtattccagccagctccagtgctgtgcctgtttctggagcttcaagagtgctcaaccaatgcacaaaacctacctggggcgtggtggctcatgcctgcagtaccagcactttgggaggccgtggcgggtggatcacctgaggtcaggagtttgagaccagcctggccaacatggcgaaacctcttctctactaaaaatacaaaaactagctgggggtggtggcaggcgcctgtaatcccagctaccgggaggctgaggcataagaatcgcttgaacccgggaggtggaggttgcagtgagccaagatcgcataactgcactccagcagcaacacaggtgcactctctctctaaataaacaaataattaaaaacaaaatgaaacaaaaaactggactcatgcgtgactctgatggttccaggaggtgatacatatacagaacatagaatgtgagctggcatgtgttaggagctcataaatgctgtctgtcactgctgctgcagcgactcattggcttcctgtcacccacaggataaagcacaaacccataagatgagctttgtggtttatctttggccatctcactagccttaattcctaccactccctgacttgggggttattctccagcaacaattttagggaaatcccttcccacactgtgctcctggagtcttctttgtctccagcccctgcacagctacttatcccttaatactggagtttggtgacagcttaggagcagaggacagtccagccagttttaatctccagcacagacctctctcctgagctctggaacccaatgtacacacacacacacacacacacacacacacacacacacacacacacacacacatgctcattcagaatcccctcatggattggttcttctcaaacgggacacgaccgcaccctggtgggagcttgggaaatttgcataattgtttttggctgcagcattgattggagggcattacaggcatctagaggcaggaccaggaatgctggacgctgaaatctgcatccagaacagtttgtaaatgtctttgcaggcgcttctgtgcgtaaaataagtttacagttatctgaaattattaatataacacatataccatacacacaaaattttggtatggtttaaaatatattgacattttctgaaatgaaactatgatgtaaatttatttttatttatctattttttttggagacagaatctcgctctgttgctcaggctggagtgcagtggtgccatctcaactcactagaacctctgcctcccgggttccagtgattcttctgcctcagcctcccaagtagctgggtttacaggcctgtgccaccacgcccagctaattttttgtatttttaatagagagggagtttcaccatgttggccaggctggtctcaaattcctgacctcaagtgatcctcctgccttggcctcccaaagtactgggattacaggcgtgagccactgtgcccggcttctgatgtaaagaaagtgaaaattgtgtacttttttgttcagaatggcaccaatggttatacatcatatcagaagaatcacaattccaacaatgccacctatgagatgtaatgtaaaattctgaatgaagtatagcacacataaagaaatgtgcccatatcatgtgttcagtatgaattttcaggaagtgaccagaaagtaaatttgacgcaagtgacacttgaataactaacacccaagtcaagaaaacaacttcgtaatcccagcacttcgggaggccaaggcaggaggatcgcttgggcccaacctggacaacatagtgaaactctgtctctacaaagataaaaaattagccatgtgtggtggtgcacacttgtagtcccagctacacaggaggctgaggtgggaggatcgcttgagcccaagagttggaggctgcagtgagccatcatcacaccactgcactccagcctgggagacagagcaagacaccatatcaaaaaaaaaaaaaaaaaaaaaaagaaagaaagaaaagaaaacaacattatgaggattctcaccccaagccttcctggtgccagtttcaatcaccatccccctctctcccaaaggtaaccagactctttgtttgtttgttgagacagggtctggctctgttgcccaagctggagtgcagtggtgtgatgatggctcactgcagccttgaattcctgggctcaagcaatcctcccacctcagcctcctgagtacttgaggctaccgttgcacaccaccatgtccagctaatttttgtattattttgtagaaacagggtttcaccattttacccaggctggtctcaaactcctggtctcaagcaatctacacatcttggcctcccaaagtgctgggattacaggcatgagccccggctcaggttatgcacttttatagtcagtagtattagtaacatgtggttgtatccttctcagtaatttttttttttttttgagacagagtctcgctccgtcgcccaggctggagtgcagtggcacggtgtcggctcactgcagcctccgcctcctgggttcaagcctcctgagtagctgggattacaggcacgtgccaccactctcagctaatttttatatttttagtagacacagggtttcacatgttggtcaggctggtcttgaactcctgacctgaggtgatctgctcacctctgcctcccaaggtgctgggattacaggtatgagccaccacgcctggccccttctcagtattttatatcagggggctccttgtgtcagtttgtcccatgactggtagcatcaactttgatcatctggtgaaggtgacatctgtcaggtttatccactgtgaaattactatttttccccaagtaactaatgcaatacatgctttttaggctctactaatttgagtttccaccccttgcaaattatttatttcctcctcagttaactaaagacctcattcaaactggtttaagagtgaaggacatttaggccgggcgcggtggctcacgcctggtaatcccagcactttgggaggccaaggagggcggatcacaaggtcaggagatcgagaccatcctggccaacacggtgaaaccccgtctctactaaaaatacaaaaaattagccgggcgaggtgacaggtgcctgtagtcccagctacgtgggaggctgaggcaggagaatggcatgaaccctggggcgcggagcctgcagtgagccgagatcgcgccactgcactccagcctgagtgacagcgagactccgtctcaaaaaaaaaaaaaaaaaaaaaagagtgaaggacatttatggttgcaactaactgaaaatgacattcagactgacctaagtggggagggaaactggtagtctagaagtagccctgacttcaggtgtggctggatccagtggcttggtacaactaggcatttgtcttgttcatcaatatctgtatagattaagggggactagatccggggaaggcagaagcaatagatgtccgctacactgaatcagaaaaaggagaggaggaagtaggaactgcatgaagagacccagccacagcctgcggttactttggagagcttcttccaagtggttcatggtgctgagcaacccaggacctggcttagcagcatattccttggccacagtggttggttccaggacaggcataagacccagcctgggctgatgaaagacagccccagagctttccagaactattggcataaagaggcactctggctgctgagctcatgggataccagcctagaactacaagtggtcttctctgtttcccaaataaagggtctacccgagaatgaagctagaccttgcatggctatgtttcaatactaggtctggcagtgtctgaagccaacgctaccccctgcaattgtcagctgcaagagccaacaaatttcctttcctgcttaagccaatgtagaatagaatgttctaggttttgcagggaatggtggctcacgcctgtaatcccagcactttgtgagactgaggcgggcagatcacttgaggtcaggggttcaagaccagcctggccaacatggcaaaaccccatctctactaaaaatacaaaaattaattgggcgtggtggcgcacacctgtaatcccagctatgcgggaggctgaggcaagagaatctcttgaaccaggaggcagaggatgcagtgagccgaaataacgccactgcactccaacctggactacagagtgagactctgtctcaaaaaaataaaataaaaaagaataaaaatacaaaaattatctgggtgtggtggcatacacctgtagtcccatctacttgggaggctgaggttcaaaaattgcttgaacccaggaggcaggggttgcagtgagccaagatcgtgccactgaactccagcctaggtgacagagataaactgtgtctcaaaaaaaaaaaaaaaaaaaaaaaggctgggcacagtggctcacacctgtaatcccagcactttgggaggccgaggcgggcggatcacaaggtcaggagttcgagaccagcctgaccaacatggtgaaaccccgtctctactaaaaatacaaaaagttagctaggcgtggtggtgggcgcctgtagtcccagctactcgggaggctggggcaggagaatcacttgaaacaaggaggcagaggatgcaataagccgagatcgtgccactgtattcgcagcctgggtgacaaagtgagactctgtctcaaaaaaataaaaataggccaggcgcagtggctcatgcctgtaatcccagcactttgggaggccgaggcgggcggaccacttgaggtcaggagttcgaaaccagcctggccaacatggtgaaaccccgtctctactaaaatatacaaaaattagccaggcgtgatggcaggcgacttaatcccagctacttgggaggcagaggcaagagaaccgtttcaacctgggaggcagacgttgcagtgagcagagttcgagccattgcactcaaacctgggggataagagcaagacttctctcaaaataataataataataataataataataataataataaaaaataaaaacaaaaataaaaaataaaaattaaaaaagaatgttgtaggttttttctttgaaaaggaaaaatatacaattacatgttgttggctgtggatttatttgaaacaaaaagaaaaaatatacaattagaaaaattctactgttagaaatgaagtcaccttttaattacagggaaatcatttagatcttaatgtgtttatgtattccagtgctgtggtgtaaaaacttattttagtctgtgctgataaaaaataacattgtcatacaacaattggggtgtatttgtaaaaaagaaaacaaaagaaaaataaatatattgacaaacacgtgaactagaaagttttgataatatggttaatcaagtagaagtgtggtctgaagaaagtctgttcttcatggaaacaggtgggcttctcagctatcctgctattcaatagaaagatggagccaggcgtggtggctcacgcacacctgtaatctcagcactttgggaggctgaggcgggtggatcacttgaggccaggagtttgagaccagcctggctaacatggttgaaaccccatctctactaaaaatacaaaaaattagccgagcctggtggcggccgcctgcaatcccagctactagggaggctgaggcaagagaattacttgaacctgggaggtggaggttgcagtgagctgagatcgtgccattgcactcctgggtgacaaagcgagacaagaaaggaagggaagagaagggaacgggaggggaggggaggggaggtaaggggaggggagggaaggggaggggaggggagggaaggggaggggaggggagaggagggaaggggaggggaggggagagaagggaagggcagcggaggggagagaagggaagggaagggcaggggaggggaggggagggaaggggaaagagagagagagagacagagacagagagagagagaaagacaggaaagaaaagaaggaaggaagggagggagggagggagggatcctcttactgggctgttattatgaagcctgtttttaaaatcacttttattgagatatcatttatgtacaataaaaatgcacccatcttaagtgtaaagttcaatgagttttgacaaatctgtgcacccgtgcaaccaccaccacaatcgttatatagaatatttccaacacctcagaaagttctcccatgcctttttgcagtcaaccctcctctcatggccccaggaaacctctgctgtgctctctgccaccgtagattagttttgcctattttagaatttctataaacgaaagcacacacacagtacatattcttttcctctagcttcttttgattgtctgtttattttaatgcttatggagcatacttatgtttacatgtgtcatagtttatgcctcctgtgttagataactgtcggaaataataaaataataggtaggatgcaacatggattcataaattccacttattattagctatttcagacgtcatggaatgcaaaatgaacagagtttttcatatgtctttccccacttctgaaaactttacttcatgaagcacttagggaccctcagaatagcattttattttttatttttattttatttttattttttgagacagaatctcgctctgtcgcccaggctggagtgcagtggcgtgatctcagctcactgcaacctccgcctcctgggttcaagcaattctcatgcatcagcctcccaagtagctgggactacaggcatgcgccactactcctggctaattttttatatttttagtagaaatggagttttaccatgttggccaggctggtctcgaactcctgacctcaggtgatccacccgcctcagcctcccaaagtgctgggattataggcgtgagtcaccgcacccggcagcatttcatttttgagacgacgtttacaatctgccctgtccttttggagaagtttagtttctaaagccaaccccaggatgcaccttgtttctactctggtaccagctgaaccatctctgtcactcagccccctccatgtcctctcctgacaccaagtccctttgggttttatggagctcacctaaccagctcggcccaggctgtaatgagagagaccagtggagtgtaaattcctgcaggtgcaggacaatggggttgagagggctcttacaccagatgtcccctcagctcgaagggcagagaatcgggttccagagtgtccaagtctccggccacctggtcatagattcctcttggatcctgatatgtgtcttcaggccagtggaggtcccagggtccctgacaggcaaaaagtggagttagaaccatggagagatgccctgtaggtcttcattgaagatctgggggatacatgcccctgcttaacttcccagaaaaaagtgttttagcttttactaaaatcccaacatatacaaaaaaggagtgtgattataatgaatgcttatgatgaaccccatgtgcttatcacctaacttcaacaatatcaggctgggcacggtagctcatgcctataattccagcactttgggatgccaaagcaggaggattgcttgagaccaggagttcgagaccagcctgggcaacatagtgagatcctgtatctacaaaaaataattttatttttcttagacagggtctggctctgtcacccaggctggagtgcaatggcacgatcttagctccctgcaacctccaccttctgggctcaatccatcctcccacttcagcctcccaagtagctgggactacaggcatgcatcaccacacccagctaacttttgaattttttttttttttaaagacgaggtttccattgtggcccaggctggtcttgaactcctgagttcaatcgatccacccgtctcagcctcccaaagtgctgggattataagtcactgggattatgagccactgcaccgagcctataaaaaatatttttaaagaaattagctaggtgtggtggtgagcgcctatagtcctagatactcaggaggctgaggtaagaggatcgcttgagccccggaggtcaaggctgcagtaagccatgatcatgccactgcactcccgcctgggtgacagactgagactatctcaaaaaaagaaaaaaagaaaaaagaaaaaaccagtagcaacccttggtcaattgatttctctgtatttctatcttgttcccctccccgactaactggattattttgaagcaagcccaagatacccaatgatttcatgttagaaaaataatgtaaatgtcagaaatataaaacctttaggccaagcatggtgactcatgcctgtaatcctagcattttgggaggccaaggcaggtggatcacttgagatcaggattcgagaccagcctgggcaatgggcaaaaccctgtctctactaaaaatacaaaaattagccgggcatgatggtgcatgcctgtaatcccagctacttgggaggctgaggcaggagaatcgcttgaacctgggaggtggaggttgcagtgagctgagattgtgctactgcactccagcctgggttacagagcaagcctccatctcaaaaataaataaataaataaaatttttaaaaatgaaaactttaaaagtccatgttatcaggtatggcaactgtggaatgtaagttatgattatattgtcctatgaatttccaaaacagttccctaatcataatagaaaaacaaaacaaagcaaaaccaaacaaacaacaacaacaaaaagaacatgaatggtagccctaactggggatgtattttgttctagggctgggagaaaatgattattttagttcagcaaactttagagcagattggcccatgctccaaatatggcctgccacctgcttttttatactgcccaagagctaagaatggtttttatttttttctttttctttttctttttttttgagacggagtcttggtttgttgcccaggctggagtgcagtggcgcaatcttggctcactgcaacctccgcctcccgggtttaagcgattctcctgcctagcctcccgagtaggtgggactacaggcgccagccaccacacccggctaactttttgtatttttagtagagacggggtttcaccatgttggtcaggctggtctcaaacttctgaccttgtgatccgcccgccttggcctcccaaaatgctgggattataggcatgagccaccgtgcccggcctggtttttcattttttaattgttgggaaaaaatgaaaaaagataacatttgtgacatagaaaaattacatgaagttcaaattacagtgtccaaaaattaagttttgtaggaacatagccacactcattcatttatgcatcgtctatggctgcttttactttacggtggcagagtttgtgtagagtttgaggaagaccgtatgtcccacacagcccaaagcatttactactatccggccctgttcggaaaaagcgtgcagcctccatctacgctttagagagtgcatatggtccagcaccatggacagcgctttgcgccatgctggtgaggagctaggatctgacaacagtcccggtatcggaggtcgttcacagagacagaaggaaatccttggcccaggaggtgccagagcatcagccaaggccacacaggaaatcaggggttctgtcccatctccctaactgtgcagcaatgggtggggattggctggtggtcaaagtgcctgtctgttgtttttgcctgtacagccaccatcctcatttccctgtgagctctctgtccctctcctactctcagcccagtgacctgagtggggctggcccctactccctgatcccatggtgaactggcccaggcctctcctgttagcatattccatcccctgactcagggatgtgttcagtgatgaggatgtgacccaagctagaccaattaagtgtcagcattgggcatttggggccactggaaaacaggtatactctttctttgaagatttctaatctcgtaggatacaaatctagattttctgggaatattttttccctttcttttttgaaacagtctctcaggctggaatgcagtggcacaatcagggctcatggcagcctcaacttccctggctcaggcattcctcctacctcagcctcctgagtagctgagaccacaggcatgcaccaccatgcccagttaattttttaaactttttttttttttgagacagagtcttgctctgttgcccaggctggagtgcagtggcatgatctcggctcactgcaacctctgcctcctgggttcaagcgattctcctgcatcagcctcccaagtagccgggattacaagtgtgtgccaccacatccagataatttttgcattttttgtagaaatggggtttcaccatgttggccaggctggtctcgaactcttgacctcaggtaatccacccacctcagcctctcagagtgctgggattactggtgtgagccaccatgctcggcttaacttttttttttttaaagatggggtattattgtgttgcccaggctggtctccaatacctgggctcaagcaatccacctacctcagcctgctgagattagagatatgagccgtgaccatgcctagccataaaaacatttttagggaagaaattctgggcccagctgggcctgatgacaattgtatgccttgatttttcagttgaatgggcccccaaattctctctttctctctctttaaccagtggagtagatatggctaattatctttaaaaattcatgtctacttccttccacagtagcagaattgcagcaaggcacatcactgctaagctagaccacatttcacagcctcctttgccgtcagatgtgaccatgtgactctcttcccaccaggggagtgagagcagagtggtgtgcaccatttctgggcctgggccacaaggcagggttgtgcctcctccacattctttcaccttttcccatgggttgaacccccagtgaactggctcattcatgtagactcggttgacttgagcagggccactcacgtctgactgaaaaagaaatagactgccttctttttttcagagacagggtcttgctctgttgcccaagctggagtgcagtggcaccatcatggctcaccgcagcctccaactcctgagctcaagggatcctcctggctcagcctcctgagtagctgagactacaggtgcacacctccatgcctggctcattttaaaaaatgttttgtagagacaagtcactatattgcccaggctcgtctcaaacttatgggctcaagcgatcctcctgccttggcctcccaaagtgttgggattacaggcatggaccatcatgcccagccgactgtctttaagccactggatcatggtcaggcctctttgttacagcagctagctggccctaactaatacaagcaataggaggtaggctcccagcactagccaggaaggatggttgctgatgcaaagcttctcaccatctgcacttcatcgtagaggggtccccaggctccagacggggggtacgttctttctacctcatcatacaagtgcccagggaaggccatatcctcatcttcacctgtgaaacctggagttggagtggaagggagacacgatcaaggcacccagtccaggcgtcgggggtacctctgagtgagggaatcctgacatggtcctaactcacctcgggaataagacacctcctcctgcgtcgggggcagctgggggctgaagtccctcagggagcggtaatacggctctgcctctgttgtgctgacctgttccccacacgcaaaacaaacaaagccctttccatcctctgaccccactgtgcccggaagggcaatgatcaacctgatgctaacggcagggcttcagtcgccgtcggtgccctgattgtggggtcaccagggccacccccacttaccgtggagctctgagtgtcccgctctcctgtccactggctctcctcatattcgttcctgactcggtcctcttccgaccttccaggatgaaggtgtggggggaagttgagtgctgccccccgccaccagtctcccccaaacctccctcagagccttctttacagaaaaatatccccacttaccctgcctctgtcttctctgagatgcctgaaggaaacaggaataaagggctcagtgaccctatgcaagccccccaccccggccccaggaagaccttcagtatgcagcaaccacagggttccctatcaccctcgggtctccaccctggcagggaagggtctctcctcaccctcagcaagacgcctgagtctccgctgccagaggacccccccgacacaggaggcattggagaggagcagaagccccccaagagcgaacagcacaggcagcaggggcagccccgagggtcctaggggtggaagatacccctcagtgaatcccagacaacaggctgtaggccaggggtgggtctccccgagaaagtgtagccctgaccaagtccctcccccagggtcagagaaacagatgggcagaggtctctgtgcccaccctttctgcccacccaagggcaggtggcttctttcttaagtcaagccattagcaaaacttcctccgtttgcttgaactctgcaaactcagaacggaactctggactcaggagggagcttcagctcgttagctgggcactgaagactttctgtggtccagcctcttcccacgcctccagccatgcccaccaaacttagaccctggtactggactgtccagccacacaaatcaaccaccagctgtttccagaatcactgaagcaaattcacacctcagagctttggaatagttaagtgtctgtcctcaaatgtcctttcttctcaagcaaacttctgtttgcctttcaaattctatctcaaggtcaggcgctgcagcacatgcctgtaatcccagcatgttgggaggtcaaggtgggagaatcgcttgagcctaggagctcaagaccagcctaggcaacatagtgaggctgattctttacaaaaaaaattaaaaatttagcagcatggtggtgcatgtctatagtcccagctactcgggacactgaagcaagaggattgcttgaacctggtaagtcaaggctccagtgagctatgatagcaccactgcactccagcctgggcagcagagcaagaccctgcctctgaaaaaaaaatcccatctcaaggacttctttattttattttgttttttaattaagacggagttggctgggcacggtggctcacgcctataatcccagcactctgggaggctgaggggttggatcacaaggtcaggagttcaaaaccagcctggccgatatggtaaaaccctgtctctactaaaatacaaaaaattagctgggtgtggtggcaggcacctgtagtcccagttacttgggaggctgaggcaggggaatcacttgaactggggaggcagaggttgcagtgagccgagatcacgctactgcactccagcctgggtgacagaatgagaccctgtctcaaaaaaaaaaaaaaaaaaaaaagagtctcactctttcacccaggctggagtgcagtggcatgatcttggctcactgcaacctccacctgcagggttcaagcgattcttctccctcagcctcccaagtagctgggattacaggcgcatgccaccacacccggctaattttttttttttttgtatttttaatagagacggagtttcgccatgttggacaggctgttcttgaactcctggcttcaagtggtctgcccaccttggcgtcccaaagtgctggcattataggcgcgagccaccgtgcccagcctcaaatgacttctttccaccaacttccatcccagccaatatcaggctgacttggctgctatatccctgaggacaaggctgaacccctctaagtaggcatctgttgggcgggcaatctcccctgtcttctactaatagcacttttttcccctggggagaacagccactccccaatctcagtcttgggttcaggcaggactccacagtgggcacatggcccggcctggaaaataagagtctccattcctctctccacagtgattgtttagacacaggcatttgacccaacgtgtgtttttaacaaaacatttaggacaattctactagctgtcaagaagatggaggtggaggagggcttctctgcccctctgattgaagaaactcagaaagaagccaccacagatgaaggcaaagttgagagagggtgagaaacagatcgctggtgagatttttgagcacctgaaagtggccacacttggaattttttatttcatataccaagactttttcttttttttcttgagacagggtctcaactctgttgcccaggctgcagtgcagtggcgtgagctcggctcattgaaggctcaacctcctgggctcaatcaatcctcccgcatcagcctcctgagtagctgggactgcaggcatgcactgccatgcctggctaattttttttgtttttgttttatagagatggggtttcaccatgttgcccaggtttgtctccaacgtctgggctcaagtgatctacctgcctcagcctcccaaagttccgggattataggcatgagccactgtgcccagccaagccattctttttcgtgttgacaaaacagctgcatttctgtcacttgcaacctttttctcgggctctgaaggggatttttttgccaaatggttgcaatcatctcccagtagtcacatccttgagtgcggggcctttccacactgactctgtgttgagccatgtgacttgctttggccaatgagacacaactatgacggaatcagctagtaaattgctgcttttgacccccgtgaccacctccatgtgaaaaagtcaagaagagacacgcgcccagttatctccattgttccaaccaagagccagatgactatcagaagtgtgggaagggggcaaccctagaccacccagtccagtggagctgccagctgactgcagagatgatttaagccagcccagaccagcactgttccgccagactcagaatcatgaggaagaatgttgctataagcacccatgtttggggtggttcattatacagcaaaagctaactgatgcaggcttcttacaggacatggagtgagctaattcttacggaattaaactaaatttggaagagaagaaaatttatcactccaggcaagaggaagatctaagaaaaaaaaaattggccagatgcagtggctcacgcctgtaatcccagcactttgggaggctgaggtgggtgaatcatgaggtcaggagttaaagaccatcctggctaacgcggtgaaacctcatctctactaaaaatacaaaaaattagctgggcgtgttggcacgtgcctgtagtcccagctactcgggaggctgaggcaggagaggaagccgggaggtggagatagcagtcagccgagatcgcaccactgcactccagcctgggcaacaaacagagcaagaatccatctcaaaaaataaaaaaataaaaaaaaaaaatgccgagtgccgtagctcatgcctgttatcccagcactttgggaagctgaggcaggcagatcacttgaggtcgggagttcgagaccagcctggccaacatggtgaaaccccgtccctactaaaaaagtacaacaattagccaggtgtggtggcaggtgcctgtaatcccagcaactcgggaggctaaggcaaaagaatcgcttgaacctgggaggtggaggttgcagtgagccaagattttgccacttcactccagcctgggcaacagaatgagactctgtctcaaaaaaaaaaaaaaaaaaaagaaagaaagaaagaaaaaagaggaagctctaaggagtctgcaagtctgcaattctgcagggacagaactaagtcttttttttttttttttttttttttgagatagggtctccctctgttgccaaggctggagtgcagtggctcagtcatagctcactgcatcctccaactcctgggcttatgcaatcctcccacctcagccttctgagtagttgggactacaggcacatgccactacacccagctattttttatttttgcaaagatggagtcttgctatgttgcccaagctggtctcaaactcctgggctcaagtgatcacatgccttggcctcccaaagtgttgggattacaggcgtgagcgactgagcttggccagaactaagtcgttaagcagctgtgactacaagcagaggaggtagggtcagagaccaggaggttccattctcaggggagccgggagggatcaggggactgaggacttgcctgaaggtggctctgtgggcagctggtcttcaggttctccagaaggctggtggagacctggggggtggatatacagattgtgacttaacactaagaatctgagataagctttaaatatttctcagcctcttcttaagcctattagattcatgggaactggtatatgactgcttaagaatatttcaaagagagctagaaattgctgataataatgacaatactattaatagcaattctaatggtaacgctaatgctaagaataatttgttttttgagactgaacctctctctattgcccaggctggagtgcagtggcgcaatctcagctcactgaaacctctgcctcccgggttcaagcaattctcctgcctcagcctcccaagtagctgggactacaggcacctgccactatgcctggctaattttttgtatttttagtagagatggggtttcaccatgttggccaggctagtctcgaactcctgacctcgtgattcgcccacctcggccttccagagtgctgggattacaggcgtgagccactgcgcctggccatttttttttttttaaagagacagggtctcactctgtcgctcaggctggagtgcagtggtatgatcatagctcactgcagcctcgacctcctgggttcaagctatcctcccgcctcagactcctgattagctgggactacaggcatgcatcaccatgcctggcccaaaaattaactgttgatgagcactttcggtgtgcaaggtccttttcacccgaattatcaatttgttgagttaaccaaaaaagactttgggctctcgatcccttaataaaggtacaagttctaaagcaaaggaggcaagtgtcatactttatgttttagtgttcaaagggaagactggagtggggtggggggaagagcagagaagattgtaggggtgaaaaagtgtccttacttccattgagaaaaagcctgctctgtcaggaagaggaaaacagaaaggagaagcttgcggccaggagtggtggcacacgtctgtaatcccagcactttgagagactgaggcaggtggatcacctgaggttaggactttgagaccagcctggccaacatggtgaaaccctgtctctactaaaaaatacaaaaattagccaggcgtggtggtatgcacctgtaatcccagctacttggaaggctaaggcaggagaattgcttgaacctgggaggcagaggttgcagtgagccgagatcatgccactgtactccagcctgagtgacagagcaagattccattgcaaaaaaaaaaaaaaagaaagaaaagaaaagaaaagaaagaaagaaagaaagaaagaaagaaagaaagaaagaaagaaaaataaactgagccacaaagatctgtgctatatatttttagaaactgagacacttgcctatggtcacacaactaagaggtagcagagaggggatttgaacccaagcttctctggaccaggctctgaaggatttaccactacaatactgtgcctatcagaattgtaacatattcatcatattcaaggaatttgtccttctcatccaacttgctgaatttattggaataaagttatccataatattccctaattatcctcttaatgtctgtggagtctgtggtaacatcccttcttccattcctgttattggtaacttgtattttctcccttttatttgtcttaatcagatttataaatgttattgatttttttcaaataaccagcttctggtttcattgattttctcaattgtttttctgttttctaattcattcatttctgctcttaccattattattttcttctttctgtttactttgggtttaatttgttcgtcttttattagcttctttctttctctctctctctctctctctctttctttctttagatggagttttgctcttgttgcccaggctggagtacaatggcaccatctctgctcactgcaacctctgcctcccaggttcaagtgattctcttgcctcagcctcccaagtaactgggattacaggcatgtgccaccacacccggctaattttgtattttcagtagagacagggtttttccatgttggtcaggctggtctcaaactcccgacctcaagtaatacacccgccttggcctctcaaagtgctgggattacaggcatgagccacagtttcttaagatgaaaacttagaatatgcatttgaggttattctcttaaaaaaaaaaaaaaaaaaaaaacgaaaactagtccagtcgtggtggctcacacctgtaatcccaacactttgggagaccgaagctggtggatcacctgaggtcaggagttcgagatcagcctggacaacatggtgaaaccctgtctctactaaaaaatacaaaaaattacaggtgcatgcctgtaatcccagctacttgggaggctgaggcaggaaaattgctcaaacccaggaggcgggggttgcagtgagccgagacggcaccattgcactccaccctgggcaacaagaacaaaactgcgtctcagaacaaaaacaaacaaacaaaaagtggccaagcgtggtggctcacacctgtaatctcagcattttgggaggccaaggcaggtggatcacctgaggtcaggagttcaagaccagcctggccaacatggcgaaaccccgtctctactaaaaatactaaaattagctgggcatggtggcacttgcctgtaatcccagctacttaggaggctgaggcaggagaatcgcttgaacccgggaggcggaggttgtagtgagccaagatcatgccactgcactccagcctgggtggcagagtgagactccatctcaaaaataaaaaataaggccgcgcatggtggctcaggcctatgattctagcactttgggaggccaaggtgagtggatcacaaggtcaggtgttcgagaccagcctgaccaacatggtgaaaccccgtctctattaagaatacaaaattagctgggggtggtggcacatgcctgtaatcccagttactcagaagactgagtcaagagaattgcttgaacccaggagatgaaggttgcagtgagccaagatcacaccattgcactccagcctgggcaacaagagtgaaactccatctcaaaaaaataaaaaaaaattaaataattaaataaaataaaaaactaaaataagcacttaatgctataaatttccctctaagtactgctttaactgcaacctcaaatttttatatgttttcattttcatttaattcaaactattttctaatttcccttggtcattaatcacattcagatagtatgggttgtggttaacggttggtctcaagttcatctgcctgagtttcaatctcatctttatcttttactagttgtgtgaccttggacaatttgcttaacagctataggcctcagtaactcatcataaaaggggaatagtattgacttcaccatactaccctacacatcctctgaggaatactccaacctgcccaagcctcccttcccacctggggtagtgatgggaagctgggtccctttgtcagccagtccactgtcccccaaggcattactggccagcagccagaccctgtatcttgtagaaggctgtagaccagtcagcgtgaaggtggtggcctggggtggtacgacatccacatagtggaaccctggagtccccagggcctcatacctgcaggacagggggatagtaaattcagggaagtgccctagcccattcccttccctcctgcctcgacaaggacccacctgatgcagaacctctgtggcaggcccccatcaaagccaggcttccactccagccccacggagtgtggggtcagactcacaacctttaatcctgatggagggtcagggcggcctatggggagaaagatgggaaagcagtcagaggatacaaaagaattccagaagattctgtccaggttttccctaggaatgattttaaatatacaatcgcttctcattgttcatagcatactcatgttctgtaaggtcatggtgaacactgctctggcaaacaccaaactgtccctgtaatcccagtactttgtgagaccaagtctgaaagatgcttgagcccaggagttcgagaccagcctgggcaacatagcaagaccctgtctcaaattaaacattaaaataaaaaataattttaaaaagaagtaagtgaaaacaaaaccaaaagaaacagcaaaaaaattcaagaccaaatggttacttctatggaaaatgaagggttaagtttctttctttttttttttttctttttttttagatggagtttcactcttattgcccaggctggagtgtagtggtgcaatcttggctcactgcaacctccacctcctgggttcaagcaattctcctgcctcagcctcccgagtagctggattacaggtgcccgccaccatgcccagctaatttttcatatttttagtagagatggggtttcactatgttggccaggcttgtctcgaactcctgacctcaggtgatccacccgccttggcctcccaaaatgctgggattacaggcatgagccaccgcgcctggcatggttaggtttcttttcttttttttttcttttcctttttttcttttttgagatggagtctcgctgtgtcacccaggctggagtgcagtggtgcgatcttgactcattgcaagctctgcctcctgggttcacgccattctcctgcctcagcctcccgagtagctgggactacaggtgcccgccaccatgcccggctaattttctgtatttttagtacagacgggttttcactatgttagccaggatggtctcgatctcctgacctcgtgatccacccgcctcggcctcccaaagtgctgggattacaggtgtgagccactgcacccggcagttaggtttctttaaacgtctcatcatagcatttgcgtcaagcaatcaatacatgatttttttttttttttttgagacagagtcttgctctgtcgcccaggctggagtgcggtggcgcgaactcagctcactgcaacctccacctcctgggttcaaacaattcttctgcctcagcctcccgagtaactgggattacaagcgcatgccatcacgcccggctttttttttttttttttaagtagagatggggtttcaccatattggtcaggctgaccttgtgatctgcccgcctcagcctcccaaagtgctgggattacaggcatgagccaccacgcctgactaatcctggtattttcatactactgttaggaagagaaagaattctgtttcctctgggaattctaacagaccactgtgagggcccttagaataaagccaacacagagacatgcagacgtaagaatgaagagggctggtcatcacacctgtaatcccaccactttgggaggctgaggcgggcagatcacctgaggtcaggagaccagcctggccaacatggtgaaaccccgtctctactagaaatacaaaaattagctgggtgtggtggcgggcgcctgtaatctcagctactcgggaggctgagatgagagaattgcttgaatccaggaggcagaggttgcagtgagccaagatcgcgccatcgcactccagcctgggtgacaagagtgaatctccatttcaacaacaacaacaacaacaacaacaacaaaaagaatggagagttgctgatggcagctgaacctagatccagaaacccctgaaaatctatttttcagttacttgagctaacaagtaccccctctccatcttttttctgttcttttctttttcttttgcctttgttgtgggtcttcctgaagatccagtctccattaggattttcagggcaggcaaaaactccatcctcacacatacacagaacttccggtttcagaaacatgggcagcccagggccaatcagggatgtgggaatggatccagggagcaccccctccccaacaccctcacagcccctccatactgatgctgacaagttgaatgttggtttggtccgagccaagggcgttggtggctgtacatgtgaagagggcgtaatcctgggcggcagacacgttggcaatggtcaggaggctgctgtggacaccaccctggtggtatgtgtgctccgtgtacctagagagaaggtagggcaccactcacccttccattcacccaaccacttatgcttggaatcatctatgcatccatccattaatgtaaccgtctgcctatctatccattcatccatttatcttttcatccactcaaccattcactcactcattcctccacccattcgtcttccttctctgcagggactcagggaggggaagtggggctggaggtccagacctggggctggagtgctgcctggctgggcttgggctcacctgggatcttggagatccagagggaccccgttttttgtccaagtgaaaacgatgttggggacacctcgggcacggcagtggagggtggcagaactggtgctgtctccagctgcagccaccttagttaggggagtggggtgctccacctggggggcaactgggaggggatgggcagtcaacatgagctatgtgggagacatgagggctgtgggttcagtggcaggtcttgaagtcaggtgtttgggtaatacccacatctgacaacaagacggagcagccgtcgtgctggaggcgccaccccattgtccacaatgcactggtaagcgccagcctgggccagtttggcatggtgaatccgcaggcgccccgttggtcccctggatatcttctccatgtcatccaggctctggtcctcctcatcttctccctggaggcccaagagtccagaattggcctcccagtctagccccagatccatcactgcccaaattgtcccttctgtagcctcattctcctagccacaatcaccctccacagaggtattgaagaaaaaaaaattctcctgtcatccatctatccatttactcaatccatcttttcatccaccaatccaggcaaccacctacccatccattcacccaaccacttatgcttggaaccatctatccgtccatccattcatttatccatctgcttatctctccattcatccatttatctttccatccactcatcggttcactcactcattcctccacccatttgtcttccttctctgcacccatgtatccacccctgtagctctccacccattcactcaactattcactcacgcttgcacacccataaatacatgcatctgttcagacatttacccagctacctatttattcatctttccattgatctacccacccatccattcatcaattcatccatcatccttccatagatatctttcctctgatggtgtatccgtccatcatctaccctctatccactgatttttctccttcaatcatcttcccacccatccactcacccatttatccatcctttcacttgtccatctgttcctccatccactcactcattcatccacctgttcatccacttacctaccttttgacctatctatccatctacctacccactcgcctggctgtctagccatttatccatgcattcattttgccaccaacagttattcattctgggagcatgccctggcgagtatatagttataagggtcatacagatgtatgtggtccccactcccaaggaactcacagtcaagaaaccacaaccccttgaccccacctctattcaccaaaggctggatcctcaccagtctctcccagttgaacatgcccgggaggatgggattggcatcgacagtgcagactatgtccacagaacccccgacgttcacctcagtggggtcctggagggcacggatggtgggagcatctggtggaaggcagaggcttggggaagacacttgggcccagacaggtctgggtgtgagagggccccaggtgggagggatgtcttaggggttccaggaaggttatgggtgtggacacaatctgcccttaataccaaagggttggaggagagttctcaaggttggtgaggttgtctccaccctccactatgcctctgtgataattagagtgagttgagtgggcttccagaattgtgtgtgtagcagggcttatacagtgggctctcattcctgacgggagcagcttccgtgtctaggcgggcaccctctctgggcagagattccacactgggtctctctagtgggaggggttccgcagtgggcgtggttacaccgcggctgggacttccagaacgggagggttccaggatgggtggctatccctgggtgggcggagctcccacaatgaggagactccacaatgggcaaggttccttgggtgggtgtggtttccatggtgggcggggctcacagtgcacgtccagccgcagccgcgcttccgcggtgccctcagagttctggcagtgcagctgatagaggccgtcgtccgcgcgggtcacattccacagatgcagagccccgctggacaggatgcgatgccgggggccgcccgctggggaaggccagaataagggacctggcaggacctcccatccccgggacccctccccatgaccacttccctcacctggactgaggcgatagccgcggaaggtccagttgaaggcctcgggggcggggttagcggacacggacacgggcagcaacgcctcgccctgctccaccgcggtcaccaccagcacctgctcccccaggaactctggacggtcttcagagggggcgccgcagggagtcaagattgttgttaaggttagggtcaaggacagattggagatcaggcacaggttcaagggttaaagttggggtcacgacggggtttaaggttgtggacaaggtaacaagttcagagctaagctcaggggtaaggttcgggatagaagttagaatacagtttaggaaaagagcagaagccagggtcagtttgaaggatggaaacaggagtcatgaggggggttaggagagaggacaaatgcaagatgggaggaggcaggataggagttggcccaggaccacgggtcaggatgaaggtcgggagtttcaagtttcaggatggggttaatgatagagtgatagtgtcaaagcaaagacccaggccaggtgcagtggctcacgcctataatcccagcactttgggaggccaaggcaggaggatcacttgagtcaaggtgttcaagatcggcccgggcaacatagagtaatgccatctctatttaaaattaaaagtacaaaaaatcagcctagcatagtggcacgcgcctgtaatcccagcactttgagaggccaacgcaggagaactgcttgagcccaggggttcaagaccagcctgggcaacatagtgagaccccgttgctacaaaaagtaaaaataaactagcgaagcgtggtagcgcacacctgtagtctcagctactcgggaggctgaggtgggagtatcacttgagctcaggagttggagactgcagtgacctatgattgcgtcactgcattgcagcctgagcgacaaaaaatgaaagagagagagagagagaagagaaaaagaaggaaaaaaaggtaagacccaaggagtagtttagggtcaagaaggcatcgagaggggctttcaggccggggcacatacacagtacgttgaggcgatagaaggagctcacggtttcgcggagctcggcgctgtgggcgcggcaggtcacgcgctggccatgatcgcgggatgacacttgcagaaggacgctcctggcggcggcggagcctttgaatggggctctccggggtggggcggccacgccctccagcctgtggaaccggggtcaagccagggctgcgagcggagccagaggctggagaggcactaggcgggggcgggacatgcgtggagggggcgaggccagaccagagaggggagggatccctcgcactcccacctctccccttccttgtcccaggacaagttgaccggcggattgctgctgacgctgacgcatgtcaagtttaaggcgtctcccgggcgcagtgcggatgcgttggccaggatcgtcacgttagttgggggaactgggagacggggttggaggagcgagactcagaggttaggggcggcctggtctgcgtccaccccgcctgcaccccaggctccgcccagtctcgggtcccccaccccgcctccgcccgctttccccgggtccagggttcgctgggtccctgccccacctggctctgtccctcccgccccgcccccgggcctcagcagtgcgagccctcacactgcaccgccagctgcgtggacgcgctgagctgtccagccttgcacgtgaacttggcctggttgtccgacggccctgtgaccagcaccagctctcgggagaaggtgctcccagatttctccacgctgccgagatgcacgcgccgcgactcctgcggcagccgcgactcggtcacggtgcgcgagtcctacgggccgggagtgactggggttcgcaggcagccctgccgcttccaccaacccccaacccccctaccctgcccactgggttggtgccgccagcccaaacaaagcctttttctgataaggagaagcactctcatcagcaccacccccctagggcaaagcagtggggagtggaactgagtgaccccctccctggagtctctcccgcctccccgagtccctgtgcatggcagttttggggatctgaatccgccttctgtcccacacccaactcctgctctgcctctgcagccacctgcaggctctcagcgcactcctcaaaatctatttctgctgtgtttacccaacaccacctgcaggaaactcccttgaaattcccaggcctttcccagagttcctcagttccttttcttaaaattcctgctgtccccaaagatttcctttgaaattttccttaattccagtgtctttccatagattacttcctttttttattattgctgctgcacaaattaaactttccatagatttctgaatctttcccgatattataatatcttatgatcccagtcttttaacagattcctttgtattgcccagattctcagcacttccccagaattccatccaattaaaataaaattccattgtcatttctataatttctagtcttccccccaaagttttcaactagctccctaattcccaggattctcctagaattctattaggcttctctttcattttaatgaaatttcattttcttgcctccaaatcccaagagttcagtttaatactaatgaatttccgatagtctgtggaattactagcttttctccaaattttcttttcttttcttttctttttttttgagacggagtctccctctgtcacccaggctggagtgcagtggcacgatctcggctcactgcaagctccgcctcccgggttcacgccattctcctgcctcagcctcccgagtagctgggactacaggcacctgccaccacgcctggctaattttttgtatttttagtagagacggagtttcaccgtgttagccaggatggtctcgatctcctcacctcgtgatccgcccgcctcagcctcccaaagtgctgggattacaggcgtgagccactgtgcccagcctttttttttttttttttttttttttttgagacggagtttcggtctcgttgcccagactggagtgcagtggcacaacctcggctcaccacaacctgggcctcccggattcaagcaattctccagcctcagcctctccagtagctgggattacaggcccccgccaccatgcccagctaattttttgtatttttagtagagacagggtttctccatgttggtcaggctggtctctaactcccgacttcaggtgatccgtctacctcggcctcctaaagtgcttggattacaggcgtgagccactgtgcccagccaaattttacagcattgttttttttttttttctgggattcaagtctttccctaaaattcctgacatttcacctgaattctgagggttttcactagaattttctttaattttaatgaaattaccttttctctagaatgcctaatcttgattcagaattccaatttttatcctaaaattctcactgtttccccagaattttcctaggattccatttaattctcatagcatttgtgtctttcctgattccctgccaaacctcagaatctttagtacttttcaagaaatttaatctttttccaagattgcccaagattctgaaggagagaaggggcctggtccttcccccacattcctggccacccccatagccctggcgtggcaccaaccttgtaccacatgagggagggctctgggttgcccccgatagccaaacacaccagcctcacccgggtcccagcccggagcttctggccctctgggggaccctcaatccacagtttctgggcgggatctggcggggagaggaaggaagaatgactttttctctgtgctgggtcctgaggcttgggggcattgctgggccagggcaggggctcacattttacgttcaggatgagcgacttcttgaaggtctccttggtgaaggcttcactgaaggcctcacatgtgagggtcagaccgttgtcctcccgccgcgccaggaatgtcaggttggacatggagatgtgaccgccatgcagtccctggcagggagtgagcttcagacgtggggactgcagcacccctatccatcgtgctagaggcctgagtccatcccagtccccagcagggacacaggagacatctctacctccccctctgttggacccatggtcctcaaggagaaagccccccaggctgctggacccaccccttccctatccacgagtcatgccctcagccccctccatgctcagacccaggagcctggcccccgcctcacatccatgactgtctcctccatgggcagcagctgccgccagcccagccaccatcgtagcagaacccgcgggcgactggacttgctgacacaggagagtgtcacgttcttgttctcagtctgggatgcagatcccaagataataatggcactagggggaactgcagggacagagaaggaagacactaagctgggctggatttctcacagaccagcccagacagaacaggactggagacagatgctgagatctttggcatccagtaggcataatttgggggcacacacagatggttctctgaggcacagaccgacaggggggcagctggcaccaggactcacaggtgacctgcagtgtgatgccgtgctcctgggtccctgcagacacgctgttgtgggcctcgcagctgagctgcgctccatggtcttctggcctcacggtcatcaccagcacactgcgggccaccgcctgggtgtgctctgtgccccacgctgtggacaccggctggccattctggagacagggacaggcctgggccagctcaggactggctcccagaccccactgtccccccattccccatgcccgcgtttgccctcaccttcagccactgcagtgtggctaagggattaccccctcgggccacgcacggcagctccaagctctgtcctgcccgcacgtgcccctcatccaggcctggccactcgatgacagggggtcctggagggactgggggatatcagtcactcagtgggcctggagtagcccatccactctttccaggccccacaacctgcctttgaacccccatgtttctctgagtgcctgaatttccataatccctgtgatccccccacaccccccagtgcctgctccccatcctcagcgccctagttggcccagttctccacttacacagaacattcacggtgaatgaggccttgatgggggcctccagtgctgggctagacgcctcacagaccagcaactgcctattatctgagctccggggtgtcaccctgggatgagaagtcagggttatagagtcagagtcatcatctgaaatttggggagtcagggagaagaggtggggatgtcacctctggtccccacacctggtctaagtccccatgctgatctcctctgggatccagggttccatgggagagattttgggggtgaacagtgagaattggagcctagagagccccacatctgaccaaaactttagtgcttgggactctagaactgaggttcccatgaagtttttttgtttgtttatttgtttgtttgtcttttgagacagaatctggctctatcacccaggctggagtgcagtggtacaatctcagctcactgcaacctccacttcttgggttcaagtgattctcctgcctcagccccctgaggagctgggagtacaggcatgcgccaccacacccggctaatttttgtatttttagtgaaaacagggtttcaccatgttgacccagctgatcttgaactcctgacctcaggtgatccgcccacctcagcctcccaaagtgctgggattacaggcatgagccaccacctctgttccccatgaagaagctttgagagtcaggatgaagaattgggtcccagatgttcatacctagcccaagcttcatgcttgcatccctggggtctggggttcccatggggaaaattaggggtcaaggttggggggttgtttcagtttccacacctggctgtggcctccacagtgaagagtttctgctgggagccctcgttcacgtttgcagagatgtcagatattgtctgtccaccttggggcagcaagagggctagaggggttccaggctccccgcaagatagattctggggagcatggcctggaagtcctcagggtgggtgcgatgccccctccctcctcgttctagaggaaaagggcctggggcagagctgcatcccctcccgactttctggactgcctgaatgccgcagtcttcagtgctgggtcctgggcctccccgctcttctcaactccttgctgggttgtaccatgcaccctatccctcagcttctcatgtctgcaccagcgctactgcccatatttctatctgggcctcagccttgtgctggttgctgccgccctcgatgtgccctcgcatccactgggtcccacactggcctcagcatctccccacaccttctcctgggtccccatcccagggatgacatcttttctggggcccttagaagggtactggtcaggaacacacacccttcccactccagaggcttcatgctgccccctgccacccagttcacccacactcactcaggagaatggtgatgtcaggtgctggcttcgcgtccccagacacacagttgaccacgtactcctgcccagctacccaggtgaccatggtgcctgcctctggggtcagcaggagcagcttgggaggaactggtgagagaagggtctggggtaagcttccagcactgagaaggacttgaagattggagttcggtacccagagtctgggagaggagaggctgggggcttggacttccgggttgcggggtaggggagggcttgaagcccagactcatgggtcctgggcgtctctcacccatacccaggatggagaggatcactctgggagacacgagctcgggccccatctcagagcggccgacctggcactcatactccgcgtcatcgctgaggtcacaggcctcgatgtgcaggtggaattcacctgcagggggagccggaagtcagggccgcagcttccgctggtggctgagggtctcaggctctgatcccttacctctagcagggtccccttccaggcggtacctcgggaagcctgggatcctggggtcggggcccaggagcagcccatctttggcccattgcaccgcactgccaggggtgctgaccccacaacgcagctccactgaggccccctccaccaccgtcaggttttcaggcagggcccagaagccccggggaacggaggcaggaatcgccaactgcgccaggcctgaggacacagcgcggtgcaaggaaagggcagagggtttgtctagggaaggtaagtgggaaatgggggccacttggcgctgggtacaaggctgggatcccactcaccttcagtcagcagccccaggagcaggagagaagccctgagcgtcgtccccagggccatcacaggtccccctactgtgacccccacagcgcccgctgccagccacctgcgtctgtctggctttctctgggtccctctctgtgtgtctctgccacctgcttttcttttttatctctttccgttactctcctccctttctcgttttcctcttcccctcttccctgtgagtatctctctctgtcttgctctcagtctcaatctctgagtctctttctctgtctctttaaaaaaacttttttttcttttttcttttttttttcttttttttttttttagagacggggtctcactatgttggccaggttgatctcagactctttccttcaagccatcctcccaccttggcctccccaagtgttgggattacaggcgtgagccactgcgcccagtctctttatctttccatctttctctccttgtctaagccgttctctctccttttgtctctgtctcttcctctctctctgtctctctctctctctctctctcaatctctatcttctctcctgccacccctcactcctgctccttgtctcactactcacagcctttcaagaaggacctgcagcccagagtccagcaggccaggagcctaggagagcgatgaggctgatgcaggcactggcagagtcagccctgctctctgacccagcttgagctcattctcacagtgcaacctcccccaggtaccttccagagcccccagctctggcctctgcccagcaggctcctcccagctggcccagctggagcataaaatcccctgtcagcacatgccaggcgcgttcctcggtgcctccccagcctccgtgaccccagggcctggcttaggctgggaagatgggagaagtcagatcaaggtggtctcccagctcagcaggggagcagccagctgggcccccagctcttccttgccctgatacatgaccttggcaagtctctttctttctttctttcttttcttgagatagtcttgctctgttgctcaggctggagtgcagtggcatctcggctcactgcaacttccacctcccatggcttgaacctcccaggttcaagtaattctcccacctctgtctcccaagtagctggtgctacaggtatatagcaccatgcctggctaatttttgtatttttactagagacggggtttcatcatgttggccacgctggtctcgaactcctgacctcaggtgatccatctgcctcagcctcccaaaatgctgggattacagacatgagccaccgcacctggcctcccttccttttttagtagacatcagtgcctaaatgatgtcagggatctctgctggggaggatgcaagagtgagtgtgacaggctgggagagtgtgggagagagggaagatatgcatgtgtgtacgtgggtgtgagagtggggaaggttagagtgaactgcgatctgtaataagcatgtggagagcgtgtgtgtgacagtgtcttacgtgggagtgcacagggtgtgggcgggagtaaaaggcagagtccaattccaccggcccccagtgtgggtgcagtgtgagcccaaagtgggcgccctttggcaaggactgcatgagctttcttctccctctttttcttgccctctctcccatctcttctttccttctccatgtctctctctctccctccctctatctatcttgatttatctttctttcttttgagatggaatcttgctctgttgcccaggctggagggcagtggcatgatcttggttcattgcagcctcaacttcctgggctcaggtgatcctcctgcctcagcctcctgaatagctgggactacaggtgcacaccaccactccagctaattttttaaaatttgtttgtagagacagggtctttctctattgcccaggctggagtgcagtggtgtgatcatggctcattgaagcctcaaacctcctaggctcaagtgttctttctgcctcagcctcctgagtagctgggactacaggcccgcatcaccactctggctatttttttttttttttttttttttttgagagggagtcttgctctgtcacccaggctggagtgcaatggtgcgatgttggctcactgtaacctccgcctcccaggtccaagcgattctcctgcctcagcctcctgagtagctgggaatacaggcattgaccaccacacccagctaatttttgtatttttagtagagacggggtttcgccatgttggccaggcaggtctcgaactcctgacctcaggtaacccacctgccttggccccccaaagtgctgggattacaggtgggagccgctgcaccccgccacttggctaattttttttaaatgtttttgcagagacagagtcttgctatattgcccaggcttgtctggaactcctgggctcaagcaatcctcccatctcggcctcccaaagtactaggattacaggcatgagccaccgcacctggcccttgatttatctttcttttttttcttttttctcttttttctttttttgagatggagtttcactcttgttgcccagactggagtgtaatagtgtgatctcggctcactgcaacctctgcctcccgggttcaggcgattctcctgcctcagcctccctagtagctgggattacaggcatgcgccaccacgcctggctaattttttgtatttttagtaaagacggggtttctccatgttgatcaggctggtctcgaactcctgacctcaggtgatcagcctgactcggcctcccaaagtgctgggattgcaggcgtgagtcattgtgcccagctgatttatctttctatctttctccatctgtttgagactctctcgctctctatattaagttgttaaatctcagtcaatctttatttcactgtgtctctccatctctatatgtctctgttattctgtttctctgtctctgttctcacctctgtcgctcccctcaccccacagtctgtctcacacacaccaggagctccataaatatttgttctcagccacactctgaccacgcctctttctcttatgtgtctctccatctccgagtggctctgctcatcacatccctggattttataaccatatgctggtgggcctgccctccccgcgtgcacatacacttgcctgggataagcttcttctgcctgcttatctcctgcgggaattggaaatgctagttttctccctacctccccaagacccccgccaatatcgttcccaggaacaagatgaggcatctggcctcagcccccagcttcatcctcgatgctggacttccatcttccctcacatgcttgactccttgccctcctcccacctcccctctcccaactgctctctacaccccctgggaaatgggctggatgccgagctgggggagtggctctgtcctgggggccctcgccagatggtgtccctaggtgccagagcgtggagctgtcccttgctggggcctttaataagcacaaaccttccaccctccaccttggctgttttccttctctgcatgctcctgggaccttgggctctccatctttccatgtccgtagccccagagagccaggaaggggaagcggcgtcaagtgcctggaaaaacagccccatgacttgagttcctccctaagactcaggagttccagccccatgtccatcctatttcaaaatccaggcactagataagccacacagaagccgggagtgtaggcccccagatccctcccctctcagaccctggggtctcagtcccttctctccaaggactcgggaatttgggcctctgatcctcctggccacactacccacccccgcacctccccatacacacacacacacacacacacacacacacacacacacacacacacacacatacacacaggacttaggacagatgttcacggtctgatttccaaatcctcctgggcctgtgtgggggtggggagagattggcagatagatccaccgactcttaagacttaagaccagatattctgacccctgtcaccctcttccaagtgcaccatgcacttgagtgcaccttgagtctccagcctctcaaggaaccgggagatcaggccatcagcgtctcagccagcaaaggcctgaaccaccagtcccttataaccctgtaagtccaacccccactcccaaccccactcccccatttagggacacggagtctgagcctaagaacagtggagaatctgaatgtggaccctccagttcttacaggtccaggaatgtcagatcagggtcccagccccccagccctccttcaggctgctcggggtccctcccacctgctcggccagctgcgcagcgtgggaacgccccagctgggctgcatggagccgtcaggacaagctgcgcggttcccagcctccctgcctgccccggcccggcaccgccgcctcccagccgtcgccgggcaaccaggccgaggggcccggccggccgagtggggagaggggttgggctgggactgcggggtcctgggaaaggaggggccgagggcctggattcctgggtcttaggacgtgctgtagtttgcagcaataacaagggaacagagggatattttgaggaggggttttgaggctgggggagtcgaggtaggggtcccaactgtcccccaggtatcggtgtgccctcttcccgacacgcaggcccgggggagccccggaccccgcatcccccagggcgcggaaactggcgaggccccaggagctcccatttatagctcagtttccactgagcgcagtccctctaggacctgggctgagcaagtttcttccactctctcccttccctcctcctcaccccttgcctgcccctcaaccccggcagggcgcaggtgtccaacccagccgggaccccctccctcctcgaacccaggtgttccggctcccagaccccaattgagctgggggcgcccacccgccgggggatcccgccctgcgtcccccattcatccgcgtctcagccgcgggagtttctcaacgggaagagggcggagctcccggggggcggacccgggcggggcgagcgggatcgggccctcttggggtctcccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctgcttcagagggagagcaggtaccgcacgaggggagcggaggaatatggggtgggggtggggagttgcttgcgggctgcctcttcactagcgagaagggagctgggggctgggactcctgggtcctgaatgaggaggcccctgaaggtgctaagctcagccctgctgccccgaactctcctaggcccgtcgccccatttcctgcaacagccagaggacctggtggtgctgctgggggaggaagcccggctgccgtgtgctctgggcgcctactgggggctagttcagtggactaagagtgggctggccctagggggccaaagggacctaccaggtaagagtgttctctccacgctgggacgggctggctagggggagagttgctgggctcggctgtacctgcagtttctattttgacattttcaagtttgggaaattgatgggctcgggtaaacatttaggagtcctgatttttgagctgcttctttgggggtgacccacggagtttgggaattattatgttattgcaaaatagtacataggccaggtgcagtggctcacgcctgtaatcccaacgctttgggaggttgaggccagaggatcgcttgaaaccaggagtttgagaccagcctgggcaacataacaagaccttatctctacacaaatgtatatatatattttaaacaaattagccgggtatggtggtgtgcatctatagtcccagttactcaggaggcttaggtggtaggattgcttgagcctaggagttcaaggctgcagtgagccatgatcaagccactgcacttcaggcaatggtgagaccctgtctcaaaaaaaaaaaaaaaagagaacataaatgcaaaaaagtacagtaaatataaatggaagatttaccaaataaaatagacacacacagccaatacccaagtccattgctagctccccagaagaccccgtgttcctttcccctatcatagccccctccccctcactccagaagtagtatctaacctaatttttatggcaatcattttcttgctttccttcctgactttattacccctaagtttgcagtgactctgggttgggagggagttagagtctctctgggcccagtacacactttttaatagtgtcttaccaccaaatgtgtgggccagttttctggtggaggatgtctggggatggaggcctgaggccaggatttcagaaccatggtgtgctgactgccttctccctgactccagggtggtcccggtactggatatcagggaatgcagccaatggccagcatgacctccacattaggcccgtggagctagaggatgaagcatcatatgaatgtcaggctacacaagcaggcctccgctccagaccagcccaactgcacgtgctgggtaaggacctcgcccacttgtcccctgggagcccaagagggcagcccgtactagctgtgagtagcagagcccagggagcccaggggcatggtcaattggagctgagaagatcaggatccatctctgaccccaaatccaccttgcagtccccccagaagccccccaggtgctgggcggcccctctgtgtctctggttgctggagttcctgcgaacctgacatgtcggagccgtggggatgcccgccctacccctgaattgctgtggttccgagatggggtcctgttggatggagccaccttccatcaggtcaggtccaaattcctgtgctagcctttgcccattgagggaaacttgggttacactctgaccacaggctcatccagaagagaagaagacatgggagggcagaggttcatgggtttggactcttgaaatatgatgcagggtaaagattctagggccagactacctgggttcaaattatgtctcagccacttgctagttgattgatcttgagtaagttagttaacctctctgtgcctcagttgccttatctatacaatcaggataatagtagcatgcatgtcatagggtattgtgagaattaaataaataaatacctataaatgcccagaagagtgaccaatacatagtgagcactatataagtaaggcaagcttgtccaacctgcggcccatgggctgcatgcagcccaggatggctttgaatgtggcccaccacaaattcataaactttcttaaaacattatgagacttttttgtaattttttagctcatcagctatcattagtgttagtatgtgtggcctaagacaattcttcttccaatgtggcccaggaaagccaaaagattggacacccctgatgggtagatggcattattattcttatccttccctccagaccctgctgaaggaagggacccctgggtcagtggagagcaccttaaccctgacccctttcagccatgatgatggagccacctttgtctgccgggcccggagccaggccctgcccacaggaagagacacagctatcacactgagcctgcagtgtgagtgcagctggccctgggaaagaggggtgtggggccctgactcctgggtatgaggaaggaggggactgtggcccttggggaatgaggaaactggagcctggactcctggatctaagatagcaggagagggctgggtatggtagctcacgcctgtactcacagaactttgggaggtcgaggcaggcggatcatctaagatcaggagttcgagaccagtctggctaacatgtcgaaaccccgtctctactaaaaatacaaaaatttgccgggcgtggtagcacacacttgtaattccagctacctgggaggctgaggcaggagaatcacttgtacccgggaggcagatgttgcggtgagccgagatcatgccactcagcagcagagtgagactccgagcaggagaggacagacagctggggtccctggggaaagagaaagctgggccttgactctcacatcggggagactaggagagggcagaaggctggcacattgaggtaactggggaaattgggaactgaaagcccagactcctggctcaaagggagaaggggattaggggcccagactcctgggatggaggaaccagggactggacacctaggccagtgacggaggtgttcctggtccttgcccatctgaccattgtcccaccctcacagaccccccagaggtgactctgtctgcttcgccacacactgtgcaggagggagagaaggtcattttcctgtgccaggccacagcccagcctcctgtcacaggctacaggtgaggacgaagacccacctctccccagccccaagagtgagcttgggaagggctgggacctgagtaggtgtgccagagaggccaggacaacgttaacagcgccaccatttcctcaggtgggcaaaagggggctctccggtgctcggggcccgcgggccaaggttagaggtcgtggcagacgcctcgttcctgactgagcccgtgtcctgcgaggtcagcaacgccgtgggtagcgccaaccgcagtactgcgctggatgtgctgtgtgagctggggccggcctgtgggtgtggtcaaaggtggccgtggctttcagggctgttgagggtcggggcctggaggggcggggccgggagagcgagcgtggggtattaggaggaggagagtgtggagctggggcatattcttgcgccctagagggtgtggtgtttctgtggggctggctgatcccaggtcagtggctgcattccgccccggccatgtgacccctagtctctttcgtccagttgggccgattctgcaggcaaagccggagcccgtgtccgtggacgtgggggaagacgcttccttcagctgcgcctggcgcgggaacccgcttccacgggtaacctggacccgccgcggtggcgcgcaggtacagccctaaatctgaggcggtggctggagggggaccaggcttccttacaaatccggcttctgacgccccttccctgtcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacggtgagaaggcggggcttcctaggggacctggcccgtcctgggatagggagcggacagagggggcaagggctaatgcagtgggagtggcctggaaggagctttacacccagcgggggctggagaccggacctattgaaggcgaggcttttaggagaatcggagtttggaggcggcgtggcctgattgattgaggttagcggagagtgcgctggacagacccggctttgttacagcctttggggagggcaagacctctcctctgagtgacctacagtctccatcccagctcccccagtagtgaccgccctgcactctgcgcctgccttcctgaggggccctgctcgcctccagtgtctggttttcgcctctcccgccccagatgccgtggtaaggaaatgtcactcctcccgtgacccatccagccgtgatccctgacctcccacctggccccccgaaactactgtgaccatttctgacttcccagacatccctcctgcttcttcctcccctcctcagtctcctccgtgtcctccctcttttgtgcccccaggtctggtcttgggatgagggcttcctggaggcg

SEQ ID NO: 1300 - DNA, 29664 bp, Homo sapiens
aattgaggcgagggatgggaaagtagaggtcgcttctctccacgcccctgcctttgtggggagattgagccctggccctgttctccaggagatgttttgcttggggtgcaggacacagtatgtaaacaaccctttggactccgtgtgtccttgaggttgccccagtctggcctaccgttcctgccctgcacaaagcttcagtagccctctcactttcccttccagtcctttccctgtcctccctcccctccacttccaagttttagttaattagagtcaagacgtcatgtcatgcctcttcccaaaggagttgggttgcacaggatgttcagactttacaaacccaaagcactgaatccctgggggaggaatttcagaccagtggggaggtattttgaggtaagggacaggcgcatatcataaagtgggagtaggtggggtttccacagaatcaatggccctcttggcattgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggttgcagtgagctgagatcacgccactgcactccagcctgcgcgacagagtgagactgtctcaaaacaacaacaacaaaaacctgattaggcttggtgtggtggctcacgtttctaatcccagcactttgggaggccagggtgggaagattgcttgagcccaggagttggagaccagcctgagcagcttaggaagatctcctctctacaaaaaaaagtttaaaaattagctgggtgtggtggcacacacctgtggtcctagctcctcgggaggctgaggtgggaggatcaccttcagcccaggaggttgaggctgcagtgagccatgatggtgcaactgcactccagtctagatgacagagcaagactgtgtctcaaaaagaagaaaagaaaaaaaaagatcaggattatctgtctttattttgtcctaggactccagattcaattatttatatatacttcaggatttaaactttgcttccagagttgtcatggaggaggccaagaagcaaatagagtaagagccaaagcctgggtagccaaacagttcttaaccttcttatttaatcacaagcccctttatgaatcacatgaaaattttgcacctctcctccagaaaaatgttcacacatataaacacacacatggaattttgcatataatcccaaatggttcacaaagaccatttattacaggtttcataaatcagcatctctgaatacctgatttaacctagtcctcttactttacagcttaggaaacaaacctaaagagaggaagtgacttgcccaaattcacagtttgggcatgggcacagtttgagaatggattaaaagtcaagttttggccgggtgcgtgctcacgcctgtaatcccggcactttgggaggccgaggcgggtggatcacgaggtcaggagatcaagaccatcctggctaacatggtgaaaccccatctctactaaaaatacaaaaagttagccgggtgtggtggcaggtgccggtagtcccagctactcaggaggctgaggcaggagaatgtcgtgaacccagcaggcggagcttgcagtgagcggagatcgtgccactgcaccccagcctgggcgacagagcaagactccgtctcaaaaaaaaaaagtcaggttttgtgattttcagttaaatagtctataatgggctgcttcttgcaggctactcaaactgcattactaaactgtaattggtgatcccgaaatcctttcaataaagaggtatctgtcaaaggaaaccttttcaaattagttggactaaacgggacctaggccggacatggctcacacctgtaatcccagcactttgggaggacgaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccaggatacagaggctgccgtgagccgagattgtgccacttcactccagcctgggcaacagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattctttgtgcatgcaagtatcccacgtaggagggattgatgaagcagatactatttcagtttttatagggagaaactattccaggaagggtggggattacagcgcaagtagatagtagagcctgaagctgagccctagtttcttcacccctttgccttcagcttttgcattttctgccagatgattctgtggttcttacactttggttcgtaactacaggtgcaaaaaaaaaaaagaaaaaaaaaaaacacatgtagatagatggatatgtgggcctatcccagatcaaataaatcagaatctctgaaggtgaggacaggaaccactaccatattctgtgttggcagaagcaaacctaaatccaggtatgttagccattttttttccatctgaagaggcagtttttgttttgttttgttgttgttgttgttgttgttgttgtttttgagatggagttttgctcttgttgcccaggctggagtgcaatggcgttatctcggctcacagcaacctccgcctcccgggttcaagcgattctcctgcctcagcctcccgagtagctgggattacaggcatgtgccaccacgcctggctaattttgtatttttagtagagacagcttctccatgttggtcaggctggtctcgaactcccgacctcaggtgatctgcccattttggcctcccaaagtgctgggattacaggtgtgagccaccgcacccacccggctgttttttttgtttgttttgttttgtttttgtgacagagtctcccactgtcgcccaggctggagtgcagtggcacagtctcggctcactgcaagcttcacctcccaggttcacgccattctcctgcctcagcctctcgagtagctgggactacaggcacctgccaccacacctggctaatttttttggctttttttttttgtatttttagtagagacagggtttcgccgtgttagcctgacctagtgatccacccactcggcctcccaaagtgctgggattacaggcatgagctactgcgcccggccccagccggcagttttatataatggagtgtatttgtgatttttgtttgtttgagcttgagctcaaacttttgaatcagctaaacttgtattctttttttttttttttttttgagacagtctccctctgtcacccaggctggagtgcagtggtgcaatcatggctcactgcagcctcgacctcctgggctccaacagtcctcctacctcagccccccaagtggctgggactacaggcagatgccaccacgcctggctaatttttgtgcgtgtgtgtgttttctgtaaaggtgaggtttcgccatgttgcctaggctagtctcaaactcctggactcaagcgatctgcccttcttggcctcccaaagtgctaggattacaagtgtgagccaccacacccagtcttatacctgtattcaaatttgatatttgccccttgctagtaactatctcctagagtttactgtgagaataaatgaaataatgcatgtaaagataaatgtatgtagtagggatgaaataaatgtcacatctttcctttctgccttctgtatcatctctgaactcaggtctgggaatccaggtttctggattattctctatgttgtgattggaaggttgggcagaagtcacttgagtagatacgcagtggtctgcaagatgatccctgcactttccacccttccagaacggtgaaggagggaacaagaagcagttctcctggtccatccctgcagaccttaccctgtggcctgcttcatgggaatgagtactttcagggcagttagccagtactacctgtgaccatggctggtgaatgctcctgtttctgcttcaagtttctccttgctgtgagaagaaacctgtggaggttctggggggccagatatgtgacttggtagatccccgagtgtgttcccagagacattgcctcctgcaggagccaaggaaacacagaagaggcccataggactgggggactttggacctaacaactgtgggctggtgggactgtggcacgggggtggggctgccaaagtgggaacatgattccagctgctgatcacttcactgcttgccctggcttgaagtaagtctcagtggttggtctccagaaactccatggaaatactgcccacaggttttggtcttctcccattttcctctccttttccctctttgtagggatgagggttggggtttctgagctgtaacctgataggacggctctggcagttgaagtcctggttataattcctcctaaacaggagaccctagcctgcccacccccactcccacaagatggggctcgtatgtggtcctgggtcctgggaagccacctgtggggagactaggtgtcaggggagggagttgaagaacaaagtggatgaaagaggcttctcccagctcccagaagatagggcaccaggccccagaccattgagtcctgagtttcttgaaaccagccatctctgtgacatctctggctgccctgctgggctggagcttctgggagcagggaggtagaggagggagctggactggtgatgtgggtgctgggacagaatagtgccagtctctcagtgactagagtccctggtttctgcttttccaggacagctggggccttgtgaaaatcagagagggaacacaggcgagaggaatggagagccttgtgcttgtgactcagagatacccagaccagggtgggggccttgggaggggacgaccttgtgatgagggggaacaaaagcaaaagctggaggcagaagtctgagatgggggtgtcacaggggcttttctgaaatgtgaaaatgaatacatgggcagattttgcaacagcacccagcctgctgtcttctcacactctgctccccagccccggcctgttccccctctcccaccctgtgcttcctctcatctttcaccaggctgctcttctgcctcagccttcatctttttctcatctggttccttctgtcccatctacaccccctgtccactctttccctgtttcctgtgttctcttccctggtgccctgttcatctgtttcggtctctttggctgcttgccctggcccccgtccttctatgctttaatgtggggcccatgggaactggagttcatagcaaaacaggaagagccggtgagcaggaaactgggaatggggcagggggtgaatgaccagcagtaacctcagcagcttgcctcccacatctggactggagcatctgcagggttctcagcctctcccctgtagcccaccagccctggctgcttccattacagcacttcactggcccaagacgcaacaagacaagattgtcctggactctgacacagcaaagggactggagtgaggacatctgggttctgatcccagcccagccactaactgtgtggtcttggaaaaggccctcacatgagtttcagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttctttttctttctttctttctttctttctttctttctttctttctttctttctttctttctctctctctctctctctctctttctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgtatttttagtagtgatggggtttcaccatgttggccaggctggtctggaactcctgacctcaagtgatccatctgccttggcctcccaaactgctgggattacaggcatgagccaccgcaccctgcatgatctgtagtttcaatcccacaacaaccttgtgtggtaaaaattactattatccctattttatttatctttctttctttttcttttttttattttgagatggagtctcagtctgtcacccaggctggagtgtggtggcacaatctcggctcactgcaacctcccagattcaagtgattctcctccctcagcctcccgagtagctgggattacagacccgcatcactatgcctggctaacttttgtatttttagtagagacggggtttcaccatgttggccaggctggtctcgaactcctgacctcaagtgatccacccgcctaggcctcccaaagtgctgggattacaggcgtgagccaccgtgcccgttctatttatttttcaacacaccattgctggctcaactattcttattttaaagatagggaaacaaagattcagagacgttaagtaacttgctcaatcaagatcacataggtaataagaggtttaggatttgaacccaaaatctgagcccagagtctgaacgctaaatcaacatgctgagttgaaattgactacagcagttgtgatggcgtgtgcctgtaatcctagcactttggaaggctgaggtgggaggatggcttgagcccaggagtgtgaagccagcctgggcaacatagtgagaccctaccccaaaaaaggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctcgatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcagatggggttgttccccagaagaggcaacccgcataccttcccaggtccatcctgggctgccacctgagttgcctgtcttccttctgccacctccacccctatcccaggcctgccactgctcatagcagatttcctatcaaaggctctcctggcctcctctcttatctgtggcccccgcagggcacccactttcagaaactccctggaaggcccagcacctgcctctctccacccctggatttctaccagcttggctgaggcctggggctagtggggagagcttcttggcctcttcccagaggcaagggaggaggagggaggctgggaaagccgctggggctcagtgtcgcaattccgggccgtgctgggacctttgctccacgaggtgcctatggaggggagggaacacgattctggaggctgctgggattggggtgggggttcctgggaggcagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccaagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctggtaagcttcattccatccctctcccctgagcccagaccgcaggctccacgcctcctgtaggaatcagcctccttcattacctgccttcttccttcctccagagagcagtccagagtcattcttagtcgtgcttgcctcccgcccagatcacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatgtaagaaactacaagtgactagtcctagctagagcccacacagactctagggtcccaaagcctgagctgggactttgctgccctctaagggtggggataagtttgcagtttcccagctaggacgctgggccgtggagccgggatggggcctgagacccccttgtgcctctcttttggagctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgaggagcttctgggtttggaggaggtaggggtccagattccaggtcctggatctggaagaggttccttgggggtttttactttatatataatctcatggttaagttcagaggctttagagctaactaaatctgactgatctaagtgtgaattttgtctctaggcctttctgagcctcactttccttgtttataaaatggaaataaaaattatggttgtcataaggatcagtgcatataaaaggctcatacagtacctagaacataatggcacttggcaaatgagggctactcttctcataaaagagagactggagtttgtataatgaagggaatgaaggtcactgagtgcccagggcagtggctgagtcagggagaacatgatgtttttcctcgggggagagcgttgaagcactttcctgtatccagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgagtttctggggctggagtggggaagaggctgaggggaaagagggggccagggtgtgacccaaaacaggtgcctgaacttgcaggggctaactgatccctaagtatggatcccagtatctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcaggtgagaactgagatcacacagggattggggttgggtggacagatgcttctttttttattttttatttttaaaaattgagggccaggcgcggtggctcatgcctgtaatcccagcactttgggaggccgaggtgggcagatcaccaggtcagtagatcaagaccattctggctaacacggtgaaaccctgtctctactgaaaatacaaaaaattagtcaggcatggtggcacgcgcctgtagccccagctacttgggagatcgaggcaggagaatcacttgaatctgggaggcagaggttgtagtgagccaagatcgcaccactgcactccagcctgggcaacaacaacaacaacaacaaaaattgagatagagtcttactatgttgcccaggttggtcccaaactcctggcctcaagtgatcctcctgcctctgactcccaaagtgctgggattacaggcgtgagccacccaccatgcccggccaagtactttttttttgtttcatttttttttttagacagagtttgctctgtcacccaagcaggagtgcagtggcgtgatcttggctcactacaacctccgcctcccgggttcaagcaattctcctgcttcagcttctcaagtagctgggattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatgtttgggtggctggtaagggaaggctcccttgttttttgaagatagaaaattggaatgctgataggcttctctcagctgctccagatagacccctgtcctctgttgctttaggtcagtggttttcaaactgtattccaaggaacctgagagatatatggaatggcaccttggaggagaaacagggaggcacaggaatgtccttcatctttactttagccaaacaagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctactttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgacaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcacgaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgaggcggggctgtcctcgcggactgactggactccatctcccagcgggcgccgcggcgcggccacgcccccccactccccgcgcgcgcccggtggaggtaaccgcggccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgaccccgtcgggtgagagtctctctgagcaacccaaacagaaggtactgctgtgggtcccccacttggcacgcgacggcgctgggtcggcctggcgcgccctcccgcgcccacgggcgctaggctaggtctgtgcgcagccgctgtctcccgaggtcggccccgccccgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatatttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacgctggaccagtctgtgctgatgagcttgcaaggtcactgcctggggaggtagaggaggggaggagagcctcctgttgtgttcacgtcagcagagatgtcatatcgctctctggttcctgtggttttactgtgagatcctgtccaaaatgagggacgaatccaaagggttggttagcatggctatttctgctgaaaaggcatagataacttaaaagtttgtgaatcctaaatctacctctgggtggagctgatggtgatgtcggacttcagcagatagatatgcattttgagctggatgcttttggaatacaggaagataggaaccagaggctctacgttagtaaacatggttgaggcaagaggcagagtcggagcctcgttggttgtgaagacaagagtgtgagttgtgggtgatgttagaggatttagtctttagaggagttaaaggtgttagtctttttggggaggggagagaggagagaatgagaaggaaaatcttagttatctttgcaatctgaataactgaaggcagtggctgctgatcagatgtgaactctggctaaaaatttatcctaccacccgtagctagaataataacaagatctcagggtccttgtggctctggaaggaaatgattgtgagtgacttgagtttcgtcagatagttgtcagtggagagggactgagatcccaccaaggctagagaggcctgatgcgtactcagtaggaggtgcttcaggcctgatctttgagattttggttggagagggctccgggttttcaatgtaaacatagattgcaaggtgtagtctagagctctggttctataaattctgttttactttaagatactttggctctcactctagtcatttctacataattcttttttttttttcgaatcccatgacaggttaactacataattctttattaaaacaaattatgctttttactcatatcccatttcatttctctatttctctcccccttggattctgctcaggaggagctgagtgcggctctgttatagtgccccacctcctgcagtttgctcatgactctattgcagttgggagaaccaagggactatttgggttcgttaagcagtggtgatacctagaaatgaatatatggcgtgctcagaaacctggtggtgttctagagatatcactatcaaaagccagaattaggacgaagtacaaactacagacagatgagggagaagacaacctaattcttagcaggtactgtcagtgggagaagtgtctctaggttcgaggagagtgaattgttatgggccttggctgactctggagtagcagctgctagcactgtgcggtcaccaagcaggggaggggctgtggctctgctataaatagtgctgggagccagagtcgctatagagataaaactgaatcctattacctgcaggtcctctactgggagcaagggaaaggagaaagcagtattttgaggatttgagaggtattgcaaataggtcttgtttattgttaggtaggggagaaaaaacttctactcattacctaaaccaaatagggccttaagcatccagggagtgtgtatgtctgtatatatgggagtgcccgcagcagcaggtgagggagtagagggtgtgtgtgtgtatacgataatgggtttctctccgtgtgcattgaacaaggtcttaggccgcatgtagagcacagaggtagaatcctggaacactagaaatatgagaaaagaacttctactcatagaagaagtagccctaccagaaatagctgtgcagcggggtgaaacgttttatttagagaagtgtatagacacttaacacgaaataaattataattaagaccatgaaagcttttcctaattttaggacatagtttagaaatttctctgagcacgtctccctgtccttgcagaaatcctggtatttctgcctctaattcatagcctctgtaatgtatagtaggacaaggactcatctgtgggtattgtattactgattctgagcctgagatcaaaatagaggagagattatgattcagcaccaagggcagagctagtagcagtggcctctgggctcctttcttgcctgaaggagggagaaaagtggtgcagattaggcaattggggcatggacattttcatttgagatcacatgaggtagaatagccagctgttattgtctgagcatggttaactagacagtctatgtggtagttttacatcaagctgaatgtagattgttgaaacagaataattaagtttccatctagacctagaagtgcaggttagtgctagctagttgaggagtctggtttgatcctgatccaccctggagggatcctgagagtgacttcaatttttgttacaatgactgagtccagattagatggcctaggtctgtttttcagaaacagagccccaggcgttaagctggaaattaagtcattggtagggataggtaggtgaaccattatttatctacatttttttttttttcttgagacggagtctcactctgtcacccaggctcgagtgcagtggtgcgatctcagctcaccacagcctccacctcctgggttcaagcgattctcatgcctcagactcccgagtagctgggattacagatgtgtgccaccacacccggctaatttttttgtatttttagtagagatggggttttgccatgttggccagctggtctcaaactcctgacctcaggtgatccgcctcggcctcccagagttctgggattacaggcgtgagccaccatgcctggcctatctattttttaacattcgattctgtgagctcatgagcctagacacgaggctaggcaagcgtcaagttctcctatcattagtatgaaagtggaagaccttctgacctctgcctctggccgggaagaagttgagagggatgagtcccttaggcacagcagtggatcttatcagtactttttttcctattagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggtaaccaagaagagattgacttttgtcttaatatctgggatagccataaaatctgcagttgttcccttctccgatttccatgttgctttgcatagctcatcttctcctgttattttaccctgatgggagcatcgaagccagtagggaaaaaacaaaatcaggtggattgaaagcaaaaccctgctcttaactaacatcttcttgatgtcgagcaaatatactctttatacctcagttttcttattttgtaaaaagaaaaagtacattataagctactcctctatgtatacttttttggtaatttattagttaattcactttaaaagatgttaatcatcttaaggtgccagtgataattttattgtcaaaatctccccttcgtttcagaatagatgccttcatgacagtgtagacttcacttaggttaccagctccatgcggcaggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaaggtacagtttgctgctgatgcctaatgggggaagcatttagagattccatgtaattggtctttgaggggcataggaaatttcctctacagctcaaggtccttcagacctattaagcatatttagagtatttagagttaatcttttttcttttggagacagtctcgctctgttgcccaggctggagtacagtggtgcgatctcggctcactgcaacccctgcctcctgggttcaagtgatccttctgcctcagcctcccgagtagctgggattacaggtgcacgccaccatgaccagctaattttggtatttttgtagagacaaggtttcgccatgttggccaggctggtctcaaactcctcacctcaggtggtccacccacgttggcctcccaaagtgctgggattataggcgtgagcatcatccccagccaagagttaatctttactaagcaaaagactgctgcagagttagacctctttccaaaattgtgtttggagtaatgctggaatttggtgttttaactgtggttaggacagtaagtcttacccagtatatatctttacatttgcttttgccattgtatatactttccggtcctatctgagctcagagactgggctttcttaatgatgctccgtttcccattgtcatcattagagcctctgtggtgatactgagttgcagtagggtatcagcttctgatgctaatgtgtctgattcctgctgtctgcttctcagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtgagaggcaagcttcctagacctttctaggggagaaactcttaaatatgccagtggccagaccacgagctcttagaggacagggactacatatttttcacctttttgtcttcaggaggtaacatgatgcctggtaaacagcaggtgttccgtagatgtgggttgaattaagatactggtatcatgtgggatgtatttagagggtttaccattcattagggcttatccttaattgtactgacctaattctttggaaatatcagtagttctgtttcagtgagtggtcctgggatgggcagtacaagaactaggaaggtaagggagtgatttgcatatctcaggtgactgaggatcaccattgtgcctggattgggaggtggcaggcatggtggggcagggggcagtgggagagacaaagctggagctgtaggctcgatgaagtggaaaccaagttgtaatgttggaagctgttttcttgtaaaccatattttatgttttggagtgattcttactggatggctcatgacaggtggtgctacagtcccgagactacaatgcactctccatgtctgtgatggcattcgtggcaatgatctacccactggagtatatgtttcctgtcatcccgctgctacccacctgcatggcatcagcagagcaggtgagtctcaaggcgacttccggctttctcacctctgtcttcctgagggaggaggcttaatgctcaaagaagttgtaagtgagtgctggtcctcaatcctttgtcataacttatttgtctacaaaatctgactgatttgaactgatctggtggcaaggcttatgctattttagttttcatttatcacaacaaatgttaatgactgtaggccactggctacactgcagcaggtgttacgtgtgttacgtaatacagtagttcctccttatctgtggaggacacattccaagacccaccagtggatgcctcaaaccacagatagttccaaactctatagatactttgtttttttctatacatatataccggtgataccgtttaatttatgaattagacacagtaagagagtaacagttttctctttgggcatatatttggtgttttttggagacagagtctccctctatcccccaggctggagtacagtggcacaatctcggcccactggagcctctgccttccaggttcaagtgattctcctgcttcagcctccctagtagctgggattacaggcactgccaccaccacacaccaaataattttttgtatttttagtagaggcggggtttcaccatgttggctgggctggtcttgaactcttgaccttaggtgatccgcctgcctcagcctcccaaagtgctgggattacaggcatgagccaccgtgcccagcctctttctacatatatttggcttctctttggcatatcccaattgccagcatcagtacccttgtgctttggggccattattaagtaaaataagggttacttgaacacaaacgctgagattgtgtgacagttgatctgataaccgagatggctacaggctggacacaggggtgattcatgtctgggtgggacagagcgggacagcatgagatttcatcatgcttctcagaactattgtcctgcacttcagatatgatcaagctgcagtttaaaatttatgaattgtttatttctggaattttccttttaatattttcagactacagtttgcctcagttaactggaatcacagaaagtgaaactgtggataagaaagactactgtatacaaaaaaatgtaccatgttacctttcaaaaaatctgaaaaattctgaattttcaaatacatctggcctcaagagttttggaagagggattgtatctgcatttccttatctagaagaatccagacttgataagtgctcatgataggttttgtctttgtttctcaccttctttatcatttccacagctgctgttggctccaaccccgtacatcattggggttcctgccagcttcttcctctacaaactggacttcaaaatgcctgatgatgtatggctagtggatctggacagcaatagggtgaggttcttggctgaggcattgtagagtctagaggaggattgcattctagacccagtcctgagatatctgtttctagattcctttcaggaacgtcctaagttgttggataatttctattgcgagacttactgaaacaagtttttttaaatgctccttttaccttattagccaaataaacccttggttaggtctcagagaattacaggatttatttttgccagaattaagtgaccccccaccatatcctccaagagcagtcagacagttgtgatctgagggccattacatgtggtatagatcatctcttaatggtttccctggggtatagtttccagtaagaaactgtctttcagtgcaggcttaattaattatatgaccattctgcaatgtgaatacattcagactttggtgggaagcccttatgtgtgctcattgtaaaacttaaaaaaaataaaaataagcgtaaataaaataagtgaaaagaaaaaccataatccttttatctagagataataaccaataacattaagttatatttcatttcagatgcatatgtatgtcata

SEQ ID NO: 1301 - DNA, 214419 bp, Homo sapiens
atcatcttaacacagcctgactgttaataacaagaaaggtagaagcagctttctctgctggggactaaaactcagcatgattcttctgaggattaaagtctgcagtctggccccttgactatctgaaagttgctggtaaaatgagactttacaactcctgtggttctgagggtctaagttatagaaaataaaatgtacaacatcaacatgatctgaagactatgtggtttgatttaagaattttggaagtcaataaagtgaaaacacagttgttagatgtaggagaccacctggtggacttaacttttcttattatctttttatactatgacacttctgtggcatttggggaaaatagaaatgggaacatgggcaaatggcccaatacatctaatttaatcggattccattcctatgtcatatgcagcactgcagtctttatgctttctttactcaactgtattctgtttccttagaccattacatcagtcttgcgaagcatttattttatttttctggctgaagcagtaagtgtgggcaaagttctgtctgcaggatgttctggggagcctcgaaaggcaagatacttatgactgcaacagatgtcgatgatttttaagaaaatgctgactttatactgtggatctctacctcccttagggaaaaataagaagtttccaattgcctgcaagctataagaacagaagggctaaacggcctagctataaaagtggaacactaaaattctgatgaggaacaaaaataacagaagatttatctcagttattattagaggggaagaaaatttgtctctcagtggttcattctttggttatggttccacagatacgattaagaggttaaaaaatgtaaccctacattccgaaatactcatctctgtttcaatatgatttaaaaaaaattaagctgaccacagaagtgcaaatattccctactgttagtttagtattattattagtacgagtagtggtggagtagtagaaacaatagttgtacaaagtcttaatcatatttttccactgttaccacattataggtaaaaataactgaggcatttggttggtgttattgcagactccagatttgaggtttcttttaacctgctacctaataactgtgtttaggcaaacatgtatttgatcctattaggtatatgaacacaaaaaattcaaagcaattaaaaaatgaatagagaaataaacaactaaacaatatcagatgttgagatatacatgttggaattctgactttgagataatggtttttttttttaaaaaacaattgattgcttcattctttcatttgttcattcattttttcaacattcattgggaaacctctatattccaggcactaagctaggcactgcaactaaaaaacatgaataacacagcgatagtctctgtcataatggaatttacttgctgtttggcagtgtacgagaattagagaaaataagcaggttcaaaaatatgaaactgagtcttgcagcatttaacgaagtgaccaatagagaaaataagcctacagagcacgcggtgagaaacagagatgttctcctaggtcatcaatggctcttatgaaattcctcaagcactgtggactgcaaagttcataaaagaagcccataagtttgcctttaattagtttctgtgtccacagtaaccaacatctagtttatttagtagttacccttggtattttttgaacacaccatagatatttactgaatgaaggagtgaattgtttcaactcaatcaacttgtatataacttaaacttctttttttaattcttactaaaagcttgactttatcttcttacattgcctttatcttttctttattattcatttatgatctaaactgattttggggatctccctggttttggtgaaagtcaaacattaaggtgtcaagaagctttcactggacctaagaagcctcaaaatcagcctaaagaaagtcccagagaggataaagactcaaggaggaatttcagtgtagtacaaacatatttatataatactaaatactccaattccctttggagagtcattagaggaggcgttgcttctatttcttagaaccactagaaattgaatcattcctccagagtaatgaacctaatatgagttgctgtggtgaaatccttgttcaaaaacaaggtttatttgagcagattttatagcaccattagtcagcttctgacagaaattggtctgacaaacagctcacatatatttgggaaagtaattaattgtgctattatgtcaaggacaaggttttgtttgtttgtataatagatatgtgaacttgctctttcctgaaaatcatttcaccaatatcactgtatactcctgcagaaaccaaaaacacatactttcttgtgaatttgtgtgactcttgttttacctttctttttaattttgatgctatatacagaattatttggcctgagtaggcgttacattggtctgggaagcataagtgaaaatttcgacaagagaggaaagatgacattcagaatgtggatactagataagcttagaggaaagaagtctgtattgtgcatttgttgacaaggatggagactgaatgactggatgagtatttggagaataatgaaaattaagttctaaatgtccggcggatactgccagtacagcttaaaattgatgtaatgggaaacagaaagcggtttgttgatgagcaaaggtgtgttataaatgttttatgaatatgaacctgatggaataatgcaggttccattttgtgtggagagagagtggaagaaatatctgtcagcagcatattgtagtatattttccagatagaaggtggtgaaaccttgtgtcacttgtagtgctggtgtgagtcagtaagattgaggagaaagtcttttggaagaagaaataacagatttgtgtattttagtaagaatttggacatagggaatgaaggtgatggaagagttaaatgtgtccagaagaatagtgatattatttatcaaatataatggtttagctggtcaagttagcaacatatagaacctacttagcagaaatcactatgttaatataaatgttgttcttgactccaggagattcatagtctagggtgggaagtggacaagtaaatagatatttatttgtagttcaattgctgtgatagagataagtacaaggtaatatatgacagcacacaaaaaggagcaaatcacacacctaagggaatagttaggaaagcttcctaaaagaacaaaaatttaagatcatctctgaaacaggggcaagaagtaaccaattaagaaagatatgacagacagtgttataggtagaagtgacagcagggagaaaatgaagaggagtgaaacctaaattcttatttgttgaggatgatgaagggttgtgtataaggaggtgtataaggttgtgtttaaggagattagactttgtatcccctaagaagatggtgtgggagagattagtccatttatggagatattaccttgaaattcattgaacatttgcatgcagatatcatttagatagctagaaatgctaaaattgcagatgtgagatgaatttggaagtaattcagtaatagctgaagaaagtgataggaggagttcttaaaagtagtgtaatgaggaaagagccatagacttttgaactgaggtgtgggagagaatattcctaggtaagtagcaagtttagtcaaataatagcaatatgaaatgtttgtctttgttttaacataatgtaggtaactctccagaaactacttaaaaacttttggaaactgaattggtaaacttttattttatttctcctttccctctggtattttccctttcaatctgagctacagaaccatgagttccagttcatgcacagtctttattgatcttttagaatcacagattagtagaaggttagagaaggaagaaagctcggagaccatctggttaagtggttttcatactattttttttaaaccacaaaatgttttctgaccaaaaaaaaaaaaaaaaaaaacccaacatagaaacatttttaaaagtagataaaagtaaggttgtctttattggagctgatgaaagagtttgtgatttattatattgtctcaattaggttcatctatccttttatggtagactcagaagaaaacctcaagctcgaaagagcagcttttgaaaactatgcccaatattttcatttacagaaaaaaaactttgctcagagacgtatcattatatttaactttaaaacaaatattctgccttctggaagaattgcttacattatataaagaattgttcttcactgatgttacttaaaaggctttaccaggtgcctttacttagaaactggactgattaatgaacatcaggcttcttgttggtgtaccccttgaaaacatgggctaaggaaggagggggtaactccttcatctttccctggccttggtagtacatgtccctttgataaaactctgtctgttctgccaaagacaaatcatatttctatgaaaagtttttacttaaaggagaaaagggaaagtcgggaatcaaatgttgagtgggtgaaagttaaaatgttttttttattttaaaaacaggtattaatgagaaaaataacaaaaataactatgggagcccttttaagctttttttccctggaataaaatgtactgtatcaggaaggggcccactcacccaagagagcaaattaagcctagttttaccttcttgacacttcttatgtttagaattttaccttagtaagatatagaaatatatttccaataaaataaatttggaaaagttaatttatcatgatgtttccagaatgaaacaaatattttagtgtttttatgtatggtaaagaggttacttgaccacttatacttctttggttactaacacttattttggttttactctgtcagacactttgccaggggcaggtatgtaaggcaaagatccattgaccccactcttgaggagtccacactaaacatgaaggaaacaaatcattgcaatgtggtgtgataatttgataatacaaaatcaatacaaagggaacacaaaataatgatgtttctatatgaaataagatgatgtcttcagtaaattctaaaagatgaatcaaaatttaatgaaagagagttcgcggttaaccttgaagtgaattatgagggagagtatatacctcactctttcatctgagttggaaaataatggcttacttcgtcagggaacatttcataaagcagtagctgatggcagtactccttggccaaaggaaaaagtaaaactggttatacaggaaaggtaacagaggtcagtaaacaaaagaatcatttcgaaacagggcaccaaattctgggcatagagatggagatcgggaaattgattgaatgacagctgaaatcactgagtgaacagaaaaaattggaagatacttgctgagaacaaatacttggaacaggcatttatttacatgattagattttatcttttcataaaaatctgataatgtaagaaattgttcaacttctttttctatgtatacttcatattccaagaatagtttctaatgaagtttaataaagatactagagagagaatgaaaatacttatttttattatttttggtttacattgaaatggaagctaatgggtaagtcttctcaagtcctttataagaaaaagtcaaagtaaacatcactgatggaaacagcctcaattctgtactcaacatgactttatctgcgtgtgactgcagtttttttaatataaacatttttaaaaatcctgaagctatagattatgcgcacgtcaactaccatagtttctaaaccatggcaagtgttaaaagctttctctttgctgtttatatgttgctgcagtagctaatttcagaaaaggaatttgcagttaaatttgatggagcacactgcatctgctcaattgcagtcagagtctaatggtgctgccaaaaggctgcattagcattataagacaatgttctccagactcagatagatgtaggacagacttcataatagagactcttgggtcactgaatctaacaagaatgtgcctgtaaggctctgtcacagaaaaataactggattcagtcatatatctatataatctcctcagaggttttacaaggaacaacttcatcttgagttcttatgaaaacaaaacacaaaaaattactgatactaggatgttgatttcttttctttctgaatcaagctgaaattcttgaagattgcaagaaagatgacagccattcagtgcttgttataaggatatttaataaatttgggattaaattagattaaattgacatagtagtggtattctgggatatggatttctttggaaatctgatgaaaactggaaatcctctaccagaaagagtacacaaccacatctatataataaatttagcgtacattttcagggggttcagccattcccagaagggtatttttggatttcaatttaaaaacaaaacaaaacaaaacaaaaaaacttctgtaactgagaaatgttgggaatatttggtccatggatttctaagaacagaaataaagaggacaaattattttacatggaacaagtcacgatgtttcattctttgaatgaatttaccatggcaggcttcttctaagggagacctcccttgactatctcctctaagcattatttcttatcccaccttacccctagcaaaggcagtcactctttatcatatatattttttattttttcacagcaattgatacaaccagaacttactttttattaattttttgttgcagcagcctgttcccattagaatgtaagcacatgaacaccttatttgtctgttgacggctataaccctagcatctagaatgtcgtctgggaatacataatgcagtagcatgtggttgtaaagttggctaactacccactggtaatatatatgaattcatgttaagtcaagaatgatatggacaaacagccggctggaaatatattactgtagcatgataagcttccataacacacttaaatggtcagtgtttcttttattcagctaatttcttgctccatttaaacattttttgtcacaaaatattaattttcttaaaatgcctatttatatgcaatgttttcaagtcttaattgtggtagggaatatatattatggcactaataatataaatgactcttagtcatttataaaaatcagctgcaagctcttccgggcataatataacattgatagggatgaaacatgacactgaactgcatagatgtgtatggtttactagcagacttctcagggcaccaaaatattcccaagaacttttccatgttcaccatatcacttcatatctttaactacgaataattatatttatattatttttttagattgtcctagatataaaatataaaagttactatatcctcttagcaacgtataactttattcctttcttttatgtcacttttaagtcatgtttaataataatttatatctgtaaaacctatttgacacttgataaaccgaacttcaaagggagtaagttttatgccaaccagtttgacattttggagacaaggcaggctccaaacaggattaaaattccactatgcctggtagatcaaccagaagagaaaaactgcatatcataattttaagatgtaagtcagataaatcagtttggtaaaatcagttgggggaaacatttttttttctgattggctaactgctagagcaaatagttttctattctttattcaggagattttcaagatttgcattcatcgtttcttagaaaaataatgaaaaaattttcatgaagttgttttttcttccataagttagtgctgtcattattttattttctagtataaggccaacaatgcaaaagaacagattttattaagtcccagactttctctgaatccactagtgatgacaaattgttagctaatagttttatgctgagtttagttaacttttagaatgagaaatgattctacaatcttgatttcagtatggatactgcttgctgagtgaatatttatgactctgggcctttctataaataactgtttaaagctataaacattaagtaatgaaggctttgtttcatcctatagagtccgcatataattcatgctcctttcctagaacactaggtagactatttcatagtagcttgtctcatgttctacttatcatctgatgatggagaaagtgaagtacactttgtttctagatgtccattttttttaagcttataaacaacagaaatgtatttcgcacagttctggaggttgggaagtcccagctcaaggtgccagtacattctgtgtctggcgagggcccttttcctgcttcatagatgattccttcttgctgcagtgaatagagtagctcttcttccttcatgagcatccaacctttgatcatgtcatgggaactttatcacacagagtacaacaaagaatataatcataactactctaacaagtcaacaagatgacattttggattctgttttccaaagtattatatttctataaagcttgacttttaaatactctgcagtggctaaagtgatcagataagtttttaaatttttttgtaaattattctttaaggagaataacactaaagaactattacatgtaaaacttaccttaatagggaaataattggttttattttgaaatgaacataagcataattttatatagttacatttttaaaataattttgctggttgaaaaattcatacacctaaatttggtaattattttaagatataaaagcttgttgtttcttattaaaagaagaaacgataagaaattaacattattttctgaagagaagatctcatcagagagaataatactgactacaaaggtgaaatgactccatgagtatggagacacgaatcagagattcggagtttgtaatgaatcttaactaatcatagttctatttatataacacatctgctgttcttttttcttttatctctacatattggaaacatactgaaatactatcattatctgaactcgtagatgtaagtttaggtgcaaataataagcattgtgattcaagcgccacaaataacacacaaacacaatcagaccatgaacatattattatttgagtgatatgaaagcttgttaatgttctggccaattcagaaaatatcagttacgtagttcagttaggattaagactttctgagcttggatttctccaatgctttgattatgtgcgtgatttaaaaatactcattatttccctcgtaagatttattttctttgttggagattaaaaaaacagtgaatagagtagttcttatttatttcaggcaaaaaactgataataatttattaagaaaaaatgcttttaaactgtaaatgtttaatgattatcacattttaaaattcatgtttccccacttctagtgacaataataatatctgtgcttgctctagcagcacatacactataaattggaaatcatgataaaatcttacatagaaaacaataaagtggtttgcaagtttcatacctcatgaataagctgtgatcagccaaattgtgaatgtatgtggtaccatataacatcattttaaacaagtaatgatgatccagatatctattagaggctatctacttaaaatttcattcatttttaaaattaaagtgactttctttcctcatacaaactcaatatatggaacacagactggttgtttttgtggtgtgtgtacaatgacaagtgaatctcttaaattttccaactcccagtagcaaaccagagcttatgtaaactcgttaaaaaaagaataaaatattgcaaaaggacccagagtagtcattcaatcatgttaactttttgtaggcaaaaaaagaaatcattgttaaaccttgacagtttcaagattgggttatttaattctacaattttgacagtgagatatttgaggatgatgctttacttgtgacatttgaaatgaattacacttaaatgttaggatttctttacatgatgctttatctaaatcattacatccttatctttcaaagaaaatcatggtactatgtatgtgtgaaactaaacatttaaaacaatttgttttattatttattatagaatatactttttaaattgtaaaaccaacctatattagtttccataaagctgccttagggaactatttttttaatatgtggaaaatacatccaaactcaatgaaatgtttgatatatagttagcttatatgtttcatagagttattaacataagtattattaaagctcttcccttttggttacattatttttccacatacagtgaatcaaggtaacaaggggtcgtttttccattttgttttctgaattggttatttacacttttgaaaccacaaagacaactcccaagtctccccatattttattttgcacaaatcttgccaataactcctcagggctcataatctaaatctagaggacattacagaattttttttttctaagagttttcaaatgtgcttattttcagggtcctgacataaggaatttcattattgcaagttgtatgtaaaatataaattaaatgctagtacatttaactatgaagaacaaaatttctttagtgtataataaatgagtagagtcaactcaaatccaatatttggaatccagatgcaccttgtgcaagaaactatatgggttgcattcagtggagtgaacagagtaactcagttgtatgaaatcagttgttgcattcaatgtcagtggcccaaaaaacttggggtaaaataaagactctatgtcaggtgtctggtttggttttcattttagtttataatgcttatgtaaaggggtaagccaagaagattattcttgaccacacttgaaaatggactcaattactgaggttaaatttcagtgtattttataaaaaatattactttcacagaagtgaagagatacaatagcacaatggtggttacaatggtagaaatacatactgccaataaaatgttagcaagagatttaaaaatgactgtacagcaccgcatcagagaattgtgttaacagcaaaatgattaatattatttttcaatataaatgaaatccttacattttttaaagaaataaatgggataaaagtgctttttgttctcctaattcctaccaaaatatttcctgatatggagcaaaagacagtaaaaaatgacagttttaaaaaaaaagacattcgtgcatttaagccaccattagtctctgactctaatataaggcagatcattaatctcttgcaaaactatgactttagccacttaaactctttttttttttagtgcttttcatgacaaggacatgataggccttgtaaatttagaagttaagatgtgtttccaacatggtaagttagacaagctcagctatgtttttgaaacaccaactttacaataaaaatgctttgctttggagaaatgatgaaaaataatagtgaagaaaaaaacggaaggggtcttatagagtttatcacaaatcacactgtttaaatcaatgaaaacatgtcacatttgcctatgtgtcatcctctgtcttgatgatatggaaaagggtgacattgaacagcacctggtggccattgttccaggcatagagagctcgatctcttgcattgtagtcaagcatggatatgtgaaagtattggttatggaagggaatgtctgtgtactcatatgtggaggttttggtggaataggaataatacaccttggctccagttaagtgggagttggtgacatacagtgtcccacagatcatgaaagattcccctgcacttctcttggggtagccagtgctccagctcttcatcacctccaaggtatcttggttaagttggctgatgacaatattgcctgcattctggttagttgcatacacagcccacagcccgatttcatcagccattaggtcgatgtcagagaatccaccccatgtgtaggggtaaacattatgaaaaccagcatactccaggcttcgttgggcaagcactctccccatatcaaagctgtatttgatgatgatattactctgatacttgttaaaatagagtgagccattgtagacaacatggttagttcctgcccacttgaaaggaaggttgtatgtccttgattcagccccactgacaaagtctgcaattgatttgtattcacgaacaattttattgttagtataactgtccatgtaccagacctgagaagaaggaaaaaaataaatggagtgactaaattctgtacttttctgataaccccaaaagaaagacagtgagagtcaacacttattataattctcaggctctggaagccacactatcttactgctgacctgccgcaatgtatttcaggcttttgtaaaaatattgctatggtctgtccatgtggaaaagaaataactgaatttactaccttgacattaatttgcttttttgctttttctctctttgttttttaaattcctgaccatttggtgcatatcactgagtgaaccaatcatatgtcaatgcaaattacacctgataaataatgccatcagtgaaaactacagcaaatacaaccttcagcaaattacatttattctatcccttgctctgaaaaaaatgtatagtctagtttttcgtattcaattgaaataagtaccatagaatcttctagaaacacttgtttattgggctagcctgtaagtacaactacattttaaagaaaccattttactaacttaataactaacctcatttagaaataaccctagagaatcttaatttttactgagttctgtaataggacataaatagagctatggcaagtttctagtatattgatttatatagcacaggcattgtcaacttatgaaaatacctcccagaagtttcagcgctatttcttttaaaattacttctagactccagggatatttaagcttatttagtaaattggttttgcccttgagtttttcacttatttagtcctattttttcatactaaagaacatattttagaaagagtaggcagggaagtttgcccttgagtttttcacttatttagtgctatgttttcatactaaacatattttagaaagagtatacaggaaattagcccctttcaagcataaaacatgactaaaatcaataaaaattagatttgctaaagtgatgaattggaagatggaacattttactaaaatagatttgtcattctttcgtagatatgttaatattatcaaacagaaaatatttgcaaattatgtaccagttttcaagtacaaacaaatatccctgaagaaaatgaatagtccagaagagaaaaagtgtaagcagaacttaattctaagcaaaggtgtttgtgggagaaacatactctgttgtttttctcagatgctaaagggtctgtcatccaagcaccaaatcgggttccagatgtcttgactgtaactgggcctgtgattttcatcagtttgccacatgctgaaattagagaaacacaaacgtgttaggtgaacgcagccaatgattccaatacgcatactcacactaagagcaaagaaggggatcataaaactaagccaatccatggaattaatatcacatttctgaataaatgattattcacaatgggtgctgggcctttaaccaaacattgaaccatgaggagttgctttttcaatgctccaaattttaaacataaaaatttaaagtgggaaatgatttgtacaatccggaaagaaataaatgaggaatatcattatcattataccagttcagtggctgctacttttaagtaaaaagttagacaaatgaagcaaattgcccatagacctgtttagttgatggccagaaactccttcccttcccctgtccccatgctttgtgactatggataacttataccagccagaaaaacactaccaattgattttcattctgtttggcaaagaagaagcccccaagaaagataactttacagtctataagaataaaacattcaatcacagtctataagaaagaggtagagattttaaaggtaaatgccttatacagctaacaggtctgacagggcagatatgaacacacaaagaacaaaacccccaaaactcaaaccttcagaccctgaagtcacatacagatgaaagatgaagagatgtaatacgtgacaaaaagactttaatgaaaaaagttgtaatatttttatcagcccagcccacctgtgaataagatcttagaaatagcttggacttcataaattccaaagccaaaaccaaacagaaagctagacatttttgtgagattttaaaaaaagattactataaagttttaactgtattttaaaataatgtttttgtccctttacctggattatattagtttgggtcacttattatgcttatctttcttttttatttattttaagttcaacttttattttagggatacatgtgcaggtttcttacatgggtatattgcacccaggtagtaagcatagcacccaatatatagttttatgagatttttgaacagcaaaatttagaagtgatttattaatcatacacattgtgaaaggcaatatgactgcctataaaatgttgggttttggtctaaacaaaagtcttctttcttgtccatttatatcatgttattttcttctatttcttttcttaaaactcttttgggtcctacttgttctacatatcttctttcctcctctgactatttagaattgatcaatttctattagttcctgttggttcttgtttttttggaaagaaaagaacacatacccaaagcaaatcaaagacaaactaactataacttgaagcttattttggctcagttttctctatatgtgcttcttataagaataatttataattggcagaatactaagctttgcagttaggaagatgatgaatggtaacattatattttgcactactagtttagtgataactacaaatttaataatctctagcatttcataaaacttgaatcgaatatatttttccctttttgtaaaagaaatcaaatgtgatggcatcattatatccatagtgtgggttactttatgatttcctcaaatcagtaaaactggaccaataattcagaagactttatgacattatctatggaattgcaagaccttgcattaagcctatttagaatatataagctctacttggtacaaatacataaacaatatatgagtaaagtagtattggtttgaactagaaaatgttaatcatattctgaatggttctagttgagtatattttctgaatgcagaataagtagaagtagtattatttttaataatgtcctatatacattttttaatcaactgatgatatgagcataacaatttcaagtgtaagtagagtgtaacaaatagaagggcctctcttttcccctaaaaacgtcataaaacatgtgattttttttctaagcatggaaaagtaattctgacttaagatgatggagtgatacatgattttatctgctttcattttctatgatctcattaaaataatagtaaaggagtaaaacatgaggggaaaaaaacaaaagaaaaaaagcaaagcaaaggtacaagagccattagtgaagaagttttaaccaatttccagaaggcagggttgatgaaaagtggtcattaaagatgaagatggaataagatgcatttgtgtctatgcagagcaagtgagacccgaggagggagatgatctgccttgaagagaaaaaagaaaggagtcagaaacataagtagaaagaatgctaggagtgagatgggactctgaaatcaggcacaccacttaaaccatgccttaagagcaattgattacatcttcatctgtagatgcgggactgcagaaggcaaaggaaaaaaaatatgaaactgtgttggtgatctgagtatacctagggtgattaatacagacattggagggccagaagaaagcctcctacacaatgacgttggtggtttccctgcctactcaccacagaaagaactgccaagccctatcttaataacaggagtttccaagcacatttattgttcaaaactttaaaaatatatgtataaccgaggatggccagatattttcaaaaagtttgtaagaatgactgatgtaaatgttcagaaaaaccagggctccccacagaagagataactcagaggatagacaagatcctagtaccttctaagagatttgtataatatatactgagtattgtaaaaggaaaacacaaaagaactattagaaaacaaaaatataattatattaaaaaatagattgcaagataaaaagagttatctccaaaataaagcaaaagagataaaaatgaaaataagagaaaaaatatggaggcatctaggatcaatctagaagctccaacatccagagagcaaggtttctagaatgaaaggagagagaaaaagaggggagaaaattatcaaagaaattatacaggaaatctccccagtaacaacacctaaatattcagattaaaagaacacatgataatgaatgaaaaaaagatctactaaaagtagttctaaaaaactactgtgaaatgttagaagattaagagtaaattgaaatggaaactttttagagaaagaatatgagcttgtcacatgcaaacaggtagaattagaccagaattgggcttctcatcaccaatactggatgctagaagacaatgatgagggcctttatatttaggaagaaaatcagaggaaaacagaataaagatattttttaacatgtgcactttccaaaaatttacctacaatgaactctttcttcagaaattacttggggatatattgcagtgagtacaccaagacaggggaagacatcagacaagaaaatagtgacttcctgtcccagaatgacaactatgcagtgggctttgagaataatcagcccagaatggaaacacagttccaagagggaggtctcagaaataagtggaattgatacatagatagactgtatgagatcctctagagaaactgggtaatgcagaggcatttattgatgtatacaaaataattcacttgaatttaactctggtaatagcctccattgaatggaacaaatatgacattgggcttaaagaggaaggaaatgtgtctaagtccaccacttagctcccaaggaacaatataaacattgctataataatgtaaacactcatgtctaacttgtagaatcagcccataaactaattacataaaacttcttacagatctcatctgctctgtgattacaggaaagccaaaatgtttccaaccatgacaacatggaagaataggtaaagtccacgttgttagagaattaaacattgggagaggaaatggaaagaaagatgggggtgtaactgtcttcgtattttaaaaatatggaggtaagagatttttcctattgttgaaaaataatgaagattcaaatctaagacttgaaattacaacattgatagggttgaactgtgaatagtcatgaaatcatattaggaggaaacatgaaagaaagcagagttggagaagttatctaaatcctcatcttgcagagcaggaagtcaataaacaatgtctaaaactgtaaaccaaaataattgaagaaaaaaagcatgttaatataaatatagacataatcactaatagccctaaaattaaactgttaaatgtggttgaaactgcggagcagagctaaagaaggagactactgctttttattctaagcatacaattttccagctacacgcatacaatatttaggttataatgtaaaaagttgaaatagctgcaaaaatttagtagcctttaattttataaagcaaaaatcacatttatatattcccttttgaaaaatcatttccaggttttacatgccatgcttccttgggaccaggaagtagatgaaaatggaagatgtgaatagtttgcagaagtggaaactgtgaatattctgcattttaatttggcctttatcctgtaaggaatagattgaaactctgttctttaaacttttaactcttactattgacatagcaatctcttgctctttaattctttcaaccttaaaaaattagaatttatattatgaattataatatttatcacttaatatatatatcaaagctaataaatttacagtggttagtaaatgtgcaggagctgtaataaaagatactgtacatatgattcaagtatgaatgatatgcattttcaaagtagttaaatgattacaatcttggaaaaatatactcctgttgaagatccactagttaaaggagaaaatgttagtctaaaacttaaaaatattttaaaaatgtgaatgatttttattattatttgaaaaaatatacatacacaggatctcagaagtcagttgagtccaattttgttctgaatacagattaatacaatgtctcgaatatgaaacaaacataatgtaatgtgcattcccacaaaactttatactcagaggaaattaccaagcggaaacacaatctgtaaaaatttatggcaacttcaagttctttctattgtccaagtgaatacagattttgtagttatggagtttgacttaacattttagatggccaaactaatgacaaatgggatctaattaaactaaagagcttctgcacagcaaaagaaactaccatcagagtgaacaggcaacctacagaatgagagaaaatttttgcaatctactcatctgaaaaaagctaatatccagagcctaaaggaactcaaacaaatttacaagaaaaaacaaacaacccgatcaaaaagtggacgaaggatatgaacagacacttctcaaaagaagacatttatgcagccaacagacatatgaaaaaatgctcatcatcactggccatcagagaaatgcaaatcaaaaccacaatgagatactatctcacagcagttagaatggcaatcattaaaaagtcaggaaacaacagctgctggaggggatgtggagaaataggaacattttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatgtttattgcggcactattcacaatagcaaaaacttggaaccaacccaaatgtccaacaatgatagactggattaagcaaatgtggcacatatacaccatggaatatatgcagccataaaaaaggatgagttcgtgtcctttgtagggacatggatgaagctggaaaccatcattctcagcaaactatcacaaggacaaaaaaccaaacaccacatgttctcactcataggtgggagttgaacaatgagaacacttggacacaggaaggggaacatcacacaccggggcctttcatggggtggggggagtggggagggatattattaggagatatacctaatgtaaatgacgagttaatgggtgcagcataccaacatggcacaggtatacatatgtaacaaacctgcacattgtgcacatgtaccttagaacttaaagtgtaattttaaaaatatataaaattaaacttcaaagtgaagtttgatttaccagcgaaactgcctcctatggtataggtaccttattgccagactgaagcatgatttgtacaaagcaagaagacacaattctggtatttgtctcaaatgtctgcatatttcagatgttgaggtgtgcataatccgatgttgattagttgaaacctgaacaagaactgtccttggagctctgaatcataccatgagccttatctaatcgacatttccaaacaacccacagcacatcactggcttggggtgtctttggcttcgatggtgcttgaatctaatccagccttgcatctctatggcaaagggatactgctgagtcttaggttgtttcggccaaaacttaggacagaatttgtaccggaggttaaaagcttctggctcttaaactaaacattgggtgaccatggtaaagtggtcttttggctagttgactcttttattttgtacctggttttgtgaggaaaattgattcttactccagtcaatcataccttagaaagcaaactttactttcttgtagcactaagcatttctctgaaatatgttagagggtaaaaacaatagttactatttaaagatataataattaatttattcatttgacaaccatttactgtgaacttattttgtaccagaactattctaggtgctgagaatacaaaggtgaacagggaggcaagtcgcgtgttatagcttcccaaaatactattgcttatgcttctcctttctgttgccttttttcttcttcttttctcttttttaaatcaactggaaaggaaatttaaagaaagaagttatattggaccaaatctgtattgagaagaaaaggacatagcaatgagtgcactaaatatttgtcaatattaaataaaaattattgaaattcagtcatgagtactgtaccataacagcattccgttaagacagtcttcttagataacctgaaatatatcttatgtttagccatatttgcctctactcttcttccacaaaacatactcataagctgtcaacatagaaacaagcaaattaaactactgttccatgtttagtgtttataaaaaatgaatatgtgtgtctagtaaaaaaatcaaatatagttatatttcaccatagctcaccgatttgttcctgcacacgtgtcttaaaggtagttgttctgtctgtacgatggaaacttatccctataatcaggaaatcaatatatatctagtgttggccagggaaggtcttatgaacacttatgaatttagtgttttgcattatttgattctcctctgtgtaatcttctctctgtcaggttgcttcatgtctgtcatccattagctatcttctctctgaccagtgactcaaaatgcccaattgcaggctttgtcttcctgctattactctttatttgacctcagtccatcacaacttttattcctggagtcaaatcctttgggtaaactaatatttgtagtgttaatctaagaaacatactttaaacgaagagttaatgtcccaaagcattaacaatttaaaaataataactgcatcttcggtttcttattctgaaatagtgaatacattaaaaatattacactccaaagcaatacacttgcttaaaacccaaggtaggtatatgataattatgtatgaaaatgtcctttacttttcactgagtaggggacaaagtgctttgcataaagtttctccacatttgatgaccatgtaaagtggtcttttggctagttgactcttatttttacctggttttgtggggaaaatagattcttactccagtcagtcttaccgtagaaagcaaacttttaggtggttaaaagaacagcttttgtatgtgacctatgtgcttcattcatttatttattcattcacccagctaaggtttttttttttttttagcagaaagcactgttccagatactagagttaacaataatgagaaagcatgacacctctgttctggtgaagcttacattttggtgagaagacagaaagaataaattaaaaaacaaataaacaaacaaactaaacatatcatacagaaataaatttaatgccaagatttaagtagggcaattttataaagagtgactggggagctacttgatattgggagggtaaggaagacctctcagtgtgtgacatttaatttgagatcttattgacaagagaaggacatttaggcatttagtttatttactggagcagttgtttagtggatttagccatttagagaatagctaggggaaggcagcatcttaaagtggttggggacatgggttaaagagtcggcctggatttgaatcctgattttatcccttattcgctggagaccttgaacaattttctaacctctcagtgtttcatgggtaacaatagaaataatatcgtatcaaagtgttattgagaagattaaataaaaaatatggctacatgtttaaaatagtgcttggtacatagttaagtacttaagaaataatagctattattattgttattgcaaaggccttaatacgcttgatgaattaagaggagcaaataaacagaaagaagatcaatgtatttagaatacacttggaacagaagaagacgagattggagagatgagtagtccagtagtccacattgtttgtaaactttgtgaagacaagatttggattttattctacgaatgatcgaaagtcattggattattttaaagggggaggggaatgacagaatgtaagctgcaccttagaaagatctctctagctactgtatagaatattaattgtagagtggatagagtgtaaacagtctcattaaaaggttatcagttttgggaggctgaggtgggcggatcacaaggtcaggagatcgagaccatcctggctaacacggtgaaaccccgtctttattaaaaatacaaaaaaaatagccgggcgtagtggcgggcacctgtagtcccagctactcaggaaactaaggcaggacaatggcatgaacccgggaggtggaacttgcagtgagccgagatcgcgccactgcattccagcctgggtgacagaacaagactccgtctcaaaaaaagaaaaaaaaaaaaaaaggttatcaggctgatttaggtgaaagatgatggaagcagttgtggagatggagaaaagtagatggacttggggtatgtttttagaataaagtggataggactaggctttggattagatgtgaggaaagggaatttaaaaactcaaaaaaaaataatcaaagataacatctagatttttggcttgtccagctagacagattgtagtgtcatttactcggatgaaatgactgagggaggaatgggtttgggagcaaaaataaagaatccaacagggataattctaagttgttcatgactattacacgtatcagtagaaacagcatataaatctagggaacagatactcctttgagttttgacaaaacagttttgatggtttttagcataatgatgacagtgaaagccaggggctacatattgcctcagagggaaggcatacacagaaaagagaaaggtatctagcacagaactctgtaaatcacaatatttataagactcatcaaagaagcccaagaataagctataagttggatagaaaaaataacgtggtattaagaaatccaaaagaagaaagtgttttaagaaggatatagtactgacctgtgaaaaacaccactaagatgtctagcagcataagatcaaagaaataaccataaaatttggcagcaagagtcactgctgattacaaaactcagaaaaagtgtggtgatcccagaaaatgaatcgaagttggtttgaaaagaacgtaaccaaagtagcagctataaaagattctttcaagggaaaagaagcagggagacaggagtaggaaaatatgagattacaggaagtttttattgttgtgctgatgatggttaagaaaggtttgtttataaaaataatctagtagggagcaatacgctgatgttgtgaaagacaataattaaataaatgaatcccatgagcagatggtagtttaatctgtttagtaaccatgagtaatcatgtgcctatctttccttttataatttttgtgtgtgagtgtctgtctgtttttactcccatcaatttcacaggaaatgttcttagagtggtatattccatccaggtttgaacactgaggcatgagttaggaagcctggtttcaaatctaggccacagcattcaatcattgtatgaagttggacaatgccttattctctggagtggaatttcctcatctataaaatgaaaattctgaagcttgacattttttcattttaactaagggaacattgaatagatagtggatcaatagcatgtatatgctggtggacagaaggtggtatttgtggttgtggtcaaataaacaccatcagcgttatgtttatgatcaccatcatctacccttattctcaggaagcaaaaagctgacagagctctcgatgttgatttcttcttagtagatgcttcccttacaaatggttattgatttcctaagctagaattcatcttgccaaatgaaattaacaaaattaaagttacaggaatgtataaaactggcagtgtctttgtttataattttgtgtaccttagtgttaagtaacataggtatctccagattctaatggagcatagatactgtaaaatgtggtaaaataaaataaacaataagagtcattttttacttctcagcttcctcacactagcctttgttcaaataaatcattatctttctcactttactctcactttttatgaggacaaagggagccagacagagaggataattttcccaaatgcctggaagacaaatgttcctgcaaaggtggatggcaaagaaggaagttaggagtcttgcttcattgattttctcctgctatgctcttctgtctgcagtaagatatgaaaacattagcatttataaaatattgtatgtgcacattgcatatattcagaaaatgtactgaaatatacatcttaccaaatgcagtaattgaagaaagtgaccgtgaccattttatttctatcatgacttttggactttaaatttcttatagtcagttacaatccatatttatcaatcagtagctcaggaaaagatatcatttgggattcagcaggaagatcagttgtttggactaacgaagtgtaaaaaccatctgtcctctcttttatttgtttacatatatataattatttcttatataattgtactctgtaatatcctgcactaatagctctggatttgaatcctaaggctatgcccttataaacaaattaaatggattattgaatatgtttatggacagaatgttatttctttttacttaaggccattagagaactcatgcattaagaaatacttctgatttgatctttaaagtctacctatttaggtacttaaaataagtttgtctgtaccatacatttggtagtaaaataaatttatattatttaaacttttatttgcatgtctagccttatgagttatatttgtgaggtaaaggtagggataagaatggatatttaaaatgttgtattggatagagcaccggaatgagtttctaatggttatctggctaatgggatcaagaataatatgaacattctaaataaccaacatttttcaaagttaacacagtttcaccttttaaattatttttgaaactcccttgactcttccttttaccttttctgggattaagcctaattatgaacatatctttaaggagaagcctgttcagcattcaaactgaatgacaacttgtgttatgaaatcccaactaattttacaattcctacttgactttggaaatacaggttttatattattaagaggctcataacttagttataatctagaaaaatgtaggagataagaggaggattaatgataaataaatatatgataaaatttaccaattaccaaaaatatggctaaaatataactaaggttccagagttccagaagaaagaataaaatgcatagcaatggagacattgccattctattttacaacctagaattttgggaagagcaagactgtttttggtaaatgacttatttgaagattcaatttaatttaaaggaatagtcttataaatttcctccattgcatttctgagtcaaatctcccacatctctacctcaggcacacagcttgacttttttgttaattcctgctttcactgagatctttcgtgtctcttgctttaagtgctaataaaacaaagtatcagatgttttggaatgaaatactgcattgccattgaagagagaacagttggcaatgacaacaaacatgaaaaaaggctgtgcttttattttccttccccccaaaagctttttggctttgtaaaagatatcgatgtgttttatatttgacacacattgatttatttcttgaaagcaacttaaagcttttgattttacaaatcaaatttgctcttgaccattctgcagatactaatttttgtccactgtgtttcaggtatattgcaatggtctccagaaattcaactagaacaagacattgattctgatctctcagtgcagggagaatttatctataagggtgtaaagatttaaaacagaaaaacaaatgggcattttctgtaaaatatgttaatgtactaagtgtcatgggagagtaggggaggtggttgtgggagaccatgccaggggactccaaccacattaaggaaaaatcatggaatagttaaagtgggaaggaagggtgtcccatgacaagggagagcaagttcaatgtcaagaaggtaaagaaagcatgcgcaattgagaaactggaagattagaatggttaaagcttagagtaagtgcatgatgagaacctgagaactcaaggcctggagaatcaggcagagcccatttcatgaagacaaagcatgcaaaggtgtttggattccattttaaaggtaaaccacttgaatacaggtgtaatataacaagatttgtattggggaaagatcacactaaatattttttagtgatggagagccaaaacaaatgatcaggaggccatttgagtaattcagttgaaaaatcatgaatgacactctgaattcggctggtggaagtgaggatgcagaagagctggttttgagaaattggtgagggggagataaaagatgtggcgattgcatggcggtgtgaagttcagagaagaattaagaatgaatctagcctcttttttttctacaacaattgggtggatggtggttctagtcattaaattaaagttattgaggtatctgggggggtctttattattttgtactccacaaaagacattatgtatggggaaagaaatctcagtctttgaactcagaaggacttccatgtaaagtgattgcctctaacatgaatctttggcaagttaatttaaactttctgagtatctgttttagtgaagttgatactaatgcctaacccagagttcttgcatagatttgaaatagcacatgcaaagcagctggcctagcgcttgtcaagcagtaggcatccaatattgctggagttattgacttatgtgtcagttgtccccactaaaatataaccttgacaggaagaggaagatggtctccttcccatccttgtatccacaaatacctagcaaagtgccagcacacattagagagtcaataaataattgttaaattaaaatattagcccatagatactttggttcttgtttaaaaactaatttggcataaacggtaaagacagtaactcaagtctctacttgtgaccttaagtttctaatcttccttctgttaaacatgaagtcccaaagctgtgtaatagaacctaatgcttcactagatggcaccaaaccattgccctaaaacagcactaacaggagggagttggggcagaggactggaaagctggaaagccttattataatctacattaaatatctatttggtgttcttaggggtgtgtacaaacttcaatcatgttttttcagtcaaattctcacatccatacaattacattctgcatatctagaaatgtgacatgattcaattaagaacaggggactttatcctattccatctttcattggagtacattaagaacttagaaaaggacattactgtacctcattcaggccagaggtccatcgctgttgagagattttcctaatttctccaaacctttaattttctagtagaaataagcaaaatggtgcccatggtgccccagtggtcttgatgacttatgattccttcgggatcttatttactatttgggggtaacctagattttgcaggcaataagactagcttggtttttagcatcttaaaattcatgtgatgtatgctgtgacatttatttaaaagcaaatccactgaaaaagtgagggaaaacacattcatcattgttgtaattttattgtttctctctaatccatttctaccctctactaattggctgtgtgggttgagaagcatttgtgtagagtgaagatgtctttgatgaataagccttcttgctgttgttactatattgctgattctgtaattatccaatgtcccactctagatctgagcagcatagcaactggattataggcccttttggaacaactgaacccctgatatgcttttctttctctaccctttctgttaatggtcctgatgttaacatcagttttcttccccaagtctatgcattctgatatatggataattgggtatttgtttatgtgataatattagccttggagttcaagggttctcagagatgaattgatccaaactgtaccaattgccaggaaatgtaaatactaaattgagtgttaatcaaactataacctactgctatactaaaagttatatatttgatttcttctgcaattgtctatatacatacatatatttatgcactatatataatataacaacatatataatatatactaccacacatcttctttcaagtagagtggctcttttaaaaataaaaatatgaagtttcatttatttattttttcagtaaccatgtggctttatacttcactgtataatgactgtatggctctgcctggacgttttctacattgtaattaagggttgtggtccagcggataaaatatcctctttgctcaggagatgctcaataagtggttaattgacctaaacatgttgggatagtaaaaactaaccagttattgagataaaaagcatgaaagagttacattcattgtttgtgacaatggcccctctactaagtaaataagaaactgaaggctgctaataatctatgaaagcatttatgaaatgtgggaactattttcagtattttataaagtcatctcgattaacttatatagcaaccatctcattaaataagaaagttgaataccgattttattgctatttgatatttgtattatactagttgccaagttttgttttagattagctaaaataaaaataaatattgattaactaatgcagtttatttgacaatcaaattctttctaacattgtggcccactggataaaattaattaaaaagatctgtgatgttacagatattaaggatcaagtcctaagcataaggatgctatagaaatattatgcaaagttcaataggaagaataaaaaggatgaatgcgtgcctacttagattaactatctttgtccaaaatatcggaagaggctatatttggggggttacatgtgggttagaaaaaacaaacaaatggggttaaaaaagagctgaggagaatatagaactacccaactgcagtacaaattatttccatctaggtaaaccagacagaatacctgtagaaggaaagctcatttataaaattgagcaaatcccagaagttgttttttgtgttgttcattcaaaaacataactgacatacgttaggtttcagggggtttactaactagaatcatcctattgcctgtccttgcttcagtagagtgcatttgtacttagcagatgccggctcactacatgcaatgcctatgtgcttgggtttattgtgacatgctaggaagagtgaattgattctcagggtctggaacggttggtttctctataacaaatggacctcctcctcaaaagcaagtcaaagccctacacagacaaatcctacagattgtcacttgcagaaaatctttaaccagatattttatgagctaatagaaaatgcatctggatatttctttgtaaacttcatattgttgaggacactgggtaattcttcatttgagatttacttgttatcttattttatggagacaccatctggcaagccctgtcactaatatgggcattaaactaaagatatttcttaatataaaaagaatcaaatataacagcagaatttccttatgtaagcaatgtttacctattgtatattaaccataaactccacaacttgaattataaaagcagagcatgtaaaataattatttaagtgctatgttaaataaataacttttcccttgcttagtcttatcatgccctgccattttgactcaaataggatgtggctaaaaagatgcatttcttgttatgagtaaaatagatcattctctgctacttgaaataggtaatatggttgaaaagtgtagaaattattcctatgactccttatagagtaaatttattcaccagatatttattgagtgacttttctttgccaggtagttttctaggcattggaagatacaacatgtagagtgaacatgatagacattgttcttgtcctcggaaaaaaagtctagcaagacacattatgctacacatgcaatgataatgaaacaagagaagtccaatcattagtgaaatatcaggatttggaagtgcctagcgaggacaccagcttagtctgggagggcaatgaatgattctagcaagacacaacatttaaactgagacctgacaaatgaatagtttatcacatgtggcaggtgaaagtgcgttgatggaggcagggtacataggggaaggagtgtttcaggagcaggaacaaacagcatcttataacaactccatggtaagacattgtaaggcacacatgactgggacttagtgtgtgaggagagaagtggcaaaagctaagcctggagaagcagaaggggccacacatgaagggtcacataagccatggactgtatcctacaacataaggaatccataggagattttcaacagagcaaaataatttcagattgatacttcagaaaatccctttggcaataatgtgtacaatgagttagagaggaatgaaaactggagtcacagaatctattatatatagttgattgttagaagaccaactgtaaatgagaaaatgtagactgtgtttgaggaggaataaagaactgaggattcttgaacatgtgtttcggccttcaggtttaccttatttcctcctgattcattttgttggattctcttagaaatcctggtatgatgacagtggagcctccgatgtagcaatttcccacactattttgaggctgtgataactgaatgcaacattttgcattttggattcctttttatcacttgaagcatatttgtaaaatagtctttacaatgttcttgtaagccactcaaattttattttaaatgtttacatttattcactgaagttttctttactagaaattaatcttttgtgtgtgtgtgtgtgtgtgtgctttacttctcttcccaattttcctgatccacaaaagaatttatttatcttgagagaacactttctatgggtattgacttgccctccctgtcatatcgcatcatgtcaacaactaaaatactgatcctaaattaacttgtagctcctccttattcaattcatagccacttatttattttaaattcaagttgcagactagtcccatgttgacttcagttaaataattagctcatggatatcacgaaagagtttgtaactcagaccagattggaccacacattttaggaggtaagaagtagagtccatgacccatgcatgtcacatgcttgactctttacacagtggtgagtacctatttaagtagctgccaccttttcatttcttgagtagatcagagcagttgatggcaattctgtaaattggaggaattatttccatttgctttaataattgctgtttgacatttggtcccagggtaactttcctttctctagtctccaaatttccccactaaccaaacaacaacaacaacaacaacaacaacaacaacaacaacaaaaaacagtttctttttccactagccaagcaatgactgatatcacatattggaaaataaaatgtatatccactagtgtagtccatagagttgactgtatttgccagattacttatttgaagccaccaaatggtaacacagggctctaaaaatcaagaaaccattagtctagcacagagtacccagacatgcttaagtcattaggggacacttcacacttagaaaatgggctctgatttctttacaattagatattttatgactctttataaaacgtaagagcacaattttctttgaaactatataaaaacgtaacttagacaaattaaattgtcatactcacttagctttttcatgcagtcacgaagtcttgtttccaagctcagcactctttggtgtagttcctcgtagtcataggcaccaatttcctcctgaataccagtgaggacagcagacagattccttatttcctccttgaactgggtgattaacttagcatctgttttgtactgttccagcacggggatcaaaggcaggagctcgtccattttctctttcaactcctgtgaaaagcagcctattgttcctgagagtcatttaaaacagatcatgctgctctgttctttttattatgatacttaaaggaaattattaaaacagcttcaacatttcttattgatttttggttgaaattaggtattttgtgaaaatttaagcggtcatgtgattattactagtaagtccatttatttcagcttttccatatgagaatctttctttaatgcttagttttctataacaaatatatccttatcataattagaaaaacttcctatggtagaaactaggactatatactatttcattttctggtaacattttatatagtgaacaatgtattatctagttaggaaatataagcagaatccatcttctaattatgaattaagtttgaataaagtgattgaaaataggtcaataccctatgattgttcagttgagtctaatcatccacctactaagtatccatgttatggggcacatacagaaaattgtggactctggatcagcttttttctgacacttagaatttttccatcatggccatcaaccaactttgtttttcctttgtgctcaggtattccttgaacttttaaatatcaattttagcacaacttcattatgaaggtaagttcagtaagtgttataaatcagatgaagtgtcccaaggctcaaataaaggtatgttactgtttactattttgaattattacctgtacttcgactccatttatcttaccatagataatttaaaggtcgttatgtatggcagaattgcttgcccatgtggcgaattaactctttaagaaaccaaggtgtgtagtttatgtaatagatgagccagttacacagagttgtttgaaactgaagcattgactttcgtcaaacacacacacacacacacacacacacacacacacacacacacacacagtgtatgttgtcaagcagtatccctcacccctagccgtaacaggactgaagcacgcctacagtttcaccttgggtttctagacatgtcaccgttacttctttctctctaacttcatagtagtgaaaatagtagtgaaaataaataaatatttctttatttatttcaggagtttgattcaattgtgaatttattggaaataatgtcatttgtggaaagagcagtccctcttatgattatttgagaataatacatagatgctgtcagaaattatactgtacactaactgatttaaggagctgaaaattgcatttttaaattacattcaggagatgttattactataaatgcattaaaatagcaggagctcccattgctgccctgatttatgggtttgagtttcttgtggggaaatttccacttgctctgtaagttcagaatctttgaatttgttcacatgtacatattgagtgggaggctaaggagagacttaataatgagaaagattcataaatatcacagtcaaaggcagaattgcagtgctttgctcattttgtcagctcatttggaaatagacttattaaagtatcttgtggtatccctaaaggaatacacaattgtttcattaggattttaatgaaaatatttctgtggttatcattttctgcacattataacaactgttacaatcaaaggttttacattctactatgggcatatttaaaagagagcaattcaatgtcaaaatgttggtagcttttcttctccctcaattcaaaactagatatttatattttttaatcttttcaacaattcataatttgattattagcgatcaattgtgaaactctgaaaacttatatgagagcattggaaagtccacccaatgctcatatcaaatacttaaaagattacagtagaatagcatagacctgtgtttgctaatctcttctagaatctcactttctactatgctgcttttacatccaagttcttagctagagtagagccaacatcaatctcttcatataagaatgtcaatctcaagtatagtagttggcataagctttctatctgaaaaagtgtagaagacaaaacctacttaacattcttgatacgatggaaattgtgtaacagaggaagaattttttttttttttgagacggagtctcactctgtcacccaggctggagtgcagtcagtggcgcgatctcggctcactgcaaactccacctcccgggttcacgccattctcctgcctcagcctctcgagtggctgggactacaagcgcctgccaccacacgcagctaagtttttgtatttttagtagagacagggtaggaagattttttaaaaagtattcttcaatattgaatttactttggaacgttccatttcctcttttcaagtatagtactagcacctagaacaaaatccaactcatggtaggactcaagaaataaataaactccacaaatatatgttgagcacctaattattattatttgtaattcagagacctaaagtctacttggagaagcaatgcagcattagtattagaaggtacaagtttggaattggactttctgaatttgaatcttggttctcatgcatattagatatacgactctggataaattactcaacctctttgatatggtttggctctgtgtccccacctaaatcttatcccaaattgtaattcccatatgtctgggagggaccaggtgaaaggtgattgtatcatgggggtggtttcccccatgctgttctgatactgagtgagttctcatgagagctgatggttttaaagtgtggtacttctgcattcatgctctctctctctctctctctctctgtctgtctgtctgtctgtctctctctctctctgtctctctctctctcctcctgccttgtgaagaaggtgactgcttccccttccatcatgattgtaagtttcctgaggcctccccagccatgcagaactgtaagtcaattaaacctctttctttcacacattacgcagtctcagcacagatctttatagcagtgtgagaatagaccaatacactctttgtgctccagtttccttatctttaaaatggaaatgaaaatagtgcctgagttacaagactgttgcgagcattatacagttaatatactgaaagtgctcagaactataccttgaatatgtataatattctgaaaaatcattattgttattatcattactgttatttggattttgacatataacttcagcgtatacttggattacatgaactaggaaaatccaagccattatgtcacatggtgctgctgcctgaaaattgttttcttattagtagcctggctgatttgctgctaggcaatttataggactaggtacattatttctttggggtttatctcaattttgtatcctttttgtttcttagtttcctgtcttctcgcaaaagttcccaaagatgaacatgcttcatcatgcattccccagccctgtcaaccctgacactctcaagctgtcctttggctttgcagaattctcattgcattgtccatctacgccaaacagtctgaactcctctcctcctgactagttccttctgggaatgctcttcccacacctaaggtgccagcttactattttctactttgccgatgacctcagcattgggttcccattattattttaccatctacactctaaccctgagaattgaaaattgacatagtaaatcttttggttttcttgatccccctataatttaatagtggaggggtagggtcactagtacgaaaccagctcttctcctggtctttttaaatcaaaattaatttctcctccctttgtgctcataagtaatgtttatgcctctattcaccatcaattcacctgcctgttagttgtctttcatagaagacagattacgtataatacatccagcagaggggccaaccgcaccttgtatatggtatgtgctcgataaatactggctaaaattaattcttttgctcttcatcctcatattcttctctgtttaccatttatccataagtttcctatttatccagttcactcacactctcattttcaataatctttaaatttaagtatattctaaatcttgctctaatttgtcctaattacttaacctgctggttttgtgtacttctctcttcaatttaaacctcatgattaatcacttcagtcccctctcttttcaataccctcaactttcttgccctctttttcttcctttgtgaccgtctgggtaaaactttaaaaccaattcagggtgtaatgttcttctatacctctctactcagtctctggagtaccactgaagaaaattacaaaaccatgaaactttctgccacattcaaatgtgttatgcagagactcggttacatgttcctcactagctccccaccagccaccactatgtgtaggaagcactcctttccttgcccaagggcttgagttcagatccactccctcaacatcagcagtgaatctcacttcctaactgacaagaaaaccagaggctattaagtgggcaaccacagtgttttatgaactatgtgctatgcctaggtaaggcaagtggtttacttttaatgggagctgagattgcattagcagaccaagagttttttcttttctttttttttttgagacggagtctctctctgttgcccaggctggagtgcagtggcgctgtctcggctcactgcaagctccgcctcccaggttcacgccatcctcctgcctcagcctcccgagtagctgggactacaggcgcccaccaccacacccggctaattttttttttgtatttttagtagagacggggtttcacctgtttagccaggatggtctcaatctcctgaccttgtgatctgcccacctcggcctcccaaagtgctaggattacaggcgtgagccaccacgcccggccgagttttttcttaaaattcataactctttcatatatagttaacaaaagttgacatagcatgatttttttctccattttcagtatttgtaaataattgccaatacaacacttaaaatctagaaaaatactttatttggataaatttatgaaacaactctctccacatgctcatattaatggcatagttttctctttaaataatttatatcatctacatctttcttcatattagcagggcataaaaccattagagaaacatttataatttaattattaattttccttggggaaatttcccttgtttcagaaactccaccaaactctacaagaatgaagctttttctatagcaagacttccatgtcttcctaccagctaatggtcagtttcagtggagagatgactgaaatcccccatgagtcttttaccttgcacatatgggccaatgcacattcatttctagctgagtgccccactgctgtccatcccactccatgtctgatttggattgacaagattgcagaagtcaaacctacctgaaaatgcttggtcataagtgtctttcgatcatcttcaatctgccgaaattttgccttcagccctttcatttgggtttccatttttaaaacatattggaaatctctctgagttctcaagtttaagacttcaatagactgggacatgttctgaacctgttgaacaagaatattgtctgtacattattatctgtttgcaggtttgtgcaatcactaagaaatagcaaaaatgccgttaacataaaaactagaagtgccaaattcataactgggttcccatatgacacattttcagaagaacaattcttcattataaacatttaaagaattcagcaagagaaaattatacctagacaggaaatttaaaaacgggcattctagcattagaactgactgaatataaatgggcttaatacattagaaaaataagctttaaaaatagaattttcattttaaggctttgtaagctaataacatcccaacctgttaaatgtcaaaataagttgtttctgtaagtactaattctgacttcttaaatatttaggatgtttagcaattgtggatggtagtgaagtgtcgaagaggcctagaatgcattcattctagctcagtaagttcttaatgggtctaaagtactcccaggggtgagactgaattgactaagacaagtggtagcagtactagaacactccctaaattggacagcatagtgtttgagggacctggaaaagggtaactgcatcaagtgcttggtagacaggacttaaacacattttaagccaatggcaccatcccaggttcgctgaaccctgggctatttggaagtaaaaaagaggtaacctataacgcatgcagaaatgagaggaaaaaatgactggtctaatttttgtagcaacaaaaatctgaaaacaaagagaaagcatctaataacaggggatgtgttaaatagagaaatagaatatgaatgacccgttataaagattaagatagatctctatgctgttagtactcaaagcaacaattttggtatcacctaggagtttgtcagaaatgcaaaatctcagaaatgctcatccagaactactgaatcaaaatatacatttatcaagattcccaagtgattcctatgtctattaaagtttgagaagtactgctcaatatagaaagatttcaatgagaaaagcaaatgtaaagatcttcataaaatttgatcttttttgttgcttttgttgttgttgctgttttttgtgagacggagtctcgctctgtcacccaggctggagtgcagtggcatgatctcagctcaccacaacctccgcctcctgggttcaaaaaattctcctgtctcagtctcctgagtagctgggattacaggtgcacgccactacgcctggctaattttcgtatttttattagagtcggagtttcatcacattgatgactatcacctcaagtaatccacccaccttgacctcccaaagtgctgggattacaggtgtgagccactgcgtccagccaatctgtttattctaaatcaaatacaaatacatgcacacacatataatcagtaaaaagttattttcattgaaaacatgtgatttacaaagggatgacttgttcagacacaaatttttgtcatcagataaagtggcaatgctaaatggatcagccagctgtaaagttcccatagttgatacattccttagaactataatattggaaaaaggcaatgaatactgtcttggcctgcctcagttctttgcctttttttcacccttttctgttccctctgctgtcttgatccatcatcttgccctttttggatcctgtccttttaggacatattacagtctggcttatcttaaaactaattgtgttatgtgggtgtggagtaggggcagggaagtagccttccctttgtgagctccatgaggttagaagctgtgtcttactcatatcttccatttccaagaccttacacggaaccaggcacagagtaagtgttcagtgaatatttattgagtaaaattatcttgggtttgtaatagtaataataagtatttagaattttaaggagagtcttcctactcctgtctctggttaggcaacagcattataggaatgtaagtatttcttaatttactaaaagtttaatattccgaaagctttatttttaattttcaaaatatttaatctagcacaaaattactaagacaacattggaagcatggtaacgccattgtggataaatgcaatgctttcaacataactttctaacttcatttgtggttaaacatgtataaggaaaagccatttgcattaaaaaaaactgtctacgtatttaaatatggcatttgtctgtgaggacacctatcattagcatggctgatatcctggtaataattctatgtacctgggccaagtctatacaattagaaaatgatgggcaagataaggtattctggataaagttaaaatagcctgtctttatttctgcctttgactcaccctataaggttaattttcaacttcatttgtgttacaggaaaatgcactgagataatttttgctaaggcttgatggtgacctatattgcagaatcatgtgtaattagaggagctacatttggggtaatggctagagctagagctgtctaattggccaggatttggcttcaggtggtcttaagcatctcttgctggttataactaggattgtttagtttcccactggctatagaggcctacagagcatcagtttcctgatgacacgggagactgaatacccatgacgacatgagtaaggaaggagaactgtctgctatgttccctctttttgttggcttatctctgcggttgttctatgattcagctttccagaggtgtttctgtgattaggatctctcagcatagtttggcaagctcattgtcgcccttcctggataattcttttggaatttttatttattctggttctttgtataaataagatatctggggcttttctggacttaaacacaaattaactttgattttcactctcactcataattagtgaggtggtcacttgaaaaaaaaggtctattaattaaatacatttggatagccttgaatttaacacatataaaccgatttcttgactgtaggacttaacaaaaactttagtagtaaactgtgtattagaaatcttcaagaatgaagtatcatgtacaatgtttcttaaacttatgtcattggtgaggatgatggcagtgtcctattaaaaaaaatcacactttaggaaatattgacttagataatacaagacatctttaactgtacagggaagctacatagttaacaaacaaataattttttaggtgagcaattttagttttggcatactaagacctgaaatactgtgaaaccaattatattttttctaatattcaataatataaatacctgttaaatggcaaacagagcatcacttaaataagtatggatataccagtgggattttgtatgacactggtacagcattgagaaaatgcaaacggatctgttagagccacaacttactgattgagtgacaatggaaagttttcaacctaaaaaccaccagttttcttttacataaacttagaaagataactatcccttctataaggatttaatgaagtagatacaaaatataatacaaaatatactaataatgggaactattgttgtaaatattgtctttattaacaatattcccttatatgtgactaaatcaatctttttggttaaaagtgaaggaggtgcttaaaggtcatgctcttgtttgccctttggtgccttggatatatgtgaaactatagagagataagcaagggactggctcagtctgaaatactgtgatatctcagacatcttttctttggatcagtgcagcaaaccagtgctacttaacctccttcaggccactgtaaaagagtgcacacaatttacgattcctctgttgctctaaaactaccatatggtaagtttaatacatctgccttgtggtgactccaattttgtgaataaattttgttttttgtcatttatgtattaataaatttttaaaggtattatgttctagaatttcttgaaaacattcagacaaattacatgttggatggatggagtggtcatattaatttctattattattttcaaccaaccaatataatgctttcatacatttttgctttcttcatctttcactacttcccagttttatcatagctatgaaatacattttactttgaacctgtaaagggaattatccactttctgacatttatactttattttaattttttcaactgatttttgaagaaatgtttgagtgtatgtgtaggtgtgaatatgtaatgctgtactgaaaaatagcaacacagaagataaagtatggtgtctaagaaaatctctcaccttagtttatatagaaaaaaagatatttctgggtagaaaagaagatttggtgaagaacattgattatctgaagggaaatacaatttaacaggaaagcaaaattggatgtaaaagattagatctttttactaatgtaaataatttccctggtaaacaaacaaaatatatatttgaatttttatataaataaaaaaatcaactttggaaaataaactcaagaataatcataattcttgctctgtcacccaggctggagtgcagtggtgagttctcagctcattgcaacctccgcctcccaggttcaagagattctcctgcttcagcctcctgagtagctggtattacaggtgcacaccacaatgcccagttaattttggatttttagtagagatggtgttttgccatgttggccaggctgtgttgccaactcctgatctcaggtgatccacctgccttggcctcccaaagtgttgggattacaggcgtgagccagcacacctggccttgtcatggtttctaatagttagatgcatgttagctgaagtcattattctgaatgaaaatgacatatgctcttgttggatgacagatattgagggatccgaaaggatgggatcttgccataaaaggaggcttaagaagaaagggccaataggtgatgataacttcaagcagaggggaaggagaaacagactaagctttatataagcacatgaaaaaatcctaaaatcttagagcatcaatatacttgcaaataatatatacagaggaaacttattttcactatgtagcagtggaagaaagtcaccatggcagcctgaaattgtgtaaataatgagtgtctctattaaaaaacttgatttcatttttctagcttctcttcattttttgttaaaaagtttctattcaatgccataaatgtgtgggtgatcatgaaaatgacatcacacagagtcaattgttaagcatgatgtcctctagaacacatactacctaatttatcttattattcctaatgacatttagaatccaaacacgtcatctttccataatctggccactccagctgtcttactacatttagagcccagcacagtgaaagtctgagtgagaatatttgacagaacgattcattggttttcctccctcccaactaaacataaataacctttcatgagctcacatttatgtgtaaaagagaataaatcaaagacattctgcatttgattgttatgaatccatattaagtaaattatggagagaatggtattgaatgaaattgaagagcttaatgttaaaaggaatcacttagagaatgatgataaacacttggaattattcattatctgtccagatagcttgcatatcacatgcaattattttaactttattgcaaggttgttatgggattcaaaagtttgagctccaagagtctagtgtgatcctgagagtggagctgaatttttggcatcagaataagatgctttttttttttccttaatgagatatcaactagagattaagatatatggtagagagccagtcttaaggtggcaaggttagaaaaagtaaaaagtcatagaaataggacaaagacaatagcaggaagcttgaggtaaccctttcaaggatcagaaaaaaaagcttatctgagaagggggacaaaaatcaaaagaatcctcttcattattatcggctctaccatatttccttttgaaagaatggtcgattttactaaaaatatgcataggggacacaggacacctaccttttccagtagttggcgaagttgcctgcttttggcatcccgggaacacaggttttgttctggagcaacaactgtgcaaatgcaccgcccatcaggatcctgagctgagctgtacacctgccacccttctttaggactaatctgagtctgaggaaaccaaagggaaacataaaacacagactcctgttataggataaaaagagtgttggtttgtagcatttcaagtaaaacacttttttgataatttaactttgtgttttcaatctttaaagttagcagagagatattaaacaatttatataggcagtatagcttcattcagtataccctccttatcaatgtccaaaacaagatcctttcttgtcttcaggtgccatattagtaactgattttgatctcatactatttcccaatgctttttctattttgtgacattttaatgcaactttagaagcatctagtaactacttaatcacatatgactcgtctttctacataagatcttcttaacagtaaatgacaattactaatattaatatattattttctaattataattcatgtgtgatattctgaaacaaagtcctgtttcaaggaggtttcccatatattgaagccttaattattaataaagtggaaaagagatcattgacgacataggttaaaaataattagaccagcactattttgcacgaaatgcagactcttagaggacttagagtttttggcagagtctgccaaattgattttcccaaaaacttctgtacacttatcactctaccttcttagaactcaagtgtgaaggggtggtattccagttctactgtagtttttctgcaatttatgcttctagatttatcttctgtaccatccaacagaaacctttaaccaaatcggtctgtgtgcgtcgtgcaagcatgccatgttgattcatgtctttttatgtcgctcatttcatttttcctgcttggaatgcctcctttataaaccatgaatttattcagcccttgtgatttctacctgttgtgaagaaactgtctgtactattcattaggtatttaatgtatattttctagaattgtcatttgcctttcacatatctcatttcaacaattagcttatatccagctatttttttttatatatagacaaaacctcactctgtcacccaggctggagtgcaggggtgagatcacagccactgcagcctcctgggctcaagcaatcctcccacctcagccgatatctcagctcactgcaacctctgcttctcacgttcaagcgattcacctgcctcagcctcttgagtagctgggattacaggcatgtgtcaccatgtctggctaatttttgtattttcagtagagatggggtttcactatgttggccagcctggtcttgaattcctaggctcatgtgatccaaccgcctcggcctcccaaagtgccgggataacaggcatgaaccactgcaaccagcccagctattagaaatgtaaatatttcctatttgacctatcaagtagactctatcaagcacaaagataagcattattattttttatgaaatcatttttcagcaagaacatcaatagacttccaaataatgtacaccaaatttattttcataaataaatttcagtggaagaaagttaccacatgtagacttgaaattctgtaaactagaagtgtctgtattaataaacttgatggttttatttttctagcttctcctgatattccattaaaaagttcttttcattatacagatagaagctattttagtagagttggatctcgccatgctggccaggctggtctcagactcctgatctcaggtgatccgcctgcctcagcctcccaaagtgctgcgactaaagctctaagccaccgcgctgggccaggagcaaattcttaaagtaactaaagcatgaaccaggttgacttctttctccacagatttaccatagtaggtggagtcttctgtctctagaattcacagcagaagagacacaatctcccgtatactttgtcctaggttctagctcatcacataccataaaccaccacaaaggtctttttcttctgaaagctttaatgataactacttctaggtgccgataggccttccaacaacaatcatgagcaaatattggggatgctaaaaattataaactcaagaaactcatgatgataccaagtcatcatccttgatctattacgtaaaggaaatggtaccagacatatcttttgaatgtcttattttctaactcctttaaaaaaattaattcatagatgtttccaatgctgccttttatttttgggggtcagactcgttaacattctccccatcccttctttctagctcttatgcttgaatatccagttaggatggaaagatgtacttagaattatacattattcaaattagataagatcttagagattactgggttagtcttttagtattattttttaaaatgcagactacccacagaatggaaatagaaacagcttaccagagtaatttcaatgatataattaggttcaagttgagtaacagtatgcgattgatgtatctggacataagccctgcagttttagctgggcatctcctaacattggacgcaaatctaaaatatgccagaaaattgaggcttgtcactaggataaattaatctattggacaaaggatgagaggccacccaattataatattaaaatattttaacagcagtccaaacactgattattaaacctggcagcattaatattgacgtgcacttgccaagtgtttggctaactagtgtggagctcatcatgacagaactccatgtcagttgctctctggaaccagggaagtgggaaaggtgaagagggtttaatgttcatttagcatttcccctgaagtgtcagttcaataaaactaaagactccagacttgtttgtacttccaattgtcttattgtaagaatcagtgaaaagagccatgaccttctctactacagagttactttgaatgatttaaactataaaaagccagctttttgacaagaaaaaggtaactcaaaagaggaaaaaacctaatagaaaagatgagtgcttgacagtcctgtgggttttgatagagacctctgtgttggggtcagtgataaatagaagctttatgagtgtttctagtgttctcttttagagaatccatgctggcattgaaaagagaatcaaaatcaaaccaactaagatctcggatggaaggacgtatttagaagttttttggaaaagacttgctccaattttaacatataagaacaattatttaggtgtcaataaaacatgcaacaggaatagcaatcattaatggagttctattcattacctggcagttcatatgtgctattgctttcgaatattataatacacctatggactaggtggtggtattctgcccattatacagatgaggaaacagactcagagacaggaaggaacttgttcaaagtcatgcagggagtatcagccagtgagtagggagatttgtgtaaatctgccttttaggcagacctgggatttgtactgagagagtcttatttcagagatttttttttttttttgagacaggttctcgctctgttgtccaagctgaagtgtagtggggtgatctcagctcactgcaaccactgcctcctgagttcaagtgattctcccaccacagtttcctgagtagctgagactgtaggcacacacaatcacgcccagttaatttttgtatcttttttggtgatggggttttaccatgttgctcaggcctacctcgcactcctggactcaggcaatctgcccgcctcggcctcccaacagagagtgaaatttaaccaccacactacaccatcaattattttaataccctttcatacataatgattataaccttggtagcattttctgaactactgtgaagctcagtgcttagacctggagggtacatatagtttagtggtacccaaagcattaataatcacagtgattactgatgcagttctctttgaacctttcgtgttaattggaagaactaaatgaagtattgagcagtttttaatattgtaaaactcataaaatatttaagaatgctctaaataggagaattaaaattatagttttaacaattgtattacaaatctggattatttgcttataacttaattacaaagctgtgctttataaatataaagctagtatatgatagttctaaggcttcaggggctttgtaataggaaagaaggatcttgaggcttgacaagtaaaagtaaaaaataatcaaactaccttgcatttcaatagattttttgcttataaaatccctgctattgttttagtctcacttttcttgaacgaactatccttagaaatagacagtatttaaatttacttatgaggaaactggaaaccaatactcaaagaacttaaacatgttttataagtcatccattttgttaatgccatatataggacttataccagctttccccagtttttagcccagagctttttatgctcatactctttggataaatgtagatagatcatctatgtccattcaccagtaaccataaacactgctatagagaagacaggccccactgtagttgatgagaagagatgcacccaggcaggtagagggcattatccaaacagcatggaaacaagtagccattggtgcctcagaggaacagatagcagtacaggctctgcaatatatagtcagatattcctgtggaaggcacggcaatcatttatcagggtctagatggagggacaggcaaagtaagagaattctgatcctttgaacagaagaaaatcaactgatcgaatattgctagattttttgtattatcctgattttctgggtatttcataaaaaggacaaaaagggatatagctactgaaagtgttgtacaaatggaggaaataaagcctaaataaatctgtttattaaaacttacttgatttagagtggagatacctgagtgatgaaaaatccctgataaattttctgtctgaagataggcttggtcccagagagtgacatgtggtttagcatgctaatggcttcagttgtggagacaagaaaatgtgaggacaggaattagacagatgtcgacagaccacgccaaaagaagctgtgttctggaggatgttaataaagatgtcactgcatagctgttttcttgctattacttataataattcttaggactgaataagaaacgcgtattcttcactgaaggaaacctccaggctttaagaaaaaacaactataaaagcaaaaataataataataataatgaataaaaaccaaaaacattatcaaatttaggttagggtgcagtggctcaggtctataatcccaacactttgggaggctggggcaggtggatggcttgagcccaggagtttgagaccagcctgggcagcataatgagaccccctcatctctaggaaaaatacaaaaattagctggacctggtagcctatagtcccagctactcagtggggtgagatggggggccgctgaagtgggaagatggcttgagcctgggaagtcgaggctacagtgagccgagatagtgccatggcactacagcctaggtgacagagtgagactgtctgaaaataataataataataaatttaggttggtcacctctgcttatgccctttggaaatcacaatgacttagacttggggaggtccttagaagtcatatttagtcccatgtctttccacacaatggaacgtctacaaattctccttgtgtttccattagacctctgcatgaaagggatttcactgctttacaggcagccccctccactgaagaaaagcagggggcatgagccgaactcctctctctgcagttttccttctttggccctacttttgcttcaggcactcaagctagaataaatctactctcttattcatgtgaggattcttctataagaaagcaatgatcatattctctgtcaccatcaagatttgccattctgttctctcacctggcttccctccttaatttgttcagttgccctatcacgaaatgagcattacctaagagtttagggaaggaaaacagaatttggggggaaaaacagtcatatacaaatcagttaaatcagatatcttcatccaggactaaaacacattggttaattgaggttaagaagcttagaagatattgacagttcatttcaggggattctactcattttatagaactttaaattgactaactcatcaaagtagttattcatgaggagaagccagctagacctttgaaaatgtaccaaaacaaatgacatgcccacaggttccttcgaggcctcttcccaccacagcagtagggctatttgagaacagcgggtgtctgctgaatgtcctcaacttttttaattgctctttcccagggtcttcctggtgtgaagcccacagcgtgagggatttctcagaagctcagcctctaggggaagttactctgcattcaagagacgcgccagagggagcctgagccttctgagagctgaggcttcctctgctcagaaaccaatgcctccaaaggctgatgggcccagtggatagattggaaggggaataaaaaagaaagaaaacagggccaacaagaaggataaaggaatgtttcaagattctgagaaaaacaagaaggagcttattcccctaataaggagctgtatttaactacttactaataaaaacatcctggaaattttaaaacccctttcagcttttgagataatcaaatgtgtcctgtttcagaggcacctgccataaattgatttaattgccatttaatgatttaaactctatttttcctggttttctttttccaggtcatttgaaactatcattctaaaaaaggactatgatcatatttgtgtaaatctgcttttcttaaaccatcgtatttatgttaatctgtttttttaacctctgcgtattccatgaacattcagatttcaagacctgcgtgtgcgtgtgcgtgtggtatattgcaaactcatcccattcatactgtttaaagtgagaacatggagtgagaacattgatgagaagagctggtttactactttacagcaatacctagtgagccagggagctgtcaacccttccatctaagggaagagttttgctggccctccacatggaagcagcagtaagggtcccttggaattatttgagaggcagcaggaagaatcccctaagcaaaagaacctctttcactgctttgtcacatgcctaaaatgccaagaaaggaggatttttttcttctttataaatgcaaaacctttgggaatggttatgacataattgagagtatagcttttctccaattctatgaggccagggagatgagaaaacatactttaaaggatgaaggtgttggtgtgtaggagggaaagaagaagaatccagggacatggaaacaatctgagcagggtagtgagaacctagtggggcaccagggaccaagagggccaatgactggcaaagcaatggtgaaatagctttgttgagtagggaggtagtcatgtaacttggttccacacttgcctctgccattaaccaaatgggggaaatctgattggtggcttaaatatttccagttagtctccccatttgtagaataatgaggctgaattagatcagtcatatttccagctaaagtcttgagagccctaagatttctaaggagatatcttgactgagacaagcagttgattgtgtggggagataacacatggtggaggcccagtaaatgcctctcccaatcatttattatctgacttaagacctcttttatgttttgaattttcattttgttttattcaaaaatatttatttagcacatataagatttaatttgcaaaaaaaaaatctgctgctaaaaatagtatgaacataactggcttgatggtttctaagatcctttccacctttctagcattaacattttatgttcctagtctaagagatactgatgcattcattcttcaccccgggaatcttaaagtatgagcactcatttggataattagggaaatgtcatagacattgctcttctggaaagcatacctaaaataaaaaaaagaaacatccaaaaaaggttttctccattccagtgaataccatttactggtttattttcagtagccatagtgaaaccttttctacattttctgcttttgttcttcttcttattattattttcttcttcttattattttcttattattattattttttttgcaaaggggggaatcaaaagtaagaattgtctgtgtcaaaacatatacagacatacagcaatgctttatatttttcaactaacaatttttcaatcagtaagtaaagatatttaatttacttgtaagataactagaaatcctaagagaatcatgtataattttggaaatttcattctcatcagtcaacaataaaaaaaaaccaagccaatgtctatatacacaaaaaatatacatgtcagaatcaaggtgcaaagtttgaaatataactcattcattagtacctcagtttacattcattatcctgcaagagttaattcaacaatgatgttgttgaaatctggtacttggacattgaaaaaaaaattggctcagtaaatattagataatataagtttatgttttgtaattgtttattgatgtctatctcttgctttctttataactccaaatctcttttacatccttcctgccaggccacttcatgcaggtagggaagaggatctcagcaatggaggctctggggttccataagtaacctaagggaaatgaaaatgtaaaagcaggtcaaagtgtggcttgtatgtgctctgctggtgccttaagcactgggagaatctggaaaattatttaactttttggtcagactatactcagttgattaacattggttgatagattattattagtaacagcaaataacacttggaaatggagggctacttttctttccatatctgactttttctgatccactggagtaacccacatgaaagtgaaaacccctagttttgcttctgtaccttttatttcagggcagaggaattattttctaagaaattccttttatttgaatttgtaaatttctatttcaaaaaacaatagttttcatttttctttgaaatatcaaacatgttgctcactgaaccttgcttcaaactatcaggaaatactttgttagaaagtagggaggattaaaaagccattaattttagatgaatgaagattatacaagacagtcttgtgataggaagtcttcataaaatattaaaaatacaggaagatgtttttatcaagtaagttttctattgctcatgtttcttagctttcttaaaggaattttgggcaggccttaaattggcgagttttttcattcatttatgcttaaaagatgttagtttctttgagtgaattcattgcaaatagtcacaggcattgcattccaaggaagaatctgctgtagcagaactagatttgacagaatatactttgtagcttactttgtgggaaaaattatgaagatttttacagatattaaaataagtaaaagaataagaaacaaaacatatatatatatatatttttaagaattgcccaagcttccaagtaatatagttaaagcttttcacccttaagaatttaatgactctggtattctctttcatagctcatttctcaagcagtccatttttggggtataactataaagtgtttataaataaatatgatgaaagttaccacatagttactacatttttgaagctgacctgtaaaggcagaagcaaaatcttagcctttgcaatttacaaaacaaagcccactaaatgcacttacttctcaagatggccaaacccaccgcagtaacttactaaggtatccggagtcgacagcctcgtggtgttcagtcccaccaaggatgggagagtttgggacatccagtttgagatcattgccatggtactaagcacagcgccaagcttcagcagtggaggactcattgctgtggagctaatgagttttcatagtgactgattaagatcccggtgccgggctggcagcgggaggcgtgactgcagcgcgccacatctacagcatgaaaagagatcaacttccccagctctaatcacccaggaaagcttcggaacctccttcccccatcctcgtgggaagtgccctgcccttctttttcctcccttaccagacattttgctggatcatcaaacaaaatattcttgataggcttggttggtaattatcagagagcagaggttggagggaggcggaaacttgagctttcccagctccactttagttagttaccatcaacagaatccatttcctctggggtttgtgtaagtataatcagctactctttatctttcattaaaaaaaaaaaatacacctttaaatggaggtctgccaaagtgcacatttcaaacaccaaacttaatatctacagatttctctgggcaaggacagagtgcttttaggaagaacatgaaaataaagtctgcaaataattttccagatgatcatattgagagtaggagataatttttttttttagaaagtaacctaaaattagcatcattgctttaaaaatatagtcaaagattaatagctactgcttgtggcaaacattacctttaggcatcttacacctgaacagacagaaaagagaaaagacagccttgcagaaaaacttctgttacagaaattttatatgtgtttccagttttgcttttgagaatgaaggctttgcttcgtaggtgttcagtcacacaggaaactcagttaactctattttcagtttgtgaggaatgacggactgatatggaaagtctgtatcttgagagaacatgtgatttagtataaagggcacaggacttggactcaggaagtctgggatctagtatttgttctcctctagttagccatatgactggccggtgacaagattccttggcttcagttttttctacaatataaggatgttggaaaatatgctctccaaggtcccttccagctctcaaattcaatgatctgtttattagattacattagcaagtgtggtatatagaatccagggtttatgggtaactttattatattgttttcataaatactataaattttccacatccaaatctcaggttccaaatgaaagaaatcagaggtctttgtcttatccaatatatgtgttttaaagtaaaaatataaagagaagacacaaaacaaaatatggatgaatgaaaattaaatgaaaagaaattggttacaaaaaggaaaagtattgttttgatttcttaggagaattctggacttgtttgtatttggaatcttcagccaaagatatatatttttcttaaatagttttggcaggagaaataaataaaatgtccttaataaaactgaaagagatacatatttatagtgtgtgtatattttactttcaaaaacagctttaaactggggtggatgctaaaagactcctcaaatcttccttgcaactattagcttagaatccaggccatttttttttttcaaaatatatccaaatgactttaatcaactcttattttttaaccacagtgcccacaaaaccaaatattattacttttctattctttcaaaaatcatgccatatgaaaaaccaataaaggcacaatattttatgtattaaacttagcagaaagccctgtgaaattttacattagtattacaatgtgttaatgacaaaaagcaaagtggatttacaaatctaatgttgaaaaatacacctggaactctatcttactttaataaagaaggggggtgtcttttcaagagcttaatttccaaaattgaaagaaaatatacatataattactagataatttaagaaatgaggtggcagatggtaattatacttattattgagctatcagcctacaaaatagtagcatttttagaagaatataagattgaatgtcaggggaaaacagtgctctgatttgcaaattataaagaaaggaagaaatagagaaaaacaatacaaatggaatgcttcttgtaattttccagagatgcaaattactacactaaagaattgaagtagaacaatggtaaaagtttatgattcggcgatgtttatgaacaacatagaagctaaactgtgttgtttttagaacaggtttaaatgatacacattgaagtagaaaagctcaaattacaataattattagttgtgggaaattaaaacagctgcaatttgcaaagagctaaatagtttgcagtactctcatagtctactgaagtgatatccatttgaaaagttgagtcctagtttgtaagtgggagaaaggattagtctattgagaagtagcggactgtgtttagggcaagcaacccagtagttgcagaagttccacaagcatagtgtgaatggtaatgatattaccactggcaatgagatgaagctggaaatgctggctgtgaccagctcagggcttcagggtcacccaaaagtgtttggactttatcttctatgtaattcaagagtttaaagcaaagcagtaagatcattagttttatgttgtgaatcattgcttagtcatttttatgatgcaggataggcaggcaggggctgcagagagtgcaaagcatatcagagacaagaaggtcacttagaggtatattctcacggtttgggcaagagatgatgaggtcctgaaataataaactgtcagtgaggttcaaaaggatgaattccataaaggtctgcacaacaattggcagtccttagtgactgaataaatgtgacgcagtggaaattacctgggagaacgtttagtttgggggtttggatgatgagcgtcaatcatcagaataagatacacaggtagaagcataactttatgaagaagatagaatttattgtcagctgatatgcattacctgtagtacagagggtcactggatgataatgtgccccacacttagagttcagaaaagaattaatttccctaggctgcaacaacttaatggactagtgagaataatgtgtcctacatgtatgaaaaaaatggtcaacgtaaaaatgcagttttaaaactaccacaattttcatttattcaattcatggtaaactataaacttaattacttatacagtccttcaaaataacaaaccaaaatctatcactagtaaatagtgaaatattactaaatctaataatctcacaaaaaatgtgacctgactacacacttattttctttgtggaatttcatagtggatcaataactatataacctacaattgtgcattattgctcatggaatgctgaaagctattgattaatatatttattcattagattttttatagtagcctgtcctttttattacccagagagtatatttcatgatagacttatatagtaaataataaataagcaaataaatattgagtgagaatgactcataggtaatttatataatattagcatgttctgtcattagaattttatttttttcttttatttgtagaacaaaagttaaatgttgttttaatgaccctacacagacatataatcatatatatttcctagtttgggactgtatgtatggtagatgtgggaaggtttctagaagacacaacctaggtagatatgaaaaatcaaatacatgaaaaaaacctgatgaccacataaaatatggtagaaaataaacagttaatgaggtaattgtgacctaaaagtttgactttaggtaaaatgagaagagacttagattgcttgctaaacagtagaagctttaagaagaaatagtgtactcatactttatttttattatttaaaacaaaatttaaatttgtaaatggcttcaggcagaggggaaagtggcttattagatatagttgtaaaggtacaaatacagggctgaagaaattattgaagaaggaggaggagaagaaaaaaagagataagaaggaggacagcaattgggtagaacatcgaaaaatgaactgtattgactgattaaaccagagtgacctctagaaaaaaacagtgggctcttgttagcaagttaagtaggaaaaataggaagagtaacataaaatagaagaaggtggaagacagagtacttgtgttgaaatcacttggggaatgctggataccctggatggggtgtggtttgagagtgaccaggtacataaaccgctctccaccctctgtggcaccttaaaagcagtttagtggatagtcctccagattcttccacttactagaaagataccattgactaagtaagtctctcagtctccattttattatctgtaaaatgaagatagaagcaccaatgtgaaatggttatttgagagactgaatgagatgacatattttgaaagtgtctatagtatgtcaaatgcaaaataaatggcaaccctatttttgacaagaaataccacgatttgagccagccaaaaggaacagaccagctgaaggaacaatcaggcctagagaaggtggaaagttttgcagctttgcaaaggggtagctgagtgcagcttggagtatatgctgtcttgcaattcagtcaccttgggtgaagagaataatacaactttgctggatgacaccatcagtctgtggctctggggctaatagtccaattcaaagtagaggaaagggactgattgctatttttgcttccctcttcattgaaaagtcgaggtaactactagaaaacttccataaggtcccattaccatatctgcttacttcctcacctgtgcccacatagtgtaccttccttttggttgccatggataaattgattgtgttcctagataaggcagagctctcctctgtgcaataaatcagttgttttggacaatcatgcataagaattacttgcaagcctgttaagacccaaatttccaggtctcacctgagtctgatttagctttaggacaggacaaaatagtttgcttttctaacaagctcccagatgatgctgatgctgcaattcttggcccaccctttgagtagacagccctaggttatatctctctcacctactcaaagacaactcttatttcctctttttccaacgtcgataaattttccctctttagcagatcattcccagcatcataaataccaccatacttttcctactttaaatgcaaacaaacaaactttcttgatcttattttctctccaggaattccaccatttctcactctccctttacagcataccctctgaaagaattgtttatacttaccatcttcaatttctctcttcctaattgcatttttgtttacacttctccactctgctgacactgctttcatcaggctaccagttacccctagattgctaatctagcagtcaattctcagtccccaactttcttaacctatgggcagcattcatgtgaatttactttctcctttttgaaatagttttttcacttggcttccaggatgccacactcactagtcttcctccaattttatgacctctctttcttagtgtcatttgctgattcttcctcatctatatgctaatgattcccaaattcattttttcccagcagacctctcctatcaattcagaactgcatatccaattatctacttgacatctccacttcagtgtttaacagacatcttaaattgagcacattgaaaaagtgagatcctgttatggctccccaaccccagaaaagaaagcaaaacaaaaatacaccaaacaaataaacaacaacaaaaatacacatgcagccattcctgcaatcttcccatttcagttaactggcaacactctagttaagttgctcaggccaaaaagtcaagtttcaatcttaatgtcttttcctccacatctcttatcaattcagtcagctagtgtctactctcaaaatatatcaacattcaagtattttgtaccatcccagctgccactgtgctgcttcaagcctccattgtcttttatctggattgttacaaaagtcacgagttattgactttgtatcacttgttactttgtaccatttgttactgctgcacaccaacattatcttcttaaaatataaatcaaattatgttattccagtgcctagattcccatctttctcatggtgaaggtcaaaatatttagcttgcactataaagttctacataatctggcctcctcttatcactctgatttcatttctttcagctctcccctttgttaactcctctggaggcactctggccccctggctgtttctcagagatgcaaggcaatctttcaccttagggactttgcacttgcccttctcttgtggaaattacaatctctcaatatcttctcacttctttttctccttcctcccaagatcatctctcataagatcttttctggccacactatctaaaatgtctactcttgtcacctggttgctttatattgtcttttgctgctttactttttttctccttagaactaggtagcatgctatatattatatttatacatcttgcttattatgttttctccactagaaatcaagctccatgagggagaaatgattcctggtttctttactggggtattcttagcctagaagagtgtttagcacacagtagtttcacaataaatatttatgagataaatggataaatgaatatgttactatttaatttctggcctgctctcagattaaaaaggaaaccatttttagtgtgaatatacagtacagcttattcttgcaaaacaaaccagtacaatgtattccagtattgtgttttgcatgtatgtttttatgtgtgcatgatggacctatacgtgggtaatggatagtgaaaagtattgaaacattatgcttatagttacatgtattttttccttccatttttcacatgtagaatgcaagcacttttggtctaagccaagaagtactaactccaactttgattctgtcttctattgataagcttcacgggtcactggaaccctacataaatatggaagcaatcttttcttcttcttgcctttggctagccaaatttttctctaatagcataggggtggcagaagggacgtatggtatgtagagaatatttttaaaaaaccatttcactatctatatgtatatcaagtatcatgttgtacaccctcaataaatatgataaaatttaaaaagaaaagacagatttaaaaaaaaatggtttagagaagatagagatctgagtctcctttcacccaaatctccttcaatttggcccttggcaaccaattagggaccatttgtaggtcctagaatcagtgctttgccatttttgccttgaggtttcaatattgtcttaaaagtactcactaatgaaagaatgaatttagaatgaaaaacatttgcaaagttctttaaaggaaggatttctgtcttctcatctttgccttcatctgtgaagctgactgatgctctataagcccgggggatcctccgttggcagctgttgttgctacttcaaaggagaaaaaatggatgtgtgggagagaaatatattcagggcaaacatttttttttctctttctactcaaaattgaagaagtgggaaaatataaatccaggattagtccagaaataaaaacgaagaatgcagagtggtgtgacagaaaccttcagcttagtcactaccttgctttgggtcttaggttcttcaaataggaaataaagatattaaacaaaatttcctatctagcccctttcatgatatagtgccactcttaagagctcagtctttatccctgcagtctcacgtgtaccctttcactccctgttctggcactagtagatgactagccatgtgacctcccagagctgtggtgttctcatgtgtaaattggggatgataagagatactctttggtatttgtgaggataaaataaactgctacatagaaagccctgttatagggcctggaacatgatcagtgctcaatcaatgtttgccatcactatgcaaaagaaatgtatgcatcttctacccatcttcatggaagaaagcataagcacaaatgttagtgacaagcgaagttcatcaaactttggagtaaattaacaatataaaatttatctttagagtttaaatattcatctttctaatatggtttgttcatatggattgacttcaaacattctagaaagtatataaaatgtgcctgtcctatgttttattgagaagcttccttatttaagcctgtcagccaggcactattctaagaactttacatgtatgaagtcgtttaatcctcagacaaacccgatgaggtagtattgctatcgtaaccagtttatagttaaggaacagagacactgagaggtgaaatatgttcgctgaagtcacacagctaataaatgacagggccagtatatgaacccccatagtcagatcccagatagtgtgttgttagttatgctatctcactgtgtctcatacacacactcacctcataggtatgcaaaaaaatagccaatattgatttcaaatttagtctttttaaaacaattagaattatgtgggtgaagcattataggttagttatttgcatgctttatcagtgagtgctaaaagctaagcacaaaaattaaaagcaacatgtcttcacttattgagtttatctttgaatgtgatggagcaaagctctcaccagggaggcattgacactcaggtaagggcttggtccccctgctttattttcactgcaatctattttcagacttttctaattcacccaactcactagggcagactgaagtgttaaattattgccaaaagcttttctggaagaaattgtttagaaagataaattttaaggagattgggaaattgcctggtgatcagaaaggagactgtttcagtggttgtgtgaaagaacaaaattggatcttcaaatgtgcaattttctgaaaagttgttatgagttgtttcataaagcttatctccctcatggcatataaaatgtatgtttaacaggtaccaaaaatctggtggtagtaaacaaccccaaacatcaaagtatgaaagaagattacatctgtagtctgctttttaacaaattcatgcaaataggagatctgcagagtagggttttatgtagcagcatagttacactgtttgtcatcattgtcctctcatcaatatgtgtagtaaaggttattttgtgttttgaaagctctaggcagacaaatacggttaaatataaacctctaaagatctggtgttgaaataagtcaggcactatttatcactgaaagcatcctaagagttatacagttttatgagaggttgacggaaacagttaagtctggttcattaaaataaccaccacatagatgaagccatataaaccctttacttcattaaattgcgctttttggcttcaatgcaattaaacacttttaaccttataaaaactgtttcaggaggacataagtaactcaattgaaaaacaactccctttgcaaatactcatctgaaaagagaccagtgacttacgtctgaacatagcaatagataagtaaaggaaaaaaatgttgataaaggttgtctcttgttattgaaatcaaatagctgatttttttctgctacttaatatttttttgttctctccacattttccagcttaattatgtattattttctgttgtcagaaaaacataaacagaagtatgttatgtctctctcactgacctttaaaggcactggtctattaaacatttatcaagtgcattctttggggcaggaactgtactattctgaaaatttaagattaatatgatacagccttctgagtatttcatcaaactgggattgtaacagaatacaagtgattatgtatattggattcaaatagttccacacttgtaagtacctatagggatataatggaggagaaaaagaagagggaattagtaccacatagtgtaatggtcaggaaagaccacagtggaaaagataatgcttgagttagttttataaattcagatctaaatttctagttcactcagagaaactgacagtaaaatttactatgggccctgaacacaagataaaatgtaagtcatagggatcttggtcctatactccaaaagacatttatgtatgttagctctttctttgtcaatgtacatctgtttccccagtactttacattttcatctctcttttcattaataaaataaagtagtgatatttacctagaacataatatagggctactgaatgtaaagagactgtgaaaaggaagtaactgttgtcaggaaaacagtattttccttgggaagtataacagacacatagaaatatctgagttcttggagaaccttgcattatcaagaaaatagattcaaaattacaaacaaacattattcaacaagtaatttggattataaatttacacataatgagtcataatgtacagagctaaaactgtaaatctagtgtagaggcttcttatcaggtctctgcaaagagacatatatacattatataaacattgtaacgtgaggagtgttaatatatttaccatactgaaaatggatcagctttgcaaagcattccacccgctccccatgctctcctttcccccctctcctttccccttctctcttcctgccttccttctcttacattcttactttcatctgtctttccttcttttctacctctttgtctccttttcttccttccatattttctcctttcttctctttcactttcaccaaactttattgagtcctttctaggtgttctgcactgaagtaggatttaagtatggtttccaagaattccccaggtaattttgatgtgctctcatttttaaccattgcctaggccgtatggctgcaatttaagcacagatcattgtaatattttgcacttcatatttggaacatttgatttacctctccactcattcaacactgttttaaaacaaaacaaaacaacttttttcttatctgaacattgaaaatgcatgtgtaggtcacaatttacattttattgcaatccataaggttttaaagaagttattgatcttaaaactggaaactcctcataactggtatttcataatcatagtatattattcatgtgaacctcattaatagctttttcttacaggactggttaataaatatgtcaatgataaaaaataaattttctctcatatattttccctttcaataatatgtgtactaatatctattaaagtatccatataagtgagttaatatttttctaccaaaaatatatgtagaattatttgaggagcaaggtctgtttcacagtgaaacatgaaacctgcatttatgcattcaggaaggatttattgatcatcctctatatgctagacactaaatgctagagatcaggaactaatgcaattaactctgactcaagatctcccattctagtgggatactgacaggaacaagaaagaaatatagctgtaagtataatttcaatataatgggacccataatgtgtacaatgtgcaatgggtcattgatatggtttggatttgtgtccccacccaaatctcgtatcaaattgtaattctcaatgttggaggaggggcctggtgggaggtgattgaatcatgaggtgaatttcccccttgctgttcttgtgattgtgagttagttctcacgagatatggttgtttaaaagcatgtagcacctccctcttcactctcttcctcctgtgccagccatgtaagatgtgcctgctttccctctgccttctactataattgtaagttctctgaggcctccccagccatgcttcctgtacagcctgaagaactgtgagtcaattaaacctcttttctttataaattacccagtctcaggtagttctttatagcaatgtggaacagactaatacagtcattaactgttagtgattaattccatttgggtgggatagaggaggcttcagagggatagtggatttccatggcttcaataaatttcccaagaaaatcaggaaggaaaggccatttcaacactggtgacagcatgtgaaaactcatttctgaagtgtgaaagatcccatgttatttaggagatctgagtagcttgcagtgggggaagtgaaaaatgcatgatagggggaaggaagagaggaaatagagttggaaaggtagcaggaaaaagaggtagcagaaacatgtagctctccaaagagaagattaaacattgctaccactatgtctttatggagtttcaggaagaaactgatgataccaaaccagtttgttatttagaggaatatcattcagaaaagatgcaataaatattagggagtgggcgaggagtgagaatgccagctgagagagtagttaggcggccatttcagcgtcagcataagaaataacagaaagactggggaagaataagacatgggctaggcacattacacaggattttgtgaataattagatgcaaagacaagagagagaaacaagacaaaagcagcctctagatttcacaaaatacaatacaagttaaatgtctcttatttgaaatgcttggggacagaagtgttttggattttgaaatatttgcattatacttactgattgagcatttctaatccaaaaatccaaaatccaaaatgctccagtgatcatttcctttgagtgtcatgttggtattcaaaatgttttggattttggagcatttcagatgtagattttcagattaggaaaattcaacctatataacagaaagtgtttaagaattgtctaggccagtgcttcttaaatgttaaggtgcaaatgaatcacttgaggatcttgtgaaaatgtagattttgattcagaagttgggaatagagtgctcgcttgaacagcacatatactaacatggaaatgatacagggaaggttagtgtggcccctgcccaagaaattggggatacagtctgagattttatatttttaacaagctcccagaagatgcagaaggagctggtaaacaaaacactttttgagtagaaggagccatggaagccagctcagagactgtggaattaagtgaagtgctaatgtgtgtagacaataaggaggcacaaccaaagtggggttgcgggaaaggccagctatgtaagagaagtgtgagtgaggattgcccagaggcacacatgcttcttatcaagaaagggggtccagagttcttgtcatccagagttaattgttaacagaaaacatttaaaagtaatccactttaaataggtaccaatatttcttagaagtaaagaaaagctgtatttaaaaatttatcttgaactaaaaaaataaaaataatcttatccttgttgtgaggatgtatttgcaactgcgtgttaactcagcatgaataacagtcttaattcatatatgtgtgtgtttatgcaattattttaacaatctcattatttagtttcattccacaatcatgaagagatatgtttttgcaaaactcttcaaggaattccataattttttcagaccctcttttattcttttgatatccatatcattgtcttttgaggagtccgccccataaattttctcttcaatcgttaaagaatgtataccttccagctactgtttagtaatccctttgtatttggtcagaccagttctctcataacacttccatcaacttcatgaaatcatgtatgtgtcttttacatgatattaacttccatcatatttacaataaatagcattaggtagtcttaatatccaaaaatcagtggctcaagaaggattccactgttaggcaataagggatactttagtgggattgagaggtaattcattaaataagtggcttggaaaacacatacttttgataactttaactcagggttgtcaagaggcttaaacataatagccagtcacccatatgctctgactttttgatataggtagaaaagacagagaaggatcatgctttcacataattcactcattttagggacggatcctactaactacatgcagaagagttaatgcattgtgttctcagcagctacagaaatctgaaatgaaatagtttgatttgattatatttttttttgagacaaattcttgctgtgttgcccaggctggtgtgcagtggtgcgatctcggctcactgcaacctctgcttcccgggttcaagcgattctcctgccttggccacccgagtagctgggactacaggcacccaccacagcacctggacaatttttgtatttttagtagagacagggtttcactatgttagccaggctggtatggaactcctgacctcaagtgatttggccgccccggcctcccaaagtgctgggattacaggcatgagccaccgtgcccggagatttgattatacttttgtctgtcagaaagaagatgttcagaagataactgcatcactggctgctgcctagacattaccagtgtttgtagtatctacgttactactgtctcagtgaggcccaagtgtccaggaaacaccatagaaggttcagggaaaggggaaagcctgaatagttgctgattggcagctgaacaaagataaagctattcccatatgacagtggattggaaggtcacgataatggaattctagtcttactgtccatgtgaagttagcagtatggcatgccttagtttcttttgaagcttcaacattctctgactctatgcattgtgttaagagcatgggctttgtagtcatgtagacctgggttggaatgccaggtttgtcacttactgtgtgatcctgtgtaaattaattatttttctgaacttcattttactaatcttcaaattagagattataatatctactgatgaagcccacctgacaaggtacaccaaaggcatacttatagttcaacgaagttagatttattaacttgttgtatgaagggagattgcacagcagaagcatggagcatccaatcaggcaaaggaagaaacagggttaaaaataggattgggggaaaatggtgtttaggcatacttaaataaagaagaatcgtgatagtgctaaaaatgagcaatgctcaaagtaaagagattaacatcaggccagagttaagaagtggactctggattctgtttccttggaaactccaaagttaagacacatgttgaatattgtatctgaaaaacccttatctgaaattttgcacctgggttgaaaattgaggctgtttcttggtgtcagtgactcaaatcttccaggcaagtgtaggttgttccatttttactgatctgatttcaaacggcagagtttctaatagtctgtgattttagagaacaaagtgtctcagtgttacatcctttggtaaagtagcaaaagcagtattgagaggttgacctcataggcttgtacaaataaaatgaagcaatgtacatgaagtactgagcacagtgcttatcttataagcaattgttactcttactattattgtttagctgtactttcacaaataaatataccataataagacaggatgctgacttaaaatgactaaactttagttactgaaaagcacaattctgaaaacttagctagccaataaatggaggaattcattcttatgaccttagataccccatgctttcaagaggagtctaggtgcagcacaatcacctgttgcctttgataatactgatttcctgatcccacctcaccagaaatgtgattcaataaacagacttgcagagaaatatgtatttgcacttttcaaaagctcctgattttgatatgcaaccaaatttcagaaacactcatataaccaaatgaccatgaggaagcatttcaatacataaactattcccaaatgatcagaagtaaaagtttagaacattaaaaataggcataaatatgatcttgtacagatttcactcagtgttgtaatgccctttgaaaatctctgatacattgatttttcaagttgaataccttcagtattggtaaaaataaatcctatgtaattagtttttttttttttttgagacggagtgttgctctgtcagctcattgtaacctccgcctcccatgttgaagcaattctcatgtatcagcctcccaagtagctgagattacaggcatgagccatcacacttggttaacttttgtattttttagtagatacagggtttcaccatgtgggccgtgctggtctcgaactggactcaagcgatccacctgccttggatccgcctgccttcccctcccaaagtgctgggattataggcataagccagtgtgcctggccagtagctgcttttgatattggatatttccaatcatgaataagtccttgctatactcatactccattcattgtctgagttctgctttctgctgcaccagccaagatttacttctttctgctacataacagcccttcaaatatcaagctacttcaacttgtatgttttagagaagaatacagcccagatttttgaccatttctcttatgatatgctttcagagcttcccccttcctggttattctcatctgcacacattcttgctggttaatcttactagactcagtacagaatcatatactctgaaacattgtaggtttgtgtgatgagcctagatcaggaaagtaaggacgcttattcgtaaaaatatcaatatattttcccttatagaattaggaaaattatcacaatttaaatatattatttttttcatgaagaattgtggttatataactgacacaaagaaaatatttttattctaagccaacaaacgctgtctgctaaagtgaagttccattgcagaagacatggttatttttcaattatgataatatatatctcagtgataaatcaaattaaaatttcctcatcactgcacataatgatttaagatatattcttaaatctcattaaagattcactatccctaactgctattggctcccagacaattgtctcataggatggatctctgagcaacttgatgcttcagaaatgggctgagaccccatggggaaaacagcttagagggcgccagtgcctcttctcttctgcttcagggctttgaactttagtttcgaatttagcccactcacccttctcctaactctcctaacaacttcagttgttactgaattagctcatatgcaattggttaattggggagtgatgtcagtataatgtgaatttgttctggttcatatcctttttttttttccaaaatctttaatattttatacaaaaaataacaagcaaagtgtatgatcatagctgaaagcagcaagctgcagttacgtagtcctttacacaatgataatttgcctacagttattttcttgaattgatttggacatgtgttgcctgtgttactccctaattgtgccttttctcttgtctctgtagctcagctacctcaatctatccttacatccatttttgtcaagtaatcttcaacttgaaagttaagaccctaaacagtatttactgaagtatttttatttattagcaatataaaattattttagctgtgttagtatgtaacacaattactgttttttgttaattctctaacaaaattgtataggtttgaggggtatgccataacccttcttgtttataatgcatgattttggaaagcatgaggttttcttgaggaatgtgtattttgcattttattagcaccatgatcaggagtctcccaaccagaacagatcaagagacagtgtggttgagggggttttgtgaggctggggtcctctgaacttcactcatctcagtggctgtaaatcctttacctcaaacacttgtggtcaacttcaataccagtgccaatatgtctcactgaatgtgaaaagttaatggctgaaaagatatttttatctccctgttcaaggcttttaagacatgccacactaccacaaacagaggcccataaaaacagtttctcaggattctcccatttctgccctcatcttaatgacttctagcccattccatttggttttatctattaggttggtgcaaaggtaatttgctttagcttaactccttggcttcaatttcttggctcagaccttcaaagttgattagtatttctgcctcctccttatgtagaattcactttggtttccctcagccatttgtaccatggactttctgagtggtttcttgcttattctgtcttccctgctccagttttgagcattatggagccccctgcaccagggtgatttctcagcagtgctcctaattggaacagccctggccaatccttaaaatgaagttgatttagtaagattgtcatgagagaatataatggcatttttgatcctgcgggcttactttcaaagtcactttaccttccaataaggctaagccttttcaatctttataactgcaaaagcaatctagctattagcacaaacccagagtagaattcaatctacactgcagacccctaggcatttacttctccttttataatgtttttaaatgctgtttcatattctggtagcttctccaagtatgtgacattactccacatgtgggaggatattggaatagaaagtaaagacacattgattccttcaaatcagcagcaggtcattcagcagcgctttgtgccaatgtaccatataaccacttcctactctacaatcattagtatctatcctagcatatccaatagccccagaaagtcacagcctggacaagtcctgggagacactggctgtagtgctatcattcaaagtctggtaatgcccacaccggctcagagttggcaaattcaaggactacgaggtcaaaattatgtaactataaaattatataacatttaactctactagatttgctttaaaaaggaaaataaagaatttgtattaacatcttaatgaatttacacagcatagctatttggttgagtgtttattttatttgatcagaatcattcttaaggagaaagttaggccagtgattttcattatatgcaacaaagctgtttgcctttccaaatgcatacagaagagaaaacagcaatcatatttcatcagctgaaggaatctatcagtatgtagagcactaatgaccattcatttgtatatttaaaatacagccagatgaaataaaatgtctcgaatttccagaaagttgttttcttcagtcaaatgtatttaaggaaacactatgtttagtaatataaataaatataattatttgtacattaaaatgtaattgctgtattggaattagaagatcactacttttttattttagttgaatcattttgaataaaatgtatttttgagttggtattaaatcaaataaaactgctttaaatatatccattctattttaattttaccaaaataaaatatcttcaatattattgttcaaacactgcaatttatgtattgaatcaatagatgataaaatcctaaaaatacataatgccacatctttttttagcttcagtgattagtaccttaatttaaatgcttgcttcataaaagcgtaagtagtttgttaaatgtcaaggtatattaggaatgtaatgtgcattttaaaatctggttaatgttaatttaaaaaatagctatgaaagaacatagaaaattaaataacatttaatagtacttaatataaacacgataaattacttaaataagcattcatctgctcatattactgtttttacatatgcattctacataaaaatttttgcaatttaggtaataatttaaatgcaatatgtaacatcacttatcctttattcaaatatttgcaggtttttaaaatacagatagtaagtatgactcggtaatggaatgtaacatctctaatttcaagttttatgtgtgtgtgatttaaaatatttattggttttactacatgttgtgcctgagagaagagcagaaatattatattttaatggagtcagaggatacagccattatttaaaccccaaacacttggctcattgctgacatggacagtagtgacttactggtctgcacctttatgatgcagtcaatggggcagcattatgatactacatttaaacaagcacattactttacaacctcttacaatcagttatattgcctatacgttaaataggctttggtggtcaatttgcattgctatacttattttaatgatgagtaattggtgtggccaaggaaggctaaaaacatgaccattgttgcacagcaatgtaacaggaaaagttgaacctctgatttacttatcaaatctggagataatctttactagtaattctatcctttgtgatcttctaagactgaagcattttgctataagaacctcatcactaacataaatattatagactgcgttttcaatattacagtggtgtcatgttcttagtatcttaattgttcttaatgttcttaatatggagaactcctgaaggattgttaccttccttgtcagccacacaatgtttataaagtcaatctagactagaatactattccaaagtcaatctagactagaatactataccacaaaccagttgttttcctattagacagttttctgttttctgaggcagggtgaatttcatgattatttatcccattaggtcagaataactcagcgatgaagaccttgtactccacgattagccatacctagatgtgaattctgcctctactacccaacaactgtttgactcaaagaaagttatttaatttataaatatttcatttacctatgtctataacaggaacaaataatagtttttgcttcataaagtcagcatgagggttatgctatggtttggctatgtccccatccaaatctcatcttgaattgtaattcccataatccctatgtgtcgtgggagggacctggtgtgaggaaattgaatcatggggcagttcctctatgccattctcatactagtaagttctcacaagatctgatgattttataaggggctcccaatttgcccagctctcattcttctctctcctgacaccttgtgaagaaggatgtgtttgcttccccttccaccacgactgtaagtttcctgaggcctccccagccctgcagaactgtgagtcagttaaatctctttcctttataaataatccagtctcgggtatgtcttatagcagtgtgagaatggactaatacaataaattggtaccactgagagtggggtgttgctgtaaagatactcaaaatgtggaagcaactttggaattgggtaacagccagaagttggaacagttggagggctcagaagaagatatgaacacgtagagaagtttggaactttccagagacttgttgaatggctttgacccaaatgcagatagtgatatgaacaatgaagtccaggctgaggtggtctcagatggaaataaggaacttgttagatactgtagtaaaagtcactcttgctgtgcaaagagactggtggcattttgccccagccctaaagatctgtggaatttttaacttgagaaagataatttatggtagaaaaaatttctaagcagcaaagcattgaagaggaagcagaacatacaaatttggaaaatttgcagactgtcaatgtgataaaaaagaaaaccccattttctagagagaaattcaagccagctgcagaaatttacataagtaatgaggaaccagatgttaatcaccaagacaatggggaaaatgtctccaaggcatgttatggtggctcttcccatcacaagcctggaggcctaagagagaaaggtttcatgggctgggcccaggcttccccttctgtatgcagccttgggacaaggttccctctatcccagctgcttcagctccaaccatggctaaaaggggccaatgtgcagctcaggctgttgcttcagagggtgcaagccccaagccttggtggtttacatgtggtattgggcctgtgtgtgcacagaagtcaagaactgaggtttgggaacccctacctggatttcagaggatgtatggaaacacctggatatccaggcagaagtttgctgcaggggcggtaccctcatggggaaacactgctgggacactgtggaaggaaaatgtggggtcagagccccacacagagttcccactggagcactacctgttggacctgtaagaagatggtcaccatcctccagaccccagaatggtagatccaccaacagcttttactgtgcacctgggaaaactgcaggcactcatgccagcccatgaaaacaggctgaagtggggctgtaccctgcaaagccacaagagcagagctacccaaggctctgggagcccacctcttacattagtgtcccctggatgtgaaacatgcagtcaaaggtgatcattttggaactttctggtttaatgactgcctttttggccaatttctcccttttggaatgagagtatttacccaatgcctgtacctccattttatctaggaagtaactaatatgcttttgattttacaggctcatgggtggaaaggacttaccttgcctcagatgagactttagacttggacttttgggttaatgttggaatgagttgagatttgggggaaccattgggaaggcatgattgtgttatgaaatgtgagtacatgaaatttgggagggagcaggggcagaacgatatgttatggctgtgtcgtcacccaaatctcaccttgaattgtaactttcataatctccacatgtcatgggagggacccagtgggaggtaattgaatcatgggggcagttttccccatgctattctcattatagtgagtgagttctcacgatatctgatggttttgtaaccatctggtgttttctctctcttgctgccgtgtgaagaaggacatgtttgcttccccttctgccatgactgtaagtttcctgaggcctccccagctttgcagaagtgtgagtcaattaaacttcttttctttctaaattacccagtctcgagcagttctttatggcagcatgagaacagactaatacaggtaattatgaaataattgaccagctaaaatgcttagtgtaatgccagaaatatattaatgcactattcaaaaatattagctgttaacaatattaacattcccatcatatttatttgttaaatagtcccaatagatagcatgtagttgatggaaaattgtgaaaatttacttggtaattacaaaataattgcttcaccttccccctataatgtggatatatctctttgtagctgaaaaaaaaatctctgagacatcagtagctcaagggatgttgttcattaccttaaaatttttccataattcatcaataacatcatgctcacctttctccctcataatgttcccagacagttttagctacagtgcatggcaatgacttctggtgtcatatttttccccacagctatcactgggactagtggatataaaagtatccaccttgaattagctaaagacaacacagttgccttgcagtaccagtatttgagattcctaacttttcataacaccttttcaatctttgtctagctttccaactgcttgttctacttcttcctcatacatcccaattgctacgtttctaatgcctctgtacccttagatattacagactgttaatggtctactaacacatccaaattaaactcaaaattcatttcctctcagaaggtttctccaactcctggcctcaagcaaacttaggagataatgggggtctttttttttcacagtggcttcctgtgggggtgtaggcagaaaggtcagaattataatacctagagagcttttttaaaatatccatatgctgagggcttttcttccccacatgctgtgggaatgagtgcaagaatgtataatataaaaattttccaagctacctttaaaatccagtacttccttttcctatgacactacacagaaacattgattcttgactttataactctttttttaaaaagaaaaaaaaagaaaaaaagaaaagatcctgtatttctaattctagtaagaaatttagacagagcagagtaatatgttgactttataactcttgtacatactcagtcactgtgcagttaccttattttttaatagtttagttttatatttatcacccttaccaaactccttgacagcaggaattttatttttttaatcccaagaaagtataatgctaaatacttgacaaaaatcagtaagtgtacttttgtgctgacacaggaatgaatatgttttaagaccattttacttattgtcacttaactataaatctcaagtagaataacaaaatgcgtgttgaaaaaaagtttttttagatcccaacagagaaaacacagtctaaacattaaagttcaaatattttgttttataagaaagcccccaggtcatcattcacttttactgtaaacaaaattataataaggttagttttactttactagttaatttactcatagtaaattgtgtaaaaatattgagtggtttagctgacatcttccacagaaagatgcatcatcagcagtaagaattgatagcttgacagactatcaatagacacaaaccctaaaatagacacaaatcctaaaacagttgagaactttcatgtattttaatttaacaataaacatctccatagataagtcactcaggcacaacaaaatcgaagccaaaccaaacaaatcatatttataatctaaattgtatcaaaagagttaaaatttttgatatttgataccatataaatatgatttataatattattaaatactttgaaaatagaatgcacataaatatgcattgatatactttgaaaatacactgaaactagaatttacattaaaattatttaaaacatatgtattttagctacttatgtgatagaacttaagtaccacagagagaagtggtcacattatgagtgcataatatgatgaacgttgtcatagaaaaatgaattattactgtgtgatcacaaagtcagctactcactttgagttaaagatttatgaaatatgttagagaggtgttaactgagttgagcgttaaagaatgggtggcagttttgcaggagtgaaagcagaagctcagagaacctggtgtgtttgagaggaaggtaagaaggttcatgtccttgaagcataggaaggtgaagattacagataagttcagagatgttgaaaagagatggaaagcctcataggctatatgtgcatcaacatattggcaacagggagttagcaaaggtgtttatcaaggtagtggcatgagaaaatttatttgtttctttgatttagtcagaaaacccaagtggttgagtggagaatagatctggtaaagttaggtggctatggcaagagttcagaaaatttatttttaaaggtctgaaaaaggctaaagattaatggtatattaaaaaggtatttaggattgattggataggagaaaattaagagatgagtggaagctttaatacatacatgtctgattgaaataagtgctatacttttccttagaggggatttgttttcaaaataaaaattatagcttacttttcaacttttaaaaacagtgtctgtaaaaactatttatctagcttccctggaaagatctcagttgttctggttcaatctcatttcctcagaagttagactttccaagttaaatgatgatgaatgataattattctgtaatgaaacctcaacttggcatcaacgaacaagacaacatgaaatggggattaaaattttgcatctaattactatattttagtaatgaagatgaacattttggtagtttttagatttcaaaaggcttgttctatcatttttgcttctgtagaaactctattgaagattgtctagcactctatatcttaatgggtacaatgcaaaaaataagttagttttaggaaaaaaaggtattaaattttaaaatctttaaaaacaaatcaacctaattttaattacatgattgtaggacatttaaaagcggacatcagctgaaaatttatgtttcagtgaatacttaaaattttgagaatatacaacttacattttcacaaactaagtgaattgctaaaataagatgaagtctatcaaaatgtcaccataaaatatagctaccttaatatgaataaacatgaagaagaactgaatggcttcatagaatgtgataataaaaacatgagcatgagaagagtgccgtgtccctttacattgcttccaagcttcccttttgttgctcttccttctgcatatgtatattcatttataagaacataagcaggaaagaagagcctcaagaaaatcccaaaaatgatttaacattgtattcttgctgttttatatatcacaatttattttgtatggtggaaattgtcttcaatatatgaaattcaggctcataaaatgatgggctaataaaatgcaagcttttatattaaaaatagataaacatatacattataatactatcatgttagtcatttgtggaagttgtacaaaatacagcaaccctgtaaggcctataggactttaatttaaggaaaatgtaactggctggggcccaggtggggggtgcaaatattgcaactttttcatggttatgagtactatgtggtagatctgagtttaattttttttttatttacaatgtatttgttcttccctagtataaaagaatagttgagcacagaggagtgttaaccatatggcctgtgttcaaattctattcacaccattttctagcttagtcaagttactagatcttttttcagttttctctagtgtagaatgaagaaaataatggtactctgagaactgtttggtttaaatgatgcaatacttcctcatcatttaaattttgccggaccaattaaacactaataaatattgacttttattgttattctccaaaaatttacattttatttattaaaataattaatctccaacttcaagatctagcagagaaaatattttgactattaaaatgtaatatggcttcaacatttagttattaatttcttcctcttacctacatggcttattatcagcagactggcctaagagcaggaataatcatcgtagctttgtagtcccctaattctataagttggaaaaatagttagggaactttttaaaatatataatacttttacgattaatagtgatttttgaaaaaaccttttctgcctcttgaccatgtggttttcaaagattgattatattttggatgatttcacattagatagtaaatagacacatgtcaaactaacccagagggaaactgggagaaattccaatgagtattagttgaattgaacattgtccccatcactaaaatgctaatttacattggctgtacagctaaagctatccatgtcaagaatggaagatctaatatgtatcttgatcattttttgcctgaactgcagtcagctgttgctatggtcaatttcttttctgtatctttacagtataataagaattctaataatataataataataataatagtaacagcagtgacaaatatttattgagcatctgtcaaatgtctggtactatgtatataattttgatatatactaaataatttgatcattacagatactgaggcaagtgtcaacttgttactcacattcagtatttttaagtaaggagtttgaggctcaaaaacattaaaattcttgcccagggtcacacagaataactggtattattttatctcaagtgttagatctgttgttctgtgttgtgatactgtttgaggtattgaatggaaggagaaggcagattatctgcaaatctaactttaagaaataggggcatggatctagtctcatcttccccaactggctaggtagtttccaactggccagctggaattttcccatcctgatttaagtaatgagcagacattacactgaaagtcattgcagaattctaaatcccagcttctcttatttgtggattagactctctgagtcacaatgactatgaatcctctcataactaacaatttcattaagtagaattatttctgacctcatagtcctggctaaaatccattgaaagatattagtttatgaaaaaagtaattaaattcactgttaatgaagaaaaattaaatgattctgtataaacagaattttaaaatagataatctcctctagattgggaggaaaaatactgagatggcagtgagcaatctgaaaaaacaattaaaatacatttctattagagcagtgaagctattttatatgatactgtgatggtggatatatgtcattatatatttgccaaaatccatagaatgtacaacatgaattctactgtgaactgtggagtttagttagtgttaatttttagttagtgttaatgggttagtataatgttaattagtattggctaatcaattttaataaaggtaccatcttaatgcaagatgtaaataataggagaaactatgtgcatgtctgtggaatagaaggaagatataggaacactactttccgctctttttttgtaaacctaaaacttctctaaaaaataaagtctgttaattaaaaaaataaaatgtatattctaggacataagatgagttaaatagaaaataaaatgtgtatacaagaagtggttatctacagtccctatgctgaactttataaaagtgtcatttccaatattccattttgtctgtcatcagaccacttgtctccatttcaaagccatatcaagagctcaaaatatgtatgcatggaattgagttggagaatgtcaattctcatacctaacttccagtaatcttgctggaatggccctgacagttttaaaacagctacaaggaaagacttcaacactgtcatttaagtggatgtcacaaagtagatttcagttaaataacaaaatgatttaactttccttgaagaacaatttgcacaaaaaatgaggaaactatttacataaatgactggcttgctcatgctaaaagagaatttatcagaattctctggcagattcagttttgcactcttaatttatttacagtacttcagattaaagaatttcacaacataagaatgttgtaaatatttaagagatgatgccttagatcagcaattcctaaggacctctctgtttaaaatttatttttcccttatacttaaaatgaagattgggattgtttataaatattcatttcatggatatcttcccacaactctcttcttacagcaggagccacctgctctgaacagccttagagtgcaaaccatactaaagggaattggtgaatgccagaagacagtggtgttaagtgttggctggcttcttaagctccctcctccatacggcaagtccaaaagtgcctaggcaacgagcactcagagaaaagatggctattgggccactacatacctatactctgtaaagtgcttttacaaaattactgttactaagcatttctatatctctgggatgaagaatgtctaaaaaaattactcttacattcagaaatttagggcagccaatttaatagctctagctctgtttgtatttgtttgttttagaataaaaacaaatttaagcctgaccaaaataagagataaacaatagatttgtaaacaataaagtagtatgcaaataagagataattttagcattaaaattccaaattaaatattgtaatttatctagcttattaagcttttttatacttcattttttattttttaataataatcaccctacctgaattctatatgttaaaatcatttagaagactgcatggtttttccagggttttagtataggttgtaacaagtcactgtgtcatgtaattgtgttcatattgtcttgtaaatgacagtgtcctaaagtgggatggacacaagatttgcaatcatcatatctcaattccttatctagctctgtcaccctcttaggtgtctgacttgggttataatttcagtttgtcaactagaagaagagagtccaacctactcacacaatatctgaaacatacttgttggtgaatggatccttcactgagccattttgaagaacaaatgagcttacatatgaaagtttctttgtaaacaataaagtggtatgtaaatatgctgtaaaatattcagatagttgcaatatctgactataaatgatacaaaccatggttatttctaatttgctgatcatttgaagaagtctggattcgcaagttgaaacttttaacccagctgttcatttatgataaagctttaagagtgacaccatcagtatatatcaggataaccagattcctctctttccattacttcctcctcattcctgaaggacttcttgataccagcaagttattgtaccttgactactattttaaaagctggagatcaggagatcaaaatccagaacatgaatttcattttgattaaatatgttccaattttgttgacactgatattacatattaaaaaccagtttttcaatgagctatatttccaaaacaacactattacataaaataaacagcatcatcagaagttacttttgtatattttaatttttgtgagacaatgttgcataagaattttggaataggagaagaaagagggaatgataaacaggtaaaacctactttgggcttttagtgttttgagttactttcattatcaacctgttttttttttaaataaatgcaaaaaataattttagtatgtacgatcttattaaaaatgaccttagtctaagtatttaaagtcacttagatgttaacattgtgtttaaatatttggtctttaatgaagcatttttttttcaaattttatttatacaacatattttttattaaatcttagttgtaactttaatatcattgtaataaagccttagtactgttcagattcccttagagtttgctagataagttttttttctatttaatacttataaaactggcttaggatatgtatggctggtggcatcaccttagatacagctcacaaagtgaaaggacctcaggagcatactcttgaggcacaatggggatttaagtgccttctcacccgcatgtcctagagaagatacacctgggcactaagactttcattttaatgcaagaccttgagactctgaaagtggaaaaatctttggagagacccaaagctggatttatgtcttagagacatttatcagagaagtgtgggtactatttttttaattaaagggatggtggttagattgttttatctccattgttgtgttaatggtcatatgcttcatttttggatattgagtggtagacaatgatggtgcagcacacctgaattaacttctccaaactgctctgtgtggaccccatcagtgccagaggaagcagatgtaagcttactatgtagagtccacaaaacacataggcattcatatatgttgggtcacccattaaactggtcacatcagagggaaggtgactttcataagctgataaatttatattctacatcagctacagtgatgaatactgatgccatctgtagcacggaggctctaacactggcttgagattagtggttataggaagcagtaggggtagaaataatggagacaagattctagtattgacctgggctcatgcgggaagccattacctgtgagctggtggcatccttagttgccatgcatcttctgggtccatcttttgaacaatggcaacagagttctaggaagcaactcatgatgatggcagaaaatcttactagacagctttagaaaacagaagcaaccacagtccttgaaaactaatgaagaattagccttggtacaaatttgcgcagttcagatcagctatagttcagttggcagagagcagttatagaaatagcttttaggtgtatctcatcacagactacaaccagtaatcactgccccttagagaaatcatatgagctgcaaaatatatgtaactgaaccacatttggtaacatattgaccaccaatgcttgtgaaagttctgaggaatatcaacaagggagggaagcagagaagggataatttggaatgaactgaattatcacctcagctttgagattctaacaaagttaaagaaaaactatgaaacttcttcagaggatgccacagagtctcagtggattgtggcatcatccttttgtcaagagctaatgagaatccatttttttgcttaaagcacaggaaacatggattgattttactaaacactacatttttttcttttgatgtctgtatggcattatttatatgtgctactgactacacagtatagtttgaatgttgaacttccaaatgtatttatagttcttcttattcttgatcataccactatcacataaatgagaaattattccttacaataataattttctctcaattcaatgtttcagctgctttgctatatcttaaattatttgatgctgggctctatatcatttcaccttccgtttgtaaaagattttgattgatattggtttcatattttatatgtcttactgttaatgagctgttttacttttttgatgcaatacattgggtctgggtcaaaaatcatgtattcctatcttttaacatggctggaatattactaattcacttaatataagtggatttatatagaagcctagatttagctatggattgattgaatgccattttggtaaatgtaattctgaatagcaaataaccaaatatcttttattctgtattcagtaaattttaatttaaagaaaagtgatgcaaggtttacttggtaaatgcattttctgaatttcataaatattctgaatcagtagtcactcctttatgaatctgtaagaggccaaataacaccctaaaataaagtttctcttaaattgcattcttattgtaaagaaaaatagcatataattgatgaaaaagctcacaacattctttcctccatctcctaaaatctgggattataaaaagagcagctgtacaacaagcattcaggccttttactattagaaagcccatctgtttttctgtacttttgcctaaatttttaataattatgtctagacatgtgacaaaaacacatagagattaactatttcttcactgattacaactttagaaatgaaccccatgaaaattcacactacataatttaattagttttattttaaatacagagaatgaaaatttcatcatgaacagggtttcaccacgttggccaggctggtctcaaatgaccctcctatttttaacttggatacctgctattctgccaaaagacagtttctagagtagttttgaatgggttgatttcccccagtcccacaaactctgaagccagtgtctagcttactaaaaaaagagttatacataatatttaagatgctgagtatttcataggaaagctgactgctgctgtaaagtgctctttaaatcttttttttaaatccctttctaatgaatgaaactaggggaatttcaggggacagagatgggatttgttgtatgataaactgtatgtagttttcagtctttctgtattgagaagccgtggttggggcatttttaagatggctggctactcttgttttccctcatgataataaatttgtcataactcagtaacatggacttgcccctagaggtagttgttaataattttgaaatattaaggtcttgccaagcttctgatgattcaaacctgtactactgattattaagcaggacagactgagctttctgctgcaaataccttggaggagaaagtaatttctaaatatacagagaggtaacttgactatatatgttgcatcctgtgcctcccttcatattaatatttgataaagattttaattcatataaaacttctaaagcagaatcaaagctcctcttggggaaatggcaagtctttaggacaggcgagaccctgtatgcatagtaccaaagcattaccacatggtagagaacacactcgattaaaaatgttaagctatctgaaaaataaaatatgcaagtcttcaggatggcacaaaacaaaggttaatactttttgggacacatttcttagcgggcttgctgagtgtgtaaatataatcaacttttgtttgtgttacatgactttgatgacttcattgaaaatctgcacaattcagtttcagctctggataacttcagttgacctttgtgaaggtttttatctgtgtagaatgggtgtttgacttgttttagcctattaagtttttattttctttcactctgtattaaaagtaaaatttactaaaagaaaagaggtttgtgttcacattaaatggctttggtttggcttattttagtcaggctttctgaacattgagatatcctgaacttagagctcttcaatcctaagatcttcatgaaaagcctctcacttgaacccaaaccagagtactcttactgcctcttttctaaatgttcaggaaaagcattgccagttcagtcttttcagaatgagggagaaacatttgcctgccgtataataataagactcagtgcttattttttaaactgcattttaaaaattggatagtataataacaataaggagtaagccaccttttataggcaccctgtagttttatagttcttaatctaaatattttatatttccttcttttggaaaaaaacctacatgctacaagccaccatatgcacagactatacagtgagttgagttggctctcccacagtctttgaggcgaattacaaaagtccagccactgtcatcctcctgagttattttgaagtgattttttttttttacattttggctgcagtattggtggtagaatatactataatatggatcatctctacttctttctttatttatttattactagacctcaaccacagtcttctttttcctcttccacctctctttgcctgtagggtgtactgtatgtagtcatgtactttgtattaatatattagaaatctacagatctgttttgtacttttcatactgttggatgcttataatcaaaacttttactagggtattgaataaatctaatcttattagaaaagaaaaaaaagaaaatttagtcatgaaatacacagacacacacacatacacacacacacacacgacattcatttgattttaaaataccattgagtataagatgcgacattaaaatgaagattaatggtgttttggaaaactacataagtattgactatataacaatcaaattttcaaaaatgttatatccaaaaatttatgtatgtcaaaatcaacaaaacaacactatgttatttctacccttaatataagtgcatatatatatatataatatatatatatatatataaagattaaaagaattctgccagttctgatattgttatataatcatatatagaatatccatatatattggattagggtgactaaaaattaccaggcaaatctttaactaagccatctttcatgtctatgcaaacccaactcagtataggttgccaatcctgcagccagggctgcctataagatagtattgatctggatccctgagaactcctggaatctggagaactgctttttctaccgggacaacactgatgtaagcatgacagggcatgagaaggtaaagtgagagatggttgctataagtttgacatctgcttcattttggtgcagaagaccacaatctagatagactcttgggcagtaccagatgacactgccccagatgtaattgccagtagtgagcaaacctatgaagatttgaccaacctcaacaaggcagggacagctgccaaggatggtgaagtccaggaaatcatctggtgttttatgaagtccggtctcctgagaaggagcctgatcacctgttttacagtaacaacagtaaggttaaagtagacatgaaaaataaaattgtctcccatttgacaattttatctttcatatctacttaccccaaagaatctagtcagaatgtctctgggcatagttccttagttcaaggctttgggtagtggtctctttaccaaagaccttcttgagtgaagacaggaaggaactaagacgtgaccagtgaagatcaagtgagcctaaggttacttctatcagccaatcttactctgcaaaactgtcccaggtagctgtcatctttccagtgaaatagaagatgaaggtaaccagtattacagttttaaaaaaatcaatgtttttagcttgactcctggaggatccttgttaagatcaaacctgaatatttgtctgcttatatttacagttatatatatactatatataatatatatacacacatatatacaatttatatactctatatatacacacacacacacatatatacacatatacaattcaaaaatgtagaaattcagatttctacttccaaataaaataatatagtcataaaatatttcaagccatttcttattccactgtggtataagctccccaagtggtaggaggagtacctcctattgtatatttcagaatccgttccttccttaccaatgtgtgtctgtgacatacccttaatgtccttgataatgtccaattatgtctttcactgcatcaccttcctaaagcatgttctagttacttggcttttccacctgggaacaatatcaattttagtataattacctgtctttctctttttttgccagaataatatgaaaaagaagtgacacgcaattaacaataattattatatctacttacatacatataattgcatttttgtattctcaagaacgtatacttttagagttacaggttacatgtgtaaaagacaaacagcttcagagttaaatacatccatgacattcataatatttagataagaaacattaagagtaaaggacaagacagcgggttccatctggccttacaaatggaaataaaaaacttactatcttttttttttaatcctggtctgtattgattctcatcttttaagccactatcaccaagagtcttaaaaataagaaagaatgtttaggtttatttatcaacatttgttcacagcaccatcaatgatctagaagaatctgcaccttccttgacttcttagatcatctgttttccagccccttctatggactttctggagccccagacctctcccaacatcctctctattttcctgctccccttggcatttccctctttacttttttcatgtttaatatgttttataaaaaagaaaagtcattatatgagaatttaaagtaatacgaaggtgaggaatctaaagctggataatttagtgccagcaaaggatggtttaatgttttcccaaagagattgactttaaaaatgtcaagataacaggagaagcaacctctgttaaccaagaggcagcagataagttcccaggcaccattaagaaaattgttgagaaaaaaggacacctttctgaacctgtttttaatgcagggataagtgccctattctgaaaaacaaaaacaaaaacaaacaaacaaaaaaaaacagacaaaaaatgccacaagggacatttattagtaaggaagagaggcgagcaccaggatttaagacagaaagtaataggctaactgtaatattttgtgcaaatgcagtcaatttataatcaggactgccctattaaagccttgaaaggaaaagataaataccagctgccagtcttttggttgtacaataagaaggcctggacaatgagaatcctttttctggaatggttccattgatgctttgtccctgaagtcaggaagtacattgttagtaagggcttgccttttaaagttcttttgatattgcacaatgcccctggccacccgcaaccccatgagttcaataccaaagacctcaaagtgttctacttgccctgaaacacacgtttctaattcagcctgtagatgagaaggtcataagaacctataaggctcattacacatgttactctatgggaagtattttcaatgctgtgaaagagaaccccaatagacagaacaccaggaaagtccattgaagatgtcattgttcttatagaaaaatccatgaaagccacggaagccatcagattcctgctggagaaaactatccagatgttgcacatgtcttcacaggatttacaacagagccagccaagaaaactatgaaagagattgtggatatggcaaaaaaaggtggcgaataaagggttttcagatatagattttgtagaaattcaagagctaatagacaccacaccacaagaattaacagaagatgactttatggagatgggagcttccaaaccagtgccagaaaacagaaagtatctgattattcaagaattcctttgctttttatgacatggtcccttctatgatacgagcactgaaataaagcaaatgatggaaaaaggattggtaccatatggaaatatttttagataaatgaaaaagcaaaagttagaaagaaattatgatgtatttccataaaggtacatggagagtgcctgcctctcctttctctccttccatctccttcacctcttctgcctctgtcatggagacagcaagaacagccccttctcttccttcttctcagcctaatcaatgtgaagataatgaggatgaagacttttataacgattcactttcatctaatggatagtaaataaattttctcttttctatgattttcttaataacattttcttttctccagcttactttgtcatacaaatacagtatatgatacacataaccacaaaatgtgtgtcaattaactctttatgctattggtacatcttccagtcaacaacaggctaatgtgccaatcaatgctttatgctattggtacatcttccagtcaacagcaggctattagtagttaagtttaggggaatcaaaagttatacatggatttttgactgcacagggcgtcagcacccctaagcctctcattgttcaagggtccagtgtacatgtatagatattagtgacaaaggaagaagtgtgtaaacactcaattaatatcttataataagtgatataaaaccttcagttgaatttttgagtattcaagcttgagcttaatttggaatatgggcaagagggagtacatacaaaaacaaaggtgtttgtcttttaaaaaaattttgagtttttccttttgagttcatgcaaaaatgagaaggttgcaccctctccccacaaccacccaagatttgaaatgtgtaagaaaacagaggcaagggaggagaaaacatacatggtatggaaaaaaaaaataatagaaaagtggaaagacttaagttaactaatacttaattttaagttgttcattttgtagaagtgcagcacaacttttgctcagacattatgcaatgatacataaaagtcttgggaagggaggaggccggctggtaggtaggtggagggtgataattttgtatgtacataaaataaagtggtgatgtttctcatatagttcagtcacaaagcaaaggaaaaaagtgaaatgagactggagggggaagaatcaggatccaaggcatagcatgttagcttgggggaaccagcccctggctactgcagccattccagctagaacatcagacacgtgagtggggacactagttaagacgactccaggtgttatctgactgcggttgcatgaaagacctccaaatgaaaccacgtagctgaggcccaccaacccacagaggtgtgagacagacaattaaaacatcaccatatgaagacactaaattttgggtttgttgcacagcaatagattattggaacacactcctttaccagattactaatgagaccatattttctccttgttgattctttccaatttattcattaaacatttattaaaagtcatctcctatgacaggctctgggtataataaggtaaataaaacatcatactttcctcctatggactaccctcagttatataatttcttctcttgaaaaatcttgaggggaattaatggatattttagtatttgctattagaacaattagctaatactctgtaataagttaatttagaccattttttcaaattagctggagaaaattttgtttttttaaataaattataatgcataaaatatagatacaggtgaaatatttgtataacctcctggtgagtgaggttatacaaatatcaagaaacaaaaagccatgaatcaaaaaatttaaagagttgactccatgaatggaaaaaaaaactttattgtggcagaaagcataataaacagaataaaagaacaaatatttgaaagaaaataattgtatacctatgacagaaaaaatgttaagaatgtttaatattaaagagctcctagatatttataataaaatggcaaaccaataaaatatggaaatgcaatttatggaataagaaatgaaaattagaaatgaacatataacatatttaaaatcattaataggaagaataaaatttgaaagaaattctccttaagagaattttttccagtaagatcttaaggtcaataatgtctaggacatctcttaattcagtttcatacagggaacaggcagtctgttatgcaacttgattgctaaaatcttttctaaattcagtattattgtactttgtgtccaagtagtaatataatcatcttggaaaatacttactttccaaaataaaatcatcttggtaaatacttattttccaaaatagttacaatgtagtataaagtgaaaagaggataatctttgtgtataagtaatataaacaaccttaaaattgtctgttaaaattctacaaatcccacagctgagcacattatacagaaaaaaaaaagcatcagtatatgtggatatatatctcatgcttacatttgcattgtttgaaaaaacataaatgccaatcaataagaattgttaaataaaaaagcatatattcaaattgtgtagtattatagtatgcagctattaacatgtgtgtttcatttataattattgacttggaaaaatacttatattgttaaatgggaaaaattaaatgtgaagtaattatggcatgattcatttttactgcccaaggtaatttacagattcaatgccatccctatcaagcttccaatgactttcttcacagaattggaaaaaactactttaaagttcatatagaaccaaaagagagcctgcattgccaagacaatcctaagcaaaaagaacaaagctggaggcatcacactacctgacttcaaactatgctacaaggctacagtatccaaaacagcatggtactggtaccaaaagagagatatagaccaatggaacagaacagagccctcagaaataacatcacacatctacaaccatctgatctttgacaaacttgacaaaaacaagaagtggggaaaggattccctatttaataaatggtgctgggaaaactggctaggcatatgtagaaagctgaaactggatcccttccttacaccttatacaaaaattaattcaagatggattccagacttaaatattagatctaaaaccataaaaaccctagaagaaaacctaggccattccattcaggacataggcatgggcaaggacttcatgactaaaacaccaaaagcaatggcaacaaaagccaaaattgacaaacgggatctaattaaactaaagagcttctgcacagcaaaagaaactaccatcagagtgaacaggcaacctacagaatgggagaaaatttttgcaatctacccatctgacaaagggctaatatccagaatctacaaaggacttaaacaaatttgcaagaaaaaaatcaaacaaccccatcaaaaagtgggcaaaggatatgaacagacacttctcaaaagaagacatttatgcagccaacagacacatgaaaaaatgctcatcatcactggccatcaaagaaatgcaaatcaaaaccacaatgagatatcatctcacaccagttagaatggcgatcattaaaaagtcaggaaacaacaagtgctggagaggatgtggagaaataggaacactttttcactgttggtgggactctaaactagttcaaccattgtggaagacagtgtggcgattcctcaaggatctagaactagaaataccatttgacccagccatcccattactgggtatacacccaaaggattataaatcatgctgctataaagacacatgcacacgtatgtttattgcagcactattcacaatagcaaagacttggaaccaactcaaatgtccctcaatgacagactggattaagaaaatgtggcacatataaaccatggaatactatgcatccataaaaaaggatgagttcatgtcctttgtagggacatgaatgaagctggaagccatcattctgagcaaactattgaaaggacagaaagcgaaacaccgcatgttttcatttataggtgggaattgaacaatgagaacacgtggacacagggtgggtaacatcacacaccagggcctgttgtggagtgggtcaaggggggagggatagccttaggagatgtatctaatgtaaatgatgagtcaatgggtgcagcacaccaacatagcacatgtatacatatgtaacaaacctacacgttgtgcacatgtaccctagaacttaaagtataataataaaaatcataaaataaaaaagtgcatgtaataaatttgtatatttggatatactgatctagcatagataacatatataaaaatgtacataaaacttagcagtatttgactaagaggtaaaagattaaaaggagttaaagatggttacgtttattctacatatatttgccatatttaaatatattatttttctacttttaaatatcttatttctcatatcatttgaacctataattctacttctcagaagtcgtcttaaggaaatgataaaaaagtcagaaaagagtggagaacaaatattgtaatccatattatataaattgactaagttgaaaatacccaaaaaattcagccacagggaactgattaagtaaatcaggttgaagtcttaaatatgacacttgttcacatcaaaagtatgtctttcaaagaccttttaatgatcttggaaaataatagcttttaatgatcttggaacataatgatcttggaaaatgatattggaaaatagttttaatgatcttggaaaatatgataattgttcatgttaaaattatgtctttcaaagagcttttaatgatcttggaaaatagctactaatcttggaaaatacttggatgtagtataaaatgaaaaaaggaagataatctttgtgtacaagtaataatacgaacaaccttaaaacacaattatgcctatagacacacacacacacacacatacacacagaaagaggaaaacaatctagaagaaaactattgtgaggaaatcttgccaggacaaggagtgatattagtttcattttactttttagacttttctataatttctgaaatttttataagtgtcattggttttctaattctcccaaagaatatatcagagccaacatgaaaatatcacaatgagtcaggaattttgtgaattctttaaaaagggattagttgattatccttctaattaaggtaaaactttgtttctgatatctgcataaaattaattatttcacatgcttattcaccaagttcattatgcataaaacaaaattaaacaaacaaaaacgactccatgaagtagtactgaatataatgaatatcctgaattctaaaactcaatgaaaaaagaactacttgattcattgcttaaataattataaaaatgaaattcaagaaataatttgggaagatttgagtactaataaaaagaggtaatagttcagcaaattgaagacaacagaatgaattaacactgttggaaaaaaatttgccttcagacagcaaatatttccacttttccgcagagaccatagtctttcatgccttatgcaatatagcctaaccaaatatttagataatctgggaattcaatttaatgaaacagcctcttttccagtacattattagtaatacattagttttcacagtgatttagcaaatttatctttctaattattttggttgaactaacgtcagcaccctgtagactgttcttggtgcaaaagaatatttcttccactcaggtctcagagtttggaaggatttagctagagattttaaatttgcactagttaatccatcccatgaatcattaacttagtataaaaaataaacagtggcttgggttaagcatagcaatttaaatattttgcagagattcaggaggaaatttaaaatggtcagtagttttgaaagaaataatagcgtactttgtcaagtattccagataagggaggtagatactatatgaataacatgctagttattactatatgaatattaaaataaaagcaataaaaataaaacgtaagcactagaggaataaaaaaatattgatgagctgctgatcactattactcataagaagcatggttttgtttgttttcttaaaatttggaccatcctctcatttttgatggatttttttttcccttaggttcaaaagcccactgaatgtttcataatgtaataaacattaaaaactagtaattatatgcattagattatctacagtaatgtcaattcattttttgtagacaagcatggtgcttagctattaaagaaaataaatgttagtggccaaatctccaatgtgtatatgcaaagctatctacatttaatattcactactgatgtttaaaatttcaggtttaacatggacattatttaccatgaaaatcataaaatgtagttatatttcactatgtgtttgttagaaccatatggaattgccatttttaaaaaatataaatgttgaacatggccaatttgatatgcatttacctaatacttagttctccccagatcttaaattcgtctttaggtacactacggattgtagaattaggcatactgaagacaacattttaaattttttaatgtgtaaacttaattgtataaagcttgaagttctttattagttcaagcttcatattttctgtggccctgctagacaagaatgagatgaaactctgccctgtgtgagactctatcaattttgttaataaatgattctgcaatttatttttcctgttaacactatacaggtgtgccaagcaagagatgtattgtactggttctagtctcagttcggtatcagaatgactagagcagcctggggagataataaagcttttgtattctccataaacccttctaacaacaagctggtgaatataagagaccccagcagacagccagtcaaatttaagcttctatacaaagacttcatctatagaagcttatgagcagcaacaactgaagagcagtctttgagatttgcgcatgtatctaacaaacatacttttcctaattccttttacaaaaattaaatcttagtagaaaaatatggtcactctttaacaaatttttaaaaattaaacaatttgatttacaatatgtttgcttctcttttctcctccttcctcctctcccattgccaccctttccctcccttttctttgtccttttcattttaatgtccaaggctattaaagaaactacatgattttccttactcttactttaaaaatggtgaaaaatttgcattgaattcaaagtttagccaccattgtggctgatgcccaactcttcttttcttctttactgtaagcattatcgtagcctgggcaaagaaatccacaggggctggcaaacaggctctttccaaaagagaatgtgtttataaacaagtgtttgtcctctctattcaacctttacctattcaaggaacaaaagctaactttattcatactttgctataatttttcctcttactatttttggtgaagggtaacaggaaaagtaagatttgaattttttcaagtagattgtatggtaacatttacattcattcatttattcattctaatcaacctcagttcctgaatctttgatgtctcttataggtgaaaggatttttaatgcacctgtgagccaatttttggtttctgaagaggaggaaggatgcagagtaaaaggaaatgtaaaagtgttgtacaccagctctcagtaaccttagaagatttatatgatgctgcaacaagaaaacaggctctgcaaaataatgtgctttgtgacaggtgtgaagacagaggtggggaaaaaaaaaaggaacagtacagtgctgtcataattgccaaggtattggaatgcaaataagaattcatcagatagaacccggaatagctcagcaaattcaagctgtgtgcatggagacccagggccatggggaacagatcagtcctcaagatagatgtaaaagctgcaacagaaagaagatagttttgggagaagacgattctagaaattcatattgacaaaagcatgaaagatggccagaaaataacatctcatgatgaaagagaccaaaaaccaggactggagccaggagatattatcattgcattagatcagaaggaccatgctgtttttacttgacaaagaaaagaccttttcatatgtatggatatacagctggttgtagtattgcatggcttctgaaaaccaatatccactcttgacaactgaaccatagtcatcatctctcatccaggtcaaactgtcaagcatggagccatcaagcatgtgttaaatgaaggcaggccaatttattgtagaccacatgaagagtcacttaatcattgaatttaaggtaaactttcttgataatggctttcccttttttgacaaactccttgctggaaaaactcctacaaaagagtaaagaagtagaagagactgatgagatgaatcaagtagaatttgtggactttgattcaaatcaggaaagatgatgctgatgccactacagtgcagaagcaaatgtgggaccattacaatggaaaagcatgaggatgataaacatcatttcagaggtgttcagtgtcaaacatcttaatgggaccagtgataatactcgctgctggcattttatgggcagtagtgaatgagcaaaggactgtaatcctaatatgctcactacttgctattgttttggttttactattcaactagagtagtgttttaaaaattaaaggaagaataaatacaatttttttaaaagttgacaaggatgagcatggccaacaaacctctctccactttggcaacaaatagttttaaatttggtttccagagtaagttaatagaaggtataacacagagaaccagaaatacaaagtgctctattagtgagatatcagaagtgattattgctgattattatctgatattttataaaacaatctcttttgagatattaaatatatactgagattcataaaacggtagatacctaaattatctcatttagtaaatcagtggggctatttaatccagataatttaaaccctaagaataattttattttccagtagattgacttttacttattttatttattttcttttacataaactcagagggaattacactttttaagaccatgtcatttaatatttccagttttaaagagaaatagagtatttggcataatgaatgcctattttactatttgtctttatgtcatatgtaatttttcctcttaaattttattttaaatgtgtttcaaagtccaataaagggaacactaatacagattgtaattgtatttcagtaatttaaacaattcattctataactgtgtaactttaagcatctttacacaaattatatatatggaaaggacaggttccttctttaagctttccagtagcatgtttggaaatattttccctacatggagcttaaacatgttatttgtggcatggaaacacctgagagatttctttggttcacaacactcaggatacaggggacatgatcccagtaatgagctgtttactttgtataaacagaatgaatacaatactcataaatgtaaacaccctgcttactttcaggccagctggaattggagtgactgaataagacaaatgggcttaggtttaacatctttatttttaaaccctttctaagagtaattatgcccttgtacatgctgtataacctttatttctaaccacaatgggacttatttctccatcagttttaccactgttttggactaaattcctctatttgcttatttatttacaattcattgtcttttttctgttccactctactagaatcccaaacctccacttacctctgttgctagagataagttatgcgtatcagcacactctgacaaaattactcttaagctaggattttgaccttagacttatgtgctattctaccttggtaaagctcaagaatacacacacacacacacacacacacacacacacacactcactcacatttgattacattaaaatacacctaaattccatgcttcattaatcattttccatgaattttatattaatcctgtacattaatgagagcttttaacaatttccttttctactgttgaaacttcagtcttctatttaacccatttttggacctttgatccatgtcaagatagcctgtgaagactgttgaactgtttggcaagatctcccaagcagtggtttacaaattgtgtggcttcactactattaggctgttcaattaattcaatgggctatgaacagatttataattgaaatggaagagaataaaatacatcagattgaactttataatttttatgttacactgcaaatgaaaaacttgcaaaattttcagtgtttgtatgaatgtgtatgtatatgcttgtggtaaatatattacttttattacttactctggtttttatttgaaaagttttaaagcctagagcaggatttctcatgcaagagttaccaaataatccatttaaaacataggtaataataataataataataataataataataataaaagtatgcatagtatttgcttatatcgatttatgtaataaaatatacacgtacaaagatatgcaacaataatttataaagattaggaataaatttattattcattttactttacgtagtaaaaatgccagaaagttccagttaaataatacaatttaaataacattaacatggcacatgcacctgctttcctgaatttaaactgaccaggttgtgtttaataatatgaagctgtattagcaccttttaattttcagttgctattgattttatcttttaatattaagaatgttgtgtcgtccttgaatcactgtgaaagtcattcagttattatgcacatttgccatggcacttgttactaaaaactgcagtaagctgatacgttctaagagtggacacagttcgtgcactcacaatttgaacatgatatttactgcagttgtgcaggacgtttttatttttcaatttagcatgcttacacacttttttttttttttttttttttttgagacggagtcttgctctgtcacccaggctgaagtgcagtggcgcgatctcggctcactgcaaactccgcctctccggttcacgccattctcctgcctcagcctccccagtagctgggactacaggcgccggccaccacgcccggctgattttttgtatttttttttttttttttttttttagtagagacggggtttcaccgtggtctcgatctcctgaccttgtgatccgcccgcctcggcctcctgcttatacactcttaacccatacaatatttccattctctgatctcttttctatctgaactgatgcataacttttgttttatatcattccttggcttcatttgactctcactcagaacaaatgcagtagaaaacaacaagtaattgcaaacaacaaaattcttaggagaaaagatgctcacaaaatgatccagaacacgagtggattaattccctttgcgcttatctttgaaatacagaacacaaaacttaacatctgtcatagaaccttccagaatgtattcatagagcttaggatgtccataagtgctaatgtggaaatcctgatctagataatttctccacattttgtaactgcaggtgtgtgtgtgtttcatatgtaccaactacctgtagaaaagtaatctgtgataagaaaaatattgaaagaaatcaaatgtttatgcaggaattatacatattcaaaattaatactatctctatgctaaaaataaataaatgcctataaaatattttaaaatagataccattactaacacaagacagcaattatactgtacttataacaaaatattctttctaaaacttactagaattccgacaattctagtatgtatacaatgagctttgtaaaatggttaagttttacatggcaggagaacactaaattgcaatgctaagtgaacgctactccctaattttaggttgtgaatgccaaattataatgatctctatttactctcttgagaagttactagtatagccctcaagtgaacataagagtgaaaaacagtgtaaattaatggtactagagtgcatattttttaaaaatcagtttgcaaccacaagaattcatgtgggtaatgaaccatacattatgaaacatggcactaaatgtttaaatataatattagaaacagctatgatttaccaacttttagaaaagtaaataacattgttctacattaaaatatgaaataaatctaggtttgatttaatctgggatacattgctgaggatattgattaacataatccaagtaactcatgtgatgcaaagtggaaaataatgatttctagagtaaacagaacttttaagattattattagaaatacagtttgtaagatcacaaacaaaaacacttcctttttctaaggcaactttccaaaatttcttataagtcatataaacaattaatatgttttgactgaggattgactcttagcttgaggtaccatgtgtctgaaggcaatttttattatattctccttctagacatttattttatttatttgaattgggataagaaaaatttttaaaagaaataattcacccttccttaatatttacctacaatagaattatccatagcttactgaaaaaaagtgttttggagaagttatctcatattttcagttttagaaggatgagtttaaaaaactgattatttttgagcaatcattatatagaatataatattgagtggaatatctgagttgggtaatataatctccttttgactgatcaggaaactgtggttatgtagtaaggttgagcaactcacccaacatcatataactagtaagtggcagattgaggatttagtttctgatggattccaaacgcatacagctttatcgtgaagtgtatcaaaactttgaaattatagtgggtggttaaacataactgtaaatggtgttcagacctgacttctccatgtttaaggggttctatttaatcttgagcagtttggggaactaatttatatcagcaagtatgcatttcccataaaataaaaaatagaattgaggccgggcatggtcgctcatgcctgtaattccagcactttgagaggccaaggtgggtggattacttggggccaagagtttgagaccagcctggccaacatggtgaaaccctgtctctactaaaaatacaaaaattagtcaggcatcgtgacatgtgcctgtagtcccagctactcaggaggctgaggcatgagaatcacttgagtctgggaggcagaggctgcagtgagccaagatcatgctactgcactccagcctgagtgacagagcaagactgtgtctcaaaaacaaacaaacaaacaaaaaaaacagaattgaatgacagcagtacaaaatcttgaacatgtatttaattcacttattcagcaattcattcattcattatgcaggtggcatgcagtacacagaaaaaaagcaattatatgaagtatttattgttgtgtaacaaagtaccccaaaacttattttctttaaacaacaaacattgattatctcacagtttccgtgccaggaatctgggtacagctcagctgggaggctctacctcaaggtctctcacaagtccacagtcaagactggagttgtgatcatatctgaaggttcaaattggggacgatcggcttttaaactcaatcacatggttattgctagaattcagttctccactgattgttggactgaggtgtcatttttttcactggctattggccagaggctgcccttagtttctggctatgtaggcctctccctagggaagctcacaacatgatagcttgtttccctcctggcaaacaaaagggagaataagagcagatgaaagagggagaggaggggcaagactgtagcaaaagtgtctttgaaactaatatttaaggcataattttatcacttttgcatattctattcataaaagggagttactaggtggacccccacactcaagcaggtaggattccacaaggacataaatacaaggaatttgggagatagtgtagaaattgcctaccatagcaattaacatgtgttagttgctggtaaacgtttgacatttgaattgcataacttttatatcataaattcaatctataggaatttcctcgcaaaaataactagaaagacaaaaaattctaaacattcttatgtaagaataatttgaattgtaaaaaaatacaaaactgtttgaactttcaataaaaatggaatgaataaatacatttaaaaatttaatatgtaaataaataatttaaactggaaaatttatattttttaatttaacatttaacacataagttacttatttagcttcattctttgttttaatgtcagctctttgttctaatgttagcttcttgtaatgttatttctttgttctaattttaacttcttaaggaacccttttctgtcatattattaccctagaattataggtaaggtagtggaagttgaattgtcacaagaaattacaagatcttcacttgaaatattataggatattcccttattctgcctaattacttttcctatcacttatcatagcctgacattatattaatagtactcatgagtttatttatatgtttgatgtttcccactagaatgcaaattctagaatggcaggaagtttgtttgctttgttcatttctgtggttcaatcatccagacaagtccatgaacacagacttgaaaaatattctgaaatttttctgaagaaatgaatgaaatctatggatagactcgtatgagaacacagaagaaaggtagttaatgagcctgcaagcccttggcatgtttgattaacaaagttttcccagaggaagtaatatttgagctaaaatgagatggaataagggaaagggaaggcttccctgaagcaatagagatatcaatctgtacatatatttgatctcatatgacagctcatgatctggcatagagaaggcattcagtggtttgaaaattggctattggagataaagagagacaagctaatttagtgtaaaggcaagaaagtgtttggcctggacaaatcatggggtcagagctaaaaagtgaaagaagtgaatctaggaaggagctgataaagtagaaaaaaaatggtagagttagtggattggaaagctaaataaagtaaagaaaatatatgaaagagttgaatttgggatatgatattatgattgagatgtaaaggatatttgaggtggcaaggccagaataagacatgaaaatgggtggctaaagtggattggggataaaggttaatggcatctattttgagaacatcctaaaatattaactttacagatttactgcaaatttagaaattcctttcagaagcgggtgcctatatttaaataaattgttaaacctgttcaaaagtaaagtgaaatgcaataattggttatgatatttttggattctctatgacctttctatttatctttaatcatattcctagtaataagtcaatttcaataatataatttattattgttcctcagagcctactatatggtatgagagttacaaagaaaaatgagatttcctcacttaacaaactggttaagactactactggctaagaccagcacccctgctggttttctaagaagtttacattctaagaagtttacattgtttgggacatgcaaaataaacagctgtcatactgttggaagaaccagggaagacttcagaaaaattgtatttgagtgggtcttgaagaatacatagaattttatcaatcatataggacaaagtagaatttcagatggagacaaaaacctaagagaaaatagtggagacaatcaaatgagacaagcatttgagaaacaatgagtactgtacatgggacatggaatgtccttacatatgggtatagagatttagagctggaacggtgatatagagaataaggctacaggaataagagtcgggacttaaatgagtctgaaagttttcaagatgacaggggacactgtcagcaaaacgtaaaatggaaaaggaagtagattagatgcagaaataccaactaggaggctatcgaaaaagtccagcaaggactaataagagcctgaactagaataaaggaagtatgagtggggaagaatgtggacatgagaaatatatggtgatttacagacctgacagataattgactatggggcaattgcaaaggatggtgttaaagatgacgactaaatttcaactgggagaacagtggtacttcaatagaaacaggagagtcagtggaaaagtaataggtataataaattgatattttctgatttgatttaaatgctacaggtaaatcaaagtggagaggtaaaacattcaatttaaattttgagctacaaattcagaagtgaggtcataataagaatttcatattcaagaatcatctgcgtggagatgagataaaaaaacttcagaatgaatgaaattattagagagcaacagggttaaaaatagaacttgtctctgatgagagatattactattgaaaggtgaaaggaggaaggggaaatagaactagatatagaaaaggaataaatttccaaatagctatgaaaaaaagagaagtaaatgatgactgtatgacgtggaagccaaatagggagggagtgcaagaaggagggcatggttggtgaaggacaaccatagttaggagagaataatttcaaaacaatattcaaaagatctattcgatagaataagtccacactgaatcctgattataatggttaaatttgagaagtaagtacttctgagaaagtggtgacatcaagatatgatctatttccataagcttggcagcaagacagggggacagatggtgtggaagcttggaatagtagcatcacagagaggaaatgaagaaattgagcatgtttgccacccaaaagggaaggaactaagtagtagagagggagacattaaagatggaaatgaaactaagaggaactaggaaatttagaataatcaagggaccaaaactacacattaaaagagaaatgtttataagaaagatggtctcagtcaggtgtacaaagaaaagaagtggaagttctgtaaataattgatatgttaaacaaacaccacttggttggttctaactgcagtaatcaatttaaaaatagctactatttgtttaggggttactattttccaggaactgtgcttaacagcgtacgtatactatctcatttaatctttccaacagctccatggagtatgtactataaatacccccattttaaatgtaggaaattgtatcattagagaatgtaacttattcaaggctgtctgtgagagttatatctgtgaatcaaactaagactggctcccaagcccatactcttgaccaccttgctgggtgagtggattgaaatatgaagaatcaccactgtatgaaggataaaagggatttttccagcagcagtggaaatccacttgacagcttggctttctaatgtgttgtatttagtgtggttttgtgagtacttccagaatgtgataacaaagatagtagataatttcatgacttggaaacaagcattatagaagggcagggaaaagaaaatttcaaggtgagagttgtcatatgttttaaatgactgacactggagtccagtctgaatggaacagaagggaagcccaaagagagtggctaattgaaagcacagggcataagcaagggcctgggcaacacaagaacaaagacaattgttaggtagaagagaataaagaactgtattagagaggagtttaattctttcaaaagtatttatatgtcaaactgatgacactaggataagcttaggatattcaaaggttaattagacatagttctgcctgagagaaagatttaataccaaggaaaatgagtggaaattggggttgctgcagtcatggagctaaggaactgaagccacagataggcagaaattttagtccgtgcatgatgttaactgttgagtttgtaaggcttataatattgactttagtaaggttgtatgctatatagtttttattgcttttgctattttatactttgtttatgattagtgacacttaagaactgcttgtttacagattctgctaaaatctatgtttcctgcatgtcctatcaaagaaaaacaatccttgaaaccattttgtaaaaatacagctttatatatttcaatgcacgtccttcttaaggaaatttggtatctgaaaaactgaaacaaaacattgtgatattttaagcagaaacaaagatttttttaccattataatacttatacatggcaatacattatttttagttattatttttaaatgactgattacaataaggaaatatgattgtgtttgatttattaatatgatactggacacctctaaatttattaacaaagtaatttttattacttttttattcagagtgctttggatacaggaacaaagtatccctttatttcaacaaaaccaaactttttcaaaccttgccttttccataacaactattatttactagagaatatgggcaattgtagggaattttttgttgactcagtcatccttatagtttgccaagttatagttctttatattgaatagcccacaataacgcactttcttgaagaaactgtttaagatcatcaaaaaataaatggaagaagttaaaagaaaatgttcttgaatgattgaagatgggagaggatatggtcagggtaaattggaacagaactccaaaactaatcatgtcaggcaggaggaaaaaatatcttgactttattttaggaacgagtcagaagttatttgtaacatttagtagggtggaggaagagagagaagttccatttttcatttctgaagatgcagctgctagtgctagcctgacgcatggtccataattctacagaaagagtggatgagaatgagtttgtcaatacctaacttttaagtaacttggagtatattgtttatcctttaatatgtggagggaagctaaatctgtttcaacacatgaataagtggttgataaatacatgaaaactgcaatacacaaagctgtgaacagaattgcaaaaagctggtggccagcaatacaattcaatgatgacaaatgactgttttccaaagagattttcttcctggaaggtgaaaactgatggcaaacaaatcaaggcaataactttctccctatcactgagaataactcttacaattatgaaaaacagccatccagaaaacataaaatgctgagatgaattctcctcccacctgtttacctctactccccacagtcacagcaaaaccaatgcccagctaatgtctcagataactccctttcagcatgtggtagacagacaaaactggtaatctttgggcacaatagaaggtagaaagtggtaaggcctgaggagttatttgtcaaaaattattgctctagggtaagataaaacgaacctttccaaaatttctaaaagaaggttttggtagtgaggttgtggcaacaaaggatttgatagatgtgtactcatcagaacatatattttgtatattttttagtttttgtttttcattagtaagtcttcaatcagctactcttacttctgtgtacattcttggacagtcaataccatgcctctttccatattgcaaaactctaatgtaactgtgcaagaaaacacctcccccagttttgaagcagtgagagtaatgtgaagacacggaaacattcattggattgcaattgactcaatgaaacttcctgaaacatcaaaatctcattaaaagcagctattgaataaaaatatcacttaagatacactcaatgatggagtcaggccaaatgtaatttaatactctgtatccagactgggtgtgagaaactgttaactcatcctggtgctatattgccaaaagagttgttctactttagatctatttacttcttggagaaagcctgcaatttgctctgtaagggttccactgtaaatttaaggaagttgtaaagtaaatttctcagtggggagtgctcatcaagctaacagccagtttccagggaataaataaagcctctgaaattgagatgacatcacaaggggaaggcgctttaaacattgtgaacactggctttcagaattgtgattggtcattaatgcctgaaatcacagctgcagtcagtgttttcaaggcagagttactggcagcagcaaggatctatgaaaacacacaccgattggcccaaatttacctttaaagttgaaagaataactcaaaacccaaaagaatctgcctctgacttgaagcagagaaccacaattctcagcaatgcaaccaggaaatgatctactcttattgtattaactttgtatgggcttcttttctctttactatctggttaaatcactagcaatcagtgaagatgagggaaaactcattttctcacatctcttcccttttttaagaaaagctgtaatagggctgaatttcgaatgatttctttttgaggagccaggagagaaatagctatccttttctccacaaactgaagatgtttccttgactaataaatcaattccatagaaaccagagtctagagtcttggagaaatgccttttatagctccagttttttttttaatgtttgatgatactttactctgatttcttatatcatcactaaattattgaattggaacaaacatctgtttacaaatgacacagacctaagtttaattttatgcctagacacagtgagaaaattcaaatatctgaataaaaatggtatgtctcaatattttcagctgtgcattgcctcttaagtattctcatattttatttcatatcttttatgttaccaaagagattatcttagaaataatttattttaatgccctcattgtacatgtaagaaaactatggcccaatgaagttaaactgatttccatgattagaaagataaatggtcaaggacttaagttcctttgattttagcttagtaatcttttcataattataagtaagttctgtcatatttgaaaacaaaacaataaaaccatggaagaacctaagattttccagtgcccacaaatgtagagcaagtatcactcttttatcctaagcaacggcagtctgtagatgaagattacacagtcttgacaaaagctaaaatgaaatggaaaactactacaatcatttggaaatctgacagctagactcattcagtggactatcatcatcagtgaccagattttatacatacatgtatgaatcattcacatacaagcatttcaaatatgacacacatgaatacatatatgcacacatacacaaacatgcatgcatacatatgtatatgttactctcaaactaagctaggagaagtctttgattaggataataaaccattatttgtcgtatttacattttgtatttttcataagcacttaattttgaaattaaaatgtttaattttctaactgttctctgtgacaataaaaaaagattaaaattgagctacaagataaatgtgactatatgacatgtgctcttagaccaggtttccattacaatagcaatgaaagattttagcatttttttgccatgggattcaaataaaatcataaacttaatgagatatttggataatcatttacatgcagtaaaaggaattttaagttttcatctctgtagagaatatgtttaaaatacacaacccacatatacaaacatcaatcactcatcaattattgggactatttatatacaaaaccattttgatgacaatgccattctctgctctggaagagccaggtggtattaaatgcagacaatgggatactggtttcaaaactctgcctcactcctgctgacagcttgaccttacttgatcttatctgtgcaggctatagagaaaaataaccaggacactctgactttgatagctgtttctgtgatgctaattagcagaattgcagaagcgacccaggacaccaggtagggatagcaaagaggggacggagatgatgtcagagtatgttccaaattgtacatttgtaaatattcattttaaagttttcaacattacatgtcattagcattactgcaatgccaaagctcttttgaatactgtctgctctaaggctaacttgtaatgaagagacaaaagtcgctaatcagtctgggatatttcgtggttacctactttgagttcagaagattcttttttgcaaaaggcgaaaggtacttggattatttagaaagctctatttcccttaaaataatcactcagacacttggaagtaatagtaaaaaacgtataattttttccagttcaaattaaattgtctacatacctattagcctctactcacgtattattatctatatgcatccccaaaatatgttaattgtgaaaaatgttaaatggagatataatagttaatatttgtgaatctatttagcattttttcctcactaaatatgtagatacaattcaaattgtaacaaatacactttatttttacattgtgttttatgtgttactaatggatctgcctccataatttcgtttaatgatagcacatgcctgaggaaaaaactttttatccttattttacagatgtgagaaatgagtcataggcaatttaagtgatttgaccagtaaaatgggataacatcttagtaagaggaattaaatcctttctcaacagccatattgttcttgattatgccatatgtcaatagcagaaaaaatgtctatatctaaaagaacaaaggcaaagcattatgaggaacagtccaaaccaaattagtaaacagtgagggagagtaaattatatgtgctaaaagctcttgaaatttcacaccttttattggaaaggtgtagacggaaaaactaggcagaccaggtggttctcaatggagcaattctgcgcacatagatgcattttgaatatttgtaggagtgtttctggttgtcacaatgaggcataacaaaaccacagcctggaatagaagtgggttaagtggtgaccccctaaaagatatgtacatgtcctagaccctggaaccttatttggaaaaaggatctgtggagatgtaattaagtgaaagatcttgaaatgaaatgatcctggattatccagatgggccctaaatccagtgataaatgttcatataagagatatatagaaggaggcagccacacagagaagaggaggagccagtgtgacccaaagcagagattagagtgattctgccacaagccgaggaatgcctggagccaccagaaagctggaagagccaaaaaataaagtttcccctacagggtttagaggccatactgtcccctggattgcagacttttggttccagaactataaaagaataaatttctgttattttaacccactaagcttgtgataatttgttacagtagtcacaggaagtgaacatacaggtatatcccaccttcatatttttgtgtccccccttcactttgcttaccttctttctttagctgttgctatgaatttcctgtctccactcagttatacaatacatttctcactctgccctggggcttctctgctgccacttggacatctctgagaaaccactcagctcagtcattctgatggccttgagtggctaacacacacagaggccacaggtattgcagatctaaggactgcctcagatagaaaaaacaaaaaatctcctgaattcctcaagacattcaaatgctttaggagacattcacatgagcaaaaactctatttgtaattatttgattctataaataacattttttgtacaaatgaaaagtatttgggcaggcttataatagacactgagttttccatgaatatattcatcatgtaaattgggggaagatagattatattctgtttgggctggaacttaactaagaccagttcactattttaaaaaccgtctatgaacaaatttagtgtgttttgttagcaacaatatgcaaattacccataccacacacttgattaatcttcatttgaaactctcacatttatggtcattctgcatataagtgtgagcatctaattacttaattatatcttttaaatattgaagtgcttattattccattataattacttgtcatatgtctcaattatattacagttagatagttatactgagtttttaaattttgatgctggtaagttatgttattttgagtgtaggctggcaggtttatttatttattttctgaaataattgcttttggggacattaaaaatgtttgtaattaaaagggtgtatactggtttgaagaatattaagatttcctgagctaaaacgctatctttcaaggcagacttggtgtccaggtaaactatagactcatccaataatcttcaaggtaccacataagcatagccagaacacatctcatcttgctttataatattaaggttatttttcctcctcctcacctttcccctccattctcctcctcctgctttcctccttctgcttcttcatatcccttgtctcagagaagcttcagctttacagttaaataatcctcttcatcatcacaagatgtttatcgagtatctatcatgttaaaaagcacattctcgaccgggcgcggtcgctcacgcctgtaatcccagcactttgggaggccgaggcgggcggatcacaaggtcaggagatcgagaccattctggctaacacgctgaaaccccgtctccactaaaaatacaaaaaattagccgggcgtggtagcgggcgcctgtaatcccagctgctcaggaggctgaggccagagaatggcgtgaacccgggaggcggagcttgcagtgagccgagatcacgccactgcactccagcctgggcgacagagcgagactccgtctcaactgaaaaaaaaaaaaaagaaagaagaaaaaaagtacattctaaatagactaaagagtataaattcagacttctgtcctcaaaagcttatcaacatgaactgaaaaatatatgcggtatacataaaatatacttaaaatcatgattagctgtgtcaatttcctggctttcttctccagttgatattttgcatgtctttttatgtttttccttggcagtacttgcttagattataacgtcctgaggggttgggatcctatttaaataattctctttgtacagatcctaaaatagcacaatgaagaattagtactttaaaattctttttgatgagggagtgaagctatgcctaaatccctgatagaaatcactactatttccagattacataacagctatatttaaagcttctgaaatagagccattggtaagaactaagattcagtaattcttttgggaaactgcatttttttttagtcacaatccagagaggatattcactcaatagagttattagagttatttagcattgtaatgttaaaatatttgaaaggaaaacggcacaatggcatagtgactcaatggtaatattttatgaatttcgttattatttcatgcatagctactctgtgagtaaagccatcataaatctagtcattgaattactaaggagctcagtggtaccctttgaacaaaatggaagcaaatatctggtagggcaaaggcataatcttccataacttaagataaatatggttatatttggaaaaggacaatagaaaataggaaggaagggtagcagaatattaaaatgagatttttaacttacacagaaaaagtaatgagaatttaaaatggagagtcaataccagaaaagcaacattcaaatttagactctgagttgaggccccattgcaaattcagtggtgaggtaaaatagataaatgactgaaacctcatgggccccttacttgattttagaaagtaagaaagggacttactttaaagattgtgatgacatggctacctattataataataatactctaatacagtggaggaaaataagtgaaattaacatactctgggtctctactttcacaagttacccaagtttaacctcgcaacagtccccaagatagtcagaaagacaacaaataccagttgagacagcaatgagctttacacatacagttaatgttttaaggggctaatacatgcacaacaaaaatgtaatttcccaattctcagagaggaggaaatccaggctaaaccagactaagaagctaccaccaaaccaccagtttgtaaattgaagaaggaagattattaatttgaatacaggcatttatatgagtcttcacactaccttaaacttacaagattgcaaattacttctttgaactttctcccatatcttgaatctccaaccttatttaagtaggtaattgtgaaaggagtttatttaatagttcaagttgctttgttattttcatatggagtacgtaagttattaatattaaaaatatcacaagtagtgaagctttggcagtgaggcatgacaggtcctcagccaggagaagaagggggtttatcgagcatctctgagctctgtctgacatgcccttggcccacatgcttattctcggcaatgagctgtgctggtataacctgacagcactttttcttggctctatcaatcacatgccttttcgggtttctgtgcttaggccttctctactgctatcttttggaatacctgtgggaacccaagcagacatttgaattcacgtatgtgcaaagctgaaagtgcaaggagtttaacactttaaatctcaactaataggagatctgggccagaggataaatactccccttttaatcattttatgtaagcagtctgaggtgcattcaacatggcttctctgaaggtcatcagcaataactccatttgccatccatggaatctttacaacaaccctatgagataaattccgtatctctgtttttaaaatgacaaaactgaagtttagagatgtagagcaaaattccaaaagtcacgcaattttttaatgaagaacatgaggtttgaactacacttattcacagcagaaatgctaaggggatataagacagaggttgagaaagctgcagagacgcctacagggagagaaagagaatcatacgattgaggtacttcaaatacgacgtcttccaatttggaatgatttggagaatatctagatgatgccttctacctacaatctcttatgatattatctaaatttcctccattagatatttgttaggtcttcaagatctgttcaaatgaaaataccttttggaaaaattgctataaatttaatggtaaaaagggctagttgtcagctgtttgagagcaatagctttgaaagagtataatccagtcctaggatataaaaaacacagggaaggaagtgaaattaaaagaggtaaaggagctacaaagtcaaatttcacttttatttattttctttaaggtttgtcctactagtaactataaggaatatgaaatttcaaagcaaaaaaagattaattagtaggaaaccctttttatttaaaaagtcttgaaagtgtgtaaggagcaaagcaatttctaaagcagtgctccatgtttagctttctaagtttagttaggatataaagaaataattatacatctgacttagtcataattgcaccatcttccctctcatgaaaggctacagattatgtaactgcagctattgattttccacatcagacattttaattgaaaggttaagatgaaactggatcagcaaagtttgaggttactaattctgcattaaataatttgggacttgaacgccctcaacagacaagaggctaagaatgttataagaaacattgcacttcttggaaaaggagtattactattaccagttaacagaaaatatttaaagcttggactgaaataaaagacatgaacttcaaataaccttagcttatgagtgggaacgttctgccattattggatttgctgattgtgatatagactactactcaaagcctacttccactttagaactgacatcatttttattgacattgatgttaacatttgaggtatttaagtaaagaagataatgtcagaatgatcatttagtaactattgccatccagaggctgagttcaaaccttaatcctaaaagccctacagaaaaaaaaaaaaaatcaacactcactattcaactgtcaaaaagactgatatccctgaggccattaagtggcaatagtaagcaataacccccatcatcattaagactggaaatcatctaaaaatttatcaacagaaatacaatgatttaaatgcttcagaagaagaaatagattaggtaaattaatatgaaataaaagggactagggaagatcaatatgttactaaatctagaccttgctcagagaacccattgtaaaactccaaatatattacctgtatattgagctaattaatgctacacttgaggcacaaaactacaaattagacatgtaaaactaaatatttacaaggagactttcataaagaattttaattatttttgttaatattttctaagcatatccttcccttttcaggtatggggacatgcataattaattatataaaccttaaaatgtttattatatgttgtagtgaactaatatctaacagttcttagtcatcctgcaagtctgccctgacgacccatcatcatgaaggcattctggatccttctggataaactgaattgggttcccatctctttgctcctactgtgtactgcccacacccaatttcttagggcttaccacattgtttttgaaattgtctacttaaatatcagtctccgccagtaactgggagcataactgagggtggtaaccatgttttctacaacttgctaatactctgttgcctcagcattgctttttagatggctgtatacaacagtagttcttaaacaagtctgagtcccaaattcagagcttaacctgacttatttcccacctaaatttctcagtttttagaatactatttcaatattattaaattagctcattgctttggagtgatattgctgtgacctgtgccaacatagatgttacttctaatagtgctataatgctggaaattgttcaagagtgagaacatgatgaagtggggataagtgccagaaattaatgctgtgtaggtatagccaaaggtggcaaagcctgcatgcggctctttccagcctttaatctgttgtaatggtcaaaacaataaaagagttttcagtggtctgaaggaaaatcattgaagttaaatacatgcatactcatggagtccatctataaaaacatatttgacagaaagaagaggttgggaaatttctttgtagaatggtaatttaaatgcttgacagtttggctaatgtttgcattattcatcacttagtacttgatgaagatacttcactttttatcttgatttcattcctcacttgccctactaaagtatgtatatttcaagtaaagtcagcaaacattaacaatttcaagagctccaaaaattatatcggtaccaacactacataaagtaggttcatactaatgctacattgcacacattcagtgtacgcaatacaacattgcagaaaaagaaagtcaatttgatttttaagctgcaagatattacgctaatatcaaatttcatgtataattgggccattatgctcttaagatacagaaaatacctgaaattttttggagtgctttatttaaccagtgggaattattatttaaataatatacacttctgctttttaaaaacttgctataaataattgtacatttaatcctcttgggatttaatctgttaaaaaaaaaagcatgtttaaaacaagtaaagggcaccaataaataaagttgcattattttaagctaaatgaagtatcgtgctattgaaacaatgaagcactttatcttaaaattccttatttttaatagctagattctctgctcttgatgaaattaaacataatgataatcatttgatacagctaaaatacaatatctctcctctcttagtagaaatagttcaaaatttctagaaaataagttggcaaatattcaaaacacgaagaaattgatgaatgttaaaataaagtaataatcatctttgcaaggtagaatggtttcacgtcctatcgctggaaaccacacacagctgaggatattccaaccttggcatcctttcagaagttatttccatatacttgccaaatcactgggaagtttctattctgaaaatagatcattgtaatatccttagtaagaaggcccattgttgaattaatgccagatttatctgtgctgttaaaattattacccgtattagcacagctattaataatactaccctgtggttttcaaagagctttcatttgtactgcctcatttagttatttcagcaactctgcgaggtaaaaaggactagtattattatccccattgtatatatgggaaattgacacaaaaagaccgaattgacgctacaagttacacaatgggaaactgtgacttacagatcaggaatctttgtaatttaaaaagtagtggaaatatttattaaacatttgttatgggcagtcactttcatctcctaataatagttattgtgaattgtgtgttttctttgtgccagataatttaacaaaccctatctttaaaagttcaaactttcaaagacagatattatcattcccctctttcaggtgagaatgtagtagcccagtggtggcataataaattttaaattcaggtctgtctgacttccaagttcaaggtcttccctctgagatattacttcatttaaatcttacattatcactttgaagtaggtataatgtctctcctttttttttaatttttattttttaaacagacctggaaatgatctaagacagttaatgttacaagaaaagactggttgaagaatcagcattctggctggctgaattttcaatttttgtgattgttgacaatttttaaaaatatataattaaatttcctgccttactaggaagaatacaattagagcaactgtagtttttgttgaagatggtagcctttcaactgctaaggacagtattttaatctcactttgcaaaacatttgtgtaaatattgaaagcagcagatgggcttgaatctgtactgattgtcatatatgactgaatattctttttaaacataaatcattaatgtcaaagagtttttgtgattgtgagatctgggtaattggtgtattattatacccctactgtgagccagatactaagctatagcaaaggggatagacgtatgagcgaattaagcacatgaattagattttacaatactgagagcatcagagttctgaacaggataaaattagatatttaatatattttaggcttagtatgaggaaaaatgctgcactaagctataagcaatttaatatttaatcatagcataaagaaaccacaaacaggaaagcagtacaacagatttacattatttgttaaatataaaataatcatctggatatttttatttgaggctatttatgttatttatgatttaagagtacaatattctgttatgtgtgccaagaagaaggtcagaatattttagagttaagtcaagagttaagatcacagtgattattaatactgttcctaaattgcagtatcatctgttgtagtaacaatattgcaatgaaaggttgaaataaaatactgcatagtttatgtaaataagcacagattttgttttgtgtaataagcaaactgttttcagaaaacactattttaaatagacaaattgttgttagtgtttctttttgtaaacactgcaccaaaaataaaaataaaagccataaatatatggccatatatatatatattttgagactgagtcttgctctgttgcccaggcggaagtgcagtggtggcatccctgctcactgcaacctctgcctctcaggttcaagtcattcttctccctcagcctcctgagtagctgagataacaggcatgtgccaccacacccaactaatctttatatttttagtagagacagggtttcaccatgttggccaggctggtttcaaactcctgacctcaagtgatccacgcatctcagcctcccaaaatgctgggattatgggcatgagccacaacgtccagcccataaacactatattttataaatcacaatcattattgttgaagttttttaaaatattgaattatcttattacttttcccataattaaaaatatacaaatcctagaatgcaatcatagtacaaacttggagaaatcaaataatgtacttttcttctaatgttcagccattacagtggtattctcctgagcagaaaagagcacgtaatttataattattgaggttttcttttatttatgttgataaatgtatttattctggaaagaacattgattaaaaaaaaccacattttatcgttcttccctttgggagtttctttccacagacatctttataattactgttctggttttgacataatacttcaatactaattaagtcgtccaaagaaattcaacgatcatttattgaacaaccactataggcaaggtgctgtggagatctgtaaaaaataaagagatgaaggacatcacaacttgtcttcaaggagttaaatttcctgaggaatctagaacaaattcagcaattgccctaatatatagtgtgttagttctctatcgctcctgtaacaaattaccacaaatttagtgactaaaaagaacacaaattaatatcttaagttgttttggtcagaaggctgaaataggtatcgtggggctgaaatcaagctattgatgcatgagttccttctggaagctccaggaaagaattcacttccttgtcttttcagcttctagaggctgccttcatttcttggtttgtggctcccttccatcttcaaaaccagcaattgcatcactccaatctctgtttccaccatatgtctctcactctgactctccttcctcctttttttttttttaacttataaggtgcttttccattacattaatcccactcaaataatgcaggataacctctccatctcaaaatccttaacttagtcacagctgcaaagtttttttgtccatgtaaaataacatattcacgggttctggggatttgaatgtgtaaatatcttttattagaggtggcattcttctgcctatcacacttgtctaaactatggtgaagccataaataccttacattttagatgtaaacactgacatactcaaaaatccaatatttaagttgttttaacctattcatattaaaacatttaaatattaacagggaagatgataaggccaaaagtttatcatatgcaattaagtaagcaagaaaaatttcccatttcaggtttcaaaagaaataagcaaatctattgataatgcatagattaagtcttagtgaataaatttacatttgtatttttagttcactgttacatatcaaccacctaactgtactttaattttatttgaaaaatcttactatcagaaagcaaaaacaactggacagtagaacttaatttggttctacagaaatttcttgcgctgacttgtaaaacaatgaaatactagttttgaaaaaaataattattaaattatttcataaaaatctttaaatactttataaaatctttttatttcacatatccctctattatcccatttctctgttccttcttaaaacaaaatgacttgaaaaatttttttgaactttctatttccaattttttttctcattctacgtttaacctattttagtcatattttgctcccgttatacggaaacgtaattttagtgaaagtcaccagtgatcaccacactgctaaatcaaagatcaaatcccagtccttattttactggacctctcagtagcattcaaagcagatgattattctctttttgaacttctttcttaatttgacattcagaacctcaactctcttgattttcatactatttcaccattcagtcctcagccacatttacctctcttctttaaccccttaacccgcgatgatggggtgccccagggatcagccttcggatttttacttttctgtgtttcttctactcatcctaagtgagattatctagtcttggggattttactattatttgcatggtatttattcctaaaattttattttcagtctgtatctcttcctggagctccacagtcatttacctaaactccctatttaatatgtccagttggatctccaggagactcataaactcagcatatcctaaactgaatttattatttctgcccccttctcttacaggaacaaaacaaaattgcacaagtaatgttctctatctcagtaaatggcaactctattctggcagatgttcaggcctaaagcattgtaatttaccttgactcttttctgtctcttatatttcataaccaacctgtcagcaaatcctgccgattgtaaacctagttccagaatatgaaccttctcaccacattcattaccaccatttatctctcacttagattatttccctgatttcctaattggtctctctgtttgtgttgcttccctacattacattttcaaatacaatatgcagagtgattctttaaaaatctaagtcaaataatttacctgtgcacaaccttatacaattttcctgactcagtctgagtaaaatccaaagtcaggatagtggcctataaactcctgcattctctggttttctgttacctacctgagctcaactcacaggttttcacatgctctatctccttctggaatgttcttctctcccatgaaggcagggtatttgtctcctttatattttcagtttcagaaatagatgctggcacagtgaaggcactcagtgaatgtttgttaaataggtgaacatattttgtctaaaactaaatgtgaagtaaaatatgttcactacttttcctcttagaaaatctgatgacagcaaaaatgcagagggtttatttttcctgtttgtgtttagtacctgattccaaaggaatttataggctgaacaacagtatgtaaccagtgacttgcctgtatttttcaaattaaggattgacaagtgatagaggtattggggttaaataaatttctgcttctgccagagctcttgtatcagctgtcctcagagttgtctctggtgctttagtaaacaatagagacccattcccactgctttattcactgtcagtctggctgctgctaacagcaaccaggcaggtcctgcttttcgtttgtttgttttatatgtgtattgactttctcaaacatctgaaagctattacaatttgtctttgaatttttctcaaaagttttttctttgtgtttttattacttctactgttataagtacaatattctattaggttgtttgcatcattcaccttctgctgcccaccttctccataagcccaaatataaatgtcttgactacttttcctatttcactcagtattttaaagatgctcaatggtgagtggaaaatgtaatagttaataataattacaataaaatgtctggtaatctcttaattagatatataacaattaaattattagatagttgacaatctatttaagtttatacacacacacacacacacacacacacacacacaaatattcctttctttccaacctcttataaggctggtgattataatgatcccttgattcaagcaaggttcttacagcagaacaagagtaaaagagtcaaatccttgtctctgagatataaaatctaaagttcagccgcaaaagaaacatattttgaaaaacagaggctgctgcaagtattttcacctcctcccaacataaagctcttctgggctagaaagagaggaacttcagtcgggaggtatagttaaagctggtgtaggctccttgagaggaggagtggtgctagaatccttggagaagcttggcttgagtaaaaggcacttgggctcatttccatttgggaccagtgagtcagtaagtcttagagttctatcctcaactacagaggggtaaatcttttacctaagaaattttttttgtttgtttacaacaaaattttttgagcataataaatgcattaaaggtgctatctgatttatctctacaactctgtatgaactgatgagaaaactgaaattcagaaagtttaagaaacctgccaggctgggtgcagtggctcacgcctgtaatcccagcactttgggaggccaaggtgggcagatcacttaaagtcaggagttcaagaccaacctggccaacatgatgaaaccccaccactaccaaaaatacaaaaaattagccgggcatggtggcgggtgcctgtagtcccagctactcgggaggctgaggcagaagaatggcttgaacccgggagatggaggttgcagtgagcagagatagtgacactgcactccagcctgggtaatagagcgagactccatctcaaaaaaaaaagggaacctgcctaaaattgtaccacaagacacaagagagggtgtggtctccacagacagattgccttatgtgaaaccaactccatttcttgtgagttgtgtgccttgggaaagttacttagtgcttttgtgctttctttcttcatctttaatactaacaattatagctatttatatggttcttattattactaaattagttaatacatgtaaagcgctttagtttagtaagtgcttaataaatattggctcttaatttattatgcagcagagttaggagtataaccaagactcatctgactccaacctgtgctttgaacaccgtacatacaggcccatacatacagctgatctcattattataaggactggagaggaatgggatgcagttgaccttcaaaaatagcatctccctgattctagctaagcagggctaattgaggcccaagctgacaggtcagatgtttctttcataaggatgttcctctgtttgactttgcctcctcatttcttcatccttcctatggattaagccatttagaaccaattattcctatgaatacccgtcagaaatctcttgtatttgtgttctctgaagtaagaatgattaaaattataataaaaactctcccactctaccctaaaatgtgttgtaacctggaacacctaaaaatgtgttgttaaccagaatattttccctcagaggtatcacaatgtgcctatgaatatgtaaacttgccttttaaatcaatagctgtgaaaatgtgaagaatatcttgtgaaattaaatggaagtaattgctaacatatttagagtttatgatgaggggagtactgtactaagcagctgacatccaataattcatttaattctatggaagctctataaagcagttgctataatttctcccaatataaagataaaagagtgactcagttttagctcaaacaagcaaagtcatagcatctgagtgttatccaggcagtctgactacagggccctatggcttaaccatgaacctcagaaaattctgttcagacattttctggatgccaggtggtcttatccagcagacaatgccctttatttcataggcatatctctgtagagtgactgattttaacctgattgccccaatgcatgtaaattttaaaatttacacaaggatatattccttccggtgtgactattcctttgcttttgaatatttgctcccgaatataatataagatatggtagaatttataaatattttaagcttctcctgtggccttgtccttttaaatctgtgtatttataatttcaatccaattacttgtttttaacttacatttttgcactaaattctacaggggaatctaaaacacttcagcatttctgaattctgagcaacctgaaaatagggatgtctcaagttatattcttagcttcatcttgctagtggagtaattaaagcacgggtaaaatctgtttaaagtttaatgtaattagcaaagctttggggtaaagtcttactaaattctaacaaataaaatgtatatggattttttttttacttattcttaaaaggtgacaagaaaaattgagttatcagaaaatctaagtctctaaaacttctttacttatttttatcttctcaacttataattctcttgacagtttcttcaattttctaattcagtttatgtacatatgtgcagaacttagacagttacagttacagtggtttcccttcaataggttgggactgtgtttttttctaaaatattctatatcatttcttccatacatattttttaaaagtctctaatttacttttgtattttctccacttagaaatataactgtgataacagaaactttgaaaaaaataatagttgaggttaatgtattgaggattaaaatttctgatccacatttgaggcctgaatattgctttaagtgcagtaaaccattgttgagaactgaaaattattcccattagctaagaaaaaacagaggtaaaccacattaactttctctccacagtcttcagtgaaaatgctttcattgtgcatattttgcttagaaaatgaaccagcttcgttaaatttaaacatcaattgacacgattctatcaattttgcactgattatgaacacttttatagtgaattatttgcacaatagtggatacagagtgccactgtggccttttcagtacgtttgcatggaagccaataagcttactatcaaaaccagagtgaaattcacagttcttatggattttatttttattcttgattctaagaattcaagtatattacttttgtttcgacattgaatctgaactaacaaaggatgaaatgaagcaaaagtgaaatagagttgaaaataaatctaagcagagtaatgtgtgttcaacctatcactactaaagtttgaattctggaaaattaacccattgtattagatcccacttgcatgatataatattgtatatttttacaaaggatgtttgctttcttcattaattctcatttgtctttctgacaattctatgcaacactgtcattcccaataagcctagtgaaatatttccacttgcatcctccaagtcacacctaactggctgcttcttgggtctctcaatttaattcccataatggttaattttaaattcttttatttatttacttaaacactacagttctggaaatgcagtatctccaatcagatcaaagctcttcagtaacaggagaaaattattcaaaattcaatgaatgtttatttagttcttgagataggtcaaacaatgtagtaagaagctgaaaattcatagatgaataagctacccaagaatgttgaaggcaatttgtaagaaggactatagtgtggatgtgcacagagtgttgtggatcacaggggaatgaataaaatctagggctggaaagaggttaagagacatgaaataaaatacaaaacattcaatttatgtttaaattaatgagtagatgcatttctcatgaataaggaggaggaagagacagagaataagaccaggttatgggttttcataaaacatggcctgcttgggaaggagaatagaatagttgtatatggtcacagggtgccagagagggaatagtgggagataatgttagatagatggaaggcagtcagactgggaagggcctaaatatttgtcttttttttttctataatatttgtattttccttgtaggaaatggaaagacattgatctatattacattggcgttttttttaatgaaatatcactgtctttaagaagcagtatcatactctgcacttctaaattagatgccttcttatgtattcccagatttcatagtatgctgtacttagttctaccatagtactcatcatagttttgtaattgtgtatgtgagtgtgtgtgtgtgtgtgtctgtagtctattttaattttttatttaattaatttattcttacagacaggatcttgctctgtcacccaggctggagggcagtggcatcatcacagctcactgtaactttgagctcctgggctcaagaaattctcctgcttcagcctcttgagtagctaggactacaggaacgtgttaccactcccggctaattaattaattcttttttttttttggtagagaaggggtttctgtatgagtgcccaggctggtctcaaactcctcggttcaaggcatcctcctgtctcagccccacaaagtgctaagattacaggcatgggtcactgtgcctggcctatatctgtagtctatactaaactgcaggcttctgtaggacgttgacataccttattctcagttatatgctcattacctagcacttggcttagcccatggtggattcttagtaaatatttggtgaatatattaatcacatttttaagatgagaactctgacatgagtgtcaaggatgcagagaagtgagatgggataatcaaggaaagtgacaaagtatgaatttaaccctgagagattattctgaagtatatgtaatgaatatgctatgctttgttcattataaatagtccagtgtttgaagccttaggttaatttaactagatcattaaaatattagaattttctaactataggcttaagccaagtaagccgtattcaaccacattaaactattttgtcatatagcttatcttctttctttctacggcaacagagatggtactatggggatgatgatattgaatctatatctaatactgtagtctatatcacaggcaaaatcatatttacactatcttgtcttaactttgacagtatgattcagtatccaagccatttctacttatctaggctgccattatattcacgcaagcctttgatagatcaatggaacagggcagcctggtggagcaagaagaaccctgttttaagacagaagtctttaggaaaagtctccatcttgcaattaaactgtcttgtgactttggacaagttatcagagcctggagctaatgcttctggtttcaaattttagcagatataagtgaagtaaagtatacaaagtctctagtacaataactggcatagtggaatttttaggctcctccctggtcacctccctgagtttcttcacttactaaagtaggaggtttagtggcagtcatttctgatgtcatcatgagtgtatgattctattacgatgaattataaaactagttgtttacacttcacaatagggtagacaattgtctctcaaatatggcagaacatttaaaaggtgaaactgaacaaagttttctaacactggatttttaaaaggcttactatttttaatgcatttctaaaaaagaagtcccttactactagcattaccttctgggaaacaacagcaataaaaaaagaattggaagaataatacaatcgctttttcctatccataaatgaatgaatgatgcagcgcttctagaactgaaaagcatttgagagccatgcttagcttgaaatctttttagaattatttagccttatttctaaggaagagtcacttttattttttacatatgactacttccatcttttataaaaatagaagagactgaaaatgactgtcttctataaccctatgctgtaaaggcctagaggggattgagaaaagaagtaaaaactgcttgaaatggtttgatataaaatgtcatttttttctaaaatgattctgacttgtctttcgaatattttgaatgaaacagaaaagaactagcttcctattaatctagaatatagattttttatcattcttaaaaaaataatccattcaaacatttcttggcaatatggaggaagacttgtcacatcactcgaaattttctttaagaagccttgtctcataaagtcagtcaatctcttaagatttgaagaataatgattatctggtaagaagataatcaggttaaagctagcagcactatggaaaattttctttcttgagtctgaaaggactgtttggcttttctaaagcctaaggtcttgttcccaaacctccttactttaaagccaagttaatgaaatatattaactactatcacttagtcattatgctaaatattaacattttaataatatactgtttttgcaaaagcaagtatatatatatgtataattatacaatttttcacttttattatatttattttaaatatttaaagttttaatataatattctaaaaatattataaatattttttctatatataagaaaaagtggaaaaacacataccagactattggtggtggtagattcacagagaatatatggtacaggaagttttctttctatgctatatctcttgaatttttgataaaaacataaatatctttggtaattaggaaatatttcctaacaaaattagtagatgaacatatgaagagaatgatatgtcaaagagaaggtataaaccccattaagataggctctgtttctgtcttgttgaggattgtatttcacagtgcctgcctcacagaaggcacttaataaatattttttgaatgaatgaatcaaaacattaaagaagctgccgcaactaatttacaagctgtctttagagaccacatgaaatctttcttcatatgggaacatttgcattgttagactaggataatacatctttgaccactgccgtgggaatacatgccttggaaatactttcaggtgcaagtctttggaaatatagtcattcagcgagaaacaaacaaacaaaaagtgtgttcattatgtttgctagaatggctctttttgtaggattatagaggtttattgtgcatgacttaacacattttgaatttggcaagatctacaaaatgagagaaatagatcctgactccttcttatctacttgtgtcttcttttactaagagagtgttttactggcagtctacccagtaacactagcacagaattcatatttccttttactttcattcataagcacttttccactttctaacagagaacttgagaaaactcattaagtcttagaatttcactcattcctggtgaacaaaataaagtttcttccttcacagagattctaagggtgtgataaggggtaatattttccttagatatgtctacaacaactatagatgcagcagcaactactatgtcctgaagacctactatgtgtttggcactacatacactttctaatgtagtttttctaaaaaccttttaagttaggcatttttatattcatttttagagggtgaaactgaggctcagagatattaaatgtactcaaaagaggcttgtattaaaatgacttgcctgagactcaattctggtaggtctggatctaaggatgtttgatgctgtggctgttttgttttgcaactttcctataatccattgttcttacggcttcacttgagagctgccccttctatgtaaagagcatgcatagcctgggaaattctgatgaaaattagagtacaaccctgaaatgccagaacttggattgcactcaaactgtcacatgctttctagctatgataaatgggactgaactcattagtgatggatttctagcagcagcaattgcacaggtaaaacttcttaactaagcagatattcaatcattctggcactgtaaaatgtcataagtgctctcagtgtaatcatctttttgtttctttgctacatttggatgagtaaaatcaggaagcattagaatactgctaagtccttccaaaagtataggccaaatgcagaggtattttgggaaacccacttcttgtgtcatactaagctttcttggatcttgattatttaatgccaaaagtgctagttgaattacagtcttgtacacttgaatgcagaagagtaagtggactcagctcttggtggaagtatacctttatttcctttctccccactctggcagatcctcatctatctctatctctcgggctccaggagtttggcactttgccacccaattagctcctgagacagcataatgaaagttaatggacctccaattcaggtaattcacatgaattaaaaataacttaggaaagcatttagggccctataaaatcaaatttagaatactacatttagaggtcataatagtccagttcaaactttctgccacacaaaataaattaaatttatttgaaatatctaaaaattattaaagtcagagagaatagaatttttccaagtcttttgcaaaataaataatcccagtaatgttttcttgcttgattagttctaaatgttttaagatctgatttaaagattgcttacacattttaaagtacatgtagaaaagacttgtagcatataataaacttacataaattattttataatttctaaaattctataaaaattatggtccaatatagaatatagactatagaggaaaagggtagtatttgtgcagaaaccacataaattatatgatagatgaaagagaatgaaaagggaccttgaatttgctttagaagaggcataataaacttactgctggaaaccgtttaatcctttcctttgttacagattgagcttcacttaaaccaacccagagggactgctgaaatctcttcaggagctaaatttttcaattccacaaatatttattaaactaggcattatgaattcaaatatagaggtcagtaatgtgctgtcctatccttaagtaatctacagtttagttattagataaggcaagtactggcatcttacagtgcaaggaagaatataatagtggccataggcaaagcacaaaatactctgtgagtttttttgaaaggaaactaaatcatgttgaagtctgcatggtagagtgagaaaatataaaactgaggtttaaatatggtttttccaccttctaattttgggtcctaggaaattaaacttttggagctttagcttcttttgaataaaatgcacttcataagtgttttttacaagattttctcattatatgtttattaattcatgaagaagtatgtactgattgttaactgtttgcctggttctatagctgtacagtgtatagtatagttgggtagcaaaagtatggtaggtgctatgataaaatggatatgcagattatagcagggctttaaagaaaagtgtagtcactactactcaagggagatccagaatctcttgtagaggagctgccgttatgatctttcctttgcagatgagaaattgaaagctaagaacatttgaataattttacccagggtggacagttactaagtggctgagccaggagccagggctccagcatttttacatgaggcaatcaattctgtgttagctttgaaaaggattatcaaaataatgggacctaaaggaatcatttacatcaatgggaatgtgcatacctcaatatctcagagcattttaaagaaattgatattttgcctagcaattatttttaaaattaatggtgacatatactcactcatataactgttatgcaaagcaggcttttgaatagtatgtggaaatatttaagaagtcttctagtttcaggttactttcaaagagtttttgtttccaagccatctcaatggaagtaaaataaactgtctctgtagttcaataataagctctcatgacctcaccaaactcatatttttatcctatgtcaaggcactattcttttgtacaaatgcataaggccaaaaaattgtttttttctcattacttaggacattcatataaattaatcctctcaaaggggagaaatctatcttgtactttctcattcctccctgctttcccattgctcttgtagagggtgggaaataaatgctggtgacactttcccctgccatttgaaggcactgctatcccatggtatagctgctgaggaattgctagaattgatcttatagtaagtgactctcagtaagtgcctttgtcattgtcttcctccctttgcctccactgtggatgcaataatggttcatgtattactgcatgagcaatcacaaagagaatatacagcaaagtccaagttagtgtttacacagaaaatgagaatagggtgcccatagctatactgagcagatgcctgattattaatgggaagtgggagaagatagaaggctcctcatgctttccagaatccacaggtgttttgacttgtgtcaccaatatagctgtggggagctcatcaatatcatctcctaataataactggcaatccactggggtaacctgaattttccatcttacaggcacaagaatctttctgtagctttgtgggtagccagataaatggaatcaaaatacttatggcaatttatctttgacaaaaaggcaacagggcagcacatcacccgggacacactcatcttgttctcacatgatcaactaaaggtgacctacaataatgaaataattgtttattatagggcatgaatgtattaaataagttggagaatctcatggcaaaatatgcatggctctggattattttacttaagatgaagataaaaagtgtagagtgtgattttttccccctgctatactgtaaggctttattttttcttttgtggaaatactatattctctgtattgactaattgactagttgcagtggtttttaaactttagtgttcccaagaactttctggaatcatgtttaaattgaaattggtgggttcatcttcagatattctaattcagtaagattatagtgagacccaggagtaagcattttaaaagtggatttagactgagaaaagtattacataaaatgaatgactggatgcagccaggagaaatagctcctaccaatagaccacgacattgggaagacaggcacactatgagcagatcttcggaggaaaggcattgagggtggatagagggaggacatagacactgggctgaagggggaggaagctgggaaccctgcacagggctattgaacactgggactcattcctaaaccctggtgacactgtgggaagagaaacaaacccagtcaactgaatccaccttataccacagtgaaatccctaacggcatgacagaagataaaagcaaagcaaagcaaaacaaaacaaaacaaaaaacatggaaagaatagcaactccagagactgaaagaacatcaacccacacagatgacaaagaaccagcataataactctggtaactcaaaaatccagcgtgtcttgttatctccaaatgaccacactagttcaccagcaatggttcttaatatggctgaaatgacagaaatagaactcataatatggatagaaacaaagatcatcaacattcaagggaaagtcaaaacccaatccaaggaatctaaagaatgcaataaaacaatacaagaggccgggcatggtggctcacacctgtaatcccagcactctgggaggctgaggtgggcagatcacgaggtcaggagattgagaccatcccggctaacacgatgaaacccatctctactaaaaatacaaaaaattagccaggcattgtggcgggcacctgtagtcccagctacttgggaggctgaggcaggagaatggcatgaacccgggaggcggagcttgcagtgagctgagatcacgccactgcactccagcctgggtgacagagtgagactccatctcaaaaaaaaaaaaaaaaaaaaaaaaaaaagagaaaaaagatgaaatgggaattttgagaaagaaacaaactagtctgatagagctgaaaaactcacatcaataatttcagaatacgatcacaagtattaacagcagaatcaaccaaactgacgaaagaatctcagagctcaaaaactggttctctaaaataactcagttagacaaaaataaagaaaaatcaaacgaagaagaatgaaccaaacctccaagaaatatggaactatgtaacgagaccaaatcaatgattcattggcatccctgaaaaaaagggaaagaaagcaagcaacttagaaagcatatgataatattgtccatgaaaatgtcctcgacctcaatagagtagctaacattcaaatttagaaaatgcagagaacccttgtgaggtgttatagaagacaaccatctctaaggcacataatcaccagattctccaagatccaaatgaaagaaaaaatgttaaaggcagctagatagaaggggcaggtcacctacaaagggaaccccatcaggctaacagtggaactttcaacagaaaccctacaagcaagaagagactgggggcctatatacagcattcttaaagaaaaaaaaaatccgaagaagaattttgtatcaggccaaactaagctttataagcgaagaagaaataaaatccttttcagacaagcaaatgctaagggacttcattaacacctgacctgccttgcaggaggtccttaagggagtatttaatatggaaaggaaagaccattactgactgtgacaaaaatcacatgtaaatagattaactattgatactataaagcaatcatacaatcatgtctgcataataaccagttaaaaacataatgtcaggatcaaatctgcacatatgaatattaaccttgaatgcaaacaggctaaatgttccaattgaaagacatagaaaggctagttgtaaaaagaagcaagacccaatggtctgctgtcttcaagagacacatctctcatgtgatgatactcacagcctcaaataaagggtggagaaaaatctacaaagctaattaaaaaaattaaacaaaacaaagaacatgggttgctattctaacctcagaatagtctttaaaccaacaataatcagaaaaggcaaagaagggcattgcataattgtaaggggttcaattcaacaagaagagttggctatcctaaatatatgtgcacatatatacacacagcacccagattcataaagcaagttcttagagatctatgaagagactaagataactatagcataacagtgggaaatttaaacatcttactgaccatgttagacagatcatgaagttaaaaaactaacaaagatattcagaacctgaacttgacacttgaccaaataggcttaacagacatctacagactctacctaaaaacaacaaaatatacagtcttctcatctgcacatagcatatattctaaaatcaaccatgcattcagccataaaacagtcctcagtaaattaaaaaaaaacaaaatcacaccaaaacactttttgacctcaacacaataaaaacagaaatcaatactaagaaaaccactcaaactcatgcaattacagggaaattaaacaacatatacccgaatgactttggggtaaggaataaaattaaggcagaaatcaagaaattatttgaaactaatgagaccaaagatacaacataccagaatctctgagacactgctaaactggtattaagagggggagtttatggcattaaatgcccacataaaaaagttagaaagacctcaaattaacgacctaacatcacacctagaggaactagagaaacaagagcaaacccaccccaaaggtagcagaagacaagaaaaaaccaaaatcagagctgaactgaaggaggttgatcttttgtataaaaaaaaatacaagacatcaacgaatctaggagtttgttttttgaaagaataaataagattgatagaccactaactagactaatgaagaaaaaaaaagaagatcgaaataaatgcaaggagaaattacaaagggaacattactactgaacctagagaaataaaaaaaaaaatcatcagagactactgtgaacacctctatgcacacaactagaaaacctagaagcaacagataaatttaaggaaacatacaatctcccaagattgaatcaggaagaaattgaatccatgaactgaccaataatgagttccaaaattgaatcagtaataaaaagcctaccaatcagaaaaacacgagaatcagatggaatcatagctgaattccactagatgtataaagaagagctgctaccattcctactaaaactattccaagaaattgaggtatagggattcctccctaacttattttacaaggccagcatcatcctgataccaaaacctggcagagatgcaacacaaaaagaaaactacagggaagtattttttatgaacatagatgcaaaatttctcaacaaaaataccagcaaactgaatcaaacagcacatctaaaagcaaatctaccatgatcaggtagactttaaccctaggatacaagattaaacatacacaaatccataaatgtgattcatctcataaatagaatttaaaacaaaaaccacatgatcaccttaatagatggataaaaggctttcaataaaattcaacgtccctttgtgttaagaaccctcaacaaactaggcattaaaagaacatgcctcaaaataataagaaccatctatgacaaacccatagccaatatcattctgaatgggcaaaagctggaacattccccttaagaaatgaaataagataaggaggcccactctaaccactcctatacagcatagtactggaagtcctagccagggcaatcaggcaaaagaaaaatgtgaagtgcatcagagaaatagagaaactcaaactatctcagtttgcagatgatgattctctacttagtaaaccctatagtctttgccaacaagctcctacgtctgacaaacaacttcaacagtttcaggatacaaaatcaatgtacagaaatcagtagaatttctatacaccaacaatgtctaagctgagatccaaacgaaaaatgcaaccctcttacaatagccacaaaaagaataaaacacctaggactacagctaaccagggaaatgtaagatctacacaatgagaattacaaagccctgctcaaagaaatcagagataacacaaacaaatggaaaaacattccatactcatggaaccaatattgatagaaagaccatactgccaaaacctgtttacagattcaatgctattcttatcaaggtaccaacaacattcttcacagaattagaaaaaatgattttaaagtttatatgaaacccaaaaaagaccttgaatacccatggcaatcttaagcaaaaggaacaaatctggaggcatcacgttacccaacttgaaataatactgcaatgctagagtaatcaaaacagcatggtactggtacaaaatcagacacatagaccaatgcaacagaatagagaccccagaaataaagctgcgcacctacaaccatctgatctttgacaaagtcgacaaaagcaagcaatggagaaatggctccatattcaataaatggtgctgctggtggtataagtgtttagccacatgccgaagagtgaaactggaccccttccgtacatcatatatgaaaatcaactcaagatgtattaaagacataaatgtaaaacttaaaagtataaaaattctggaagttaacctgggaaataccatttgggacataggccctgacaaagatttcatgatgaaggcaccaaaagcaattgcaacaaaaacaaaaactgacaaatgggacctaattaaactaaagagcttctgcacaacaaaagtgtttactcttcccaatcagagtgatccccaaaatccttaaagggcttgcaagggctacatgctttttaccccacccactcatacatcactgactgcatttcttaccggtctgctcctgtatccgtctattccagctgaagtgacatttttgctgttcataaaacaatacaaacatgctccagtgtgagtctttggcgttctctgttctttcttcctgaaatgctccaacccagatgacatggtttggctgtgtcccaacctaaatctcgtctttaattcccacatgttgtgggagggccccggtgggaggtaattgaatcatggcggccggtctttctcgtgctgtacttatgacagtgaataagtcccacaagacctgatggttttataagaaggagtttctctgcacaagctctctatttgtctgctgccatgcatgtaagacgtgacttgctcctccttgccttctgccatgcttttgaggccaccccagccacatgaaactgtatgtccattaaacctctttttcctcccagtctcaggtatgcttttaaaagcagcatgaaaataaactaatacatcagatataccaaagttcacttttacattttcttcatatctcaaatactttcttatcaaaggtatctcctgaccaccctatacatatacaacatctggttctccttaattgcattatcattattctaatcacttattcatcccttacatattatagatttttcttgtttacttccatattggttgtttctgcccactagaatgtaaacacctcaagggcaggattttatgagctctatttattgctttcccttgagctttctgaacactttggcatttagcaatggctcaataaatatttattgcatgatgctcttcttgctttctgttgtgagatatagcaaatttaacgtagaaatcaaatatttttcattgtaacttattaacaaattacttcaatactcttcagaaccatgctttctttcctcaatatttgtttaacatcctttatcagagatataattcctaaacaaatagggcccactattgtgctttctatttcgctgagccctctctctataatctattgctatttgtgcaatcttttacacataggcaaccctagcacaatccatgacctgaaacaccagtgtaaactagaacaggactttacctctgagtttctatcctggtgaatctttgggggatactccaagtttttctagtcccctgaaatgcatgcatgagtccttaggagaccatgaacacattctccactttcgccttctttagcttatctttgctgccttctgatgttctaccttgtgccccgttatttacctggccaccagatggtgacataattattgctattcccaccaagatcattagcacaaatgtctcttaaagttatgcacatcatagcacaggctgcttttgcaaggaaaggagagaagctttggctcacttgtgttaaaagttattggggttcctgctgagctttcccatttgctcagttttgtgtattgcttcctggcacatactagagggatctgttaggcccactccctcagtttcttacagctgcctctctcaaggtatttgtaacaagtccccccgaggcctgggaaaattggagtgtctctatcaagtattcacccaaatcatcttcccatgctgagaatcaacatgtttgctaggataaatcccagatggtttgtgtgtctctatctagggcaaatttcccacccacctggagtccttgttgagagactgggactgaagagaggcagtggctctttctttctcttttttgttccatagtcttaatttcagtatcttttataaattctcatgctaatgtgtaatgtaggtctcacttggtaaaatccctgcaatgcttaaaaaaaaatccataaaaaacattcattagaaaataagctatttcacaactagcacaaacaccatccagtgctacagacaggtgaagagaaagattgtaactcatatactaaacttcataagttttattccccagaaactaacgtcgcttgcgtttctacttgttgtttgcttaagcacttctttggtaactaaacttggatggcaaaatgttaatgtgtaggaaagtaaatggctaaacataatttatatcagaatggtattttgaaagtggcttttttttaattcatgtgttcatccaacaaacatgttcattgctcattagtggtcagatgtgttgagcccacagagatgaatatacacagtgtgtgccctcaaggactaacaatagtagatataaaaatctaaatcactctctgtaagaggcttatggacaaacttgagtgtgtcttcataaatgtgatgatactgttgaggctctttggaacacctgagagagaagataacattctggaggcccaggatacttgtcttcaaggaattgaaagtctatcatatggacaaaggagtagactcaatgtgtgtggcttcagaagggaaaattaaagcgatgcaggattgaggacattgaggaaaaacatgtaccaagtagactgtttagaaaatatgggctaccttcagaggagcaaagtggtggaagttttaaacaattgtaagggaagtcttttgtttttgcttgttttttgttggtgagaggttatacttacattgtttttagggtattttgagtgatcaaactttatgatattatcatagcctctacccacacagtgcttatccttccattatattattttcatctagttcataaatcagtaatcagaaaagagcattaattcagaacctataaaattatggtgaaaaaatataacaatttcacattttcatctcaatttgatttaaagttcatagttatttactaatgaatgtgggaattcatatgggccagtaggagtgtaatagacatagtctgagtgtgtttgtgatgggcaagtgcatgcattctccctaatattctgaagggagaagttatagagagatgtttccagccagtaatatagaacagtgatactgggtcagtaaaaaactgatgaaaaaaagtggaactttagaatattttcttgtttcttgagtttgactgatttttcagaaccacaatagagctgtgctattctcaggatccatgtgctatggaaatgttttggaacatttttttttttttttggctctgcattcaggttcttctcacatccctctctttttgagctttgaaaaaaaatctaggccttgattttttaaaatttttatctatctatctttctaatctattatctatctttctaatctattatctatctttcaatcatctatctctgtctacctaatatatcatctgtctatctatctatgtatctatctatctatcatctatctacatttgtgctacagcaagtcccagctatgatggaggcaaatatgggtatgtgtggtgggtggagtcaggtgtcacacattccttgatattccccaaactgtaactacccagctatatatatatatccagttttatatatatatatatctttgtatatatagctttgtatatatatgtatgtatatatattcatttgtgtgtatatatatacacacaaatgtatatgtatagcttaactatgtagctatatccaaatacatatttatgtctatacctaatttatttaaatctaactgaatccaactatctcactatccaagcctaagaaattggcactgaaaagtgatatttgaggttacaacacagtgtcttatttcctgaatctgtactggtggatacatttgtaccctggggaacaataggctgtaggtaaaatgcaaggagttgcttcattaaattttgcagcattgtgaggctaaaggaacccttctggaccatcataagagaaggaagtgtgttgtttcccattttacttcacagaaaagtgcgaagtgtgatggcaccagcagattggaagcacaggtccccaaggtttgacggaggtccatccgagaacagagcaaataaagatcaaccacggcagtggcagagttactggcacctaggtcctgtggattgtccaggcaaggcccaaattgcagcattacagcagggagactgaaaagcagcagtataataatggcagtcgtggctcagggtgtggctcagcagggaagggtagaacagttggttttcctggatggaatttctgaatgtgggaatctcccaggggtctcctggcaatatgccagcagagaggtcatttttaaaggtagaactgagagattatagttatattctttgcggaaaataagttcatgaatgtgacctcattcatgtccatgaatgaagctggtgagacagtacaattttaagttatttctgttaccctacttagttatgatattgactaaagatgaggtaataaaaggaagggaaatctagagacatcacaaaattaaaattgtagaaacattttaaagaattttaaaaagcatatgacatttcagaaattataatcagaggttgcttacattttaactcaggtatctctttatccttgctaagggaagatgtaagtagcctctgctaaaactgaagcacagcctaggttcaaacaagtggggcattgatattagccgcttctcaaggcagctgtgtagtaactccaggctgtcagaaagagttatcagatagaagaccatgctcttaaaaagataccagtaaaactaacttacgtaaaacactttgtaatctacaaacctcatttattcatcatctcatttattattcataataaagccttttcaagaaaatgtttttatcccaattttgtaaatgaggaagcaaggttcagagatatgaaaacacaccctaggacgaagggattttgaacttaagtatttggattctaattacaactgtctagctataagtataaaagcccagagtgcatcttaatcattttggggtaatggaatatttgagaatcaaaagaaagtggtaaaccctcgccccagaatagctacatagatatacacatatacaaaattcaaatattctttcagaaacacttctgaaacatattcagggatatgctacatgtctaaagaccacagaatgaaaaatctaggctgaaagtggaatattggggtgctgtaacaatcaggtttaataactgaagagtttatgtgaaaaagcaaactcaagaaatttaattttgtaattgcagtcttatgttttgggtcccatggtgatattactaagggttttctcctaatataattcatatattcatactgggggaaaaggtttctgtaaatgtagttcttatttcccttctgtatgtttctaagacacctctttgtatttctctattcctgtagcagtaattcacatcattgttatatagaacagtactttacagttctattattttatgtacctgctaaggttttttcaattactactagacaattgcctgtcctaattggtagccatgaggtgaactgatctttgatgcatgtggtatacaatatgagggctgttcacttatttttctcccacagttaatgaataagttactggagagtgacatttgaataatagcattgcattaagagaagccaaatttccattcttgctttgttcttacaaaaacagagggaaaataaatcaagaatgacctttagccttttagcaattagatcataattttttctttggttactaacggtgactcctgagagtcactatttacaattctatttatttcattttaccttagagttgaatgatttatgaatgtctgagctcagatgcatacaggactaacaaaactcagctttctcgtctcctgtctgctaacaggataatggggcatcgtgatggtcttttagatgtgtgaacttggctagggtatagcctctagttagtctttcaagcataaatctaggtattgctgtgaaagttattttataaattgtattaatgttcataaaaattgacatttagtaaggcagactgtcttaaataatccggatgagcctgaatcaattggctgatgaaccttaaaattagagatgagggtttcttgaaaaagaagaaatgccacctgtggacagcggcttcagcctgggctatgagcttcagcatgccctttttgatagcttgtcctacagatttcaaatttgtctagccagccccacaattttgtaagacagttatttgcaataaatatcttacatacctcctatcacttctgcttttttggttgtccatttactggcacaaacgtatatgcaaatatcaattgagttaaagcaataacttcaggtacctccttatttctcaaaaaatatacaagttaaacacaaggagttaccctgaattagagagaaacgtgatgattctcttgaagatttcaaaacattgaactagtctagatcagaatgttgctattctagatgtactgttatctattattttaacttaatttgccaatatattaattatcagctttagctggaatgttttcttaaataaaaatgtatagatgtatgtatctatatatttatagttcacctattatctatccacatctctaataccattaagtgtgtatttgcacaggtatatctaaaggaggattactgctgttattgtatattggtatatttaataacatcatatctgattaaattcataaaactctagaaatccaatagcctcttattaatattctgtttctgattgaaataaaaatgtttgcttcttgcaacattgcctaataacttatgataaaataaccccaaaagaatattccgttgaaagttgtattcccactatatatatatccatatctaggttgtatatatttttatatatatatatagtgggaatacatatatatacatatataatatatacacatacatagcagtaactagattactgatggaccaatgatgttaaataatctgtgcctacttctatgttatattttattatcacatataaattatgtttaattattgccaatgcctaggaaagtaacctctgaaaattaagagcttactttacattaaggtcaagttaccacagaccagaacatacactaaaatttacacctaaaggctctaatcctgcaagaattgcatatgacttcattgtaataataatccagaggagggatgcagaaaatgaaaagtggtagttggtcaggaaagataaaggaaagagccagagacaaatttcaatagtgcctattcaagcagtgcttaaaggaggggcttaactcctggagaaaaccattcctaacctagatatggataaatctaactctcctcattttgattccacatgtgcacctgcccatcttccttcattcatcaatctgagacattcaacctgccattaatagtacctggacgccaggtgcagtggctcatgcctgtaatcccagcactttgggagtccgaggtgtgcagatcacctgagggtaaggagttgaaaccaggctggtcaacatggcgaaaccccatctctactaaaaatacaaaaattagccgggcatggtggtgggagcctgtaatcccagctactcaggaggctgaggcaggagaattgcttgaacccagaagccagaggttgcagtgagccaagattgccccactgcactccagcctgggcgacagagtgagactccacctcaaaaaaaaaaaaaagttcctgggcatgtgccattgtgaggaaattaccagatgccagagaagatgctcagtattatttgtcattgggaaacagaaattgaaactacaatgatataccactacacacatttagaatacataaaattataaagattgacaatatcaagttttggcaagaatgtagaaaaactggaactctcatacactgcttggaaacagtttgggagtttcttaaataaataaatatacatataccatattagatagccatttcacttctaggtatttatccaagagaaatgaaagtccaatacaaaagacatgtacataaatgtttacatcagctttatttgtaatgaccaatgatgaaaacaactcaaatgtctatcaaaaggtgaatgaataaacgaatgtgatacgttcatacaatgatgtactattcagtaataagaaggaatgaactattgatatacacaacaatatgagtgaatctgaaaataatgctgagtgaaaaagccagacataaagagtatatatggtatgattccatttatctaagattctagaaaatataaactaattatagttgcaggaagcaggtcagtggtttctgtgggaggagggttaggaagaaatgggaggaagagattacaaagggaaaattggagtggtgatagattttttttttatattggtgatagttttatgagttaatacatatgttgaaatttataaaacataaaactgtacacttatcttaattttttttgaaataaaaataaaaatctgctgggcacagtggctcacgcctataatcatagcactttgaaaggccaaggtaggaggattgcttgagaccaagagtttgagatcagcctaggcagcatagtgagacaccttctatagtaaaagaaatgtgttatcccaataaagttattgggatataattgacaaaacagaaacaacaaacacaacagcaacaattaaaatttttttaaaaagagcataaataaatattgttattataatgattataatgaggtgaatgtatttcctgttgataatgttgaggcagggacatggcaagagtctgaatgttttaaaaatggaatcatgtgccaaaaatgttgtcttgtgagaatgctgttactgagactatcatttcagaaaatgcctgaggttagcgtgttcctagcactagcatcaaacctccacttgggtgccttggtcagcagcattcttaagtttgcagatcactgagaaatactgcagaaggtaaaagagaaaagcagtgtaaaaatgactgcttagacatttctctaatcagaatccaatttgattcaatatctgtcaaatgataaataatgaattaattttctctgcaaatgtgaatatgttaatgacacaaataacacttatgtgttagacataatttatttgagtatcacgagaatcctttgaaaatctagagacaaagatatgtgacttgaacaacagaagtggttttcaaagttgttaagcaagtcagaatgttaagactttatctggttccaaccctttaaataaacaggcaagcaagtaagtacctaaattatttaaaacttcctatcagaattgcttgatagagtcattcaacatatatttttagcgtacctataatttgaaatgaaaagtcaaaaagacgataagtggcaatcttttactcaattaatgaattatgttcttagtcattcagttatttaggcattaatgtaacactgtttatactgaatatttatattaaatagtgtatcaggcactgccaataatgaagaatgcaaagattaaggatatagctcccatggcccaggaggttctactgaactctataaactttttttagtaaataaaatggaaactttagtagataaaccagccaataaaatctacaatatcatgttgtaggatcgtatattttaaataagtgtatacttacaatgattgaacaagtgaagcataaatacatagtacacagtgaaattaaaaatgcagttattctgttttattgcacatagtgaagtaaaaaacaaaatgccttttggaagataaaattaagtgctttcgttaatgtgaaagaaaatgagaaaattttaagtgagaaaatctggctgattgtctattcagcaatcagacaattgcatggtttcatttttccttgagatgctttgataattatttgctatactttcctaagagaatttctatttcagttttaagcatattcttaaagtttgaaaattataattcttatgaattactttttaaaatgtttagatcattcattttaataccacacaatgcttggtttgttgcaaaaatataattttaaagtttcactctatgatttgaattttaccaggagaaaatcaactggaatatcaaaataatttcatttcctttttgcagttggtgttaactcttcattataaacacagtattcatgtaattatagttgaagagtatatacaagcaaagttcaagtgtggcatctaatttgtagaagttcctagtttgtttagggaggtaagaccaaaaaaatagccatttagaaataaaattgtttctagtttaccaagtgtgttggctcacacctgtaattccagctacttgggaggctgaggagggaggattggttggggctggatttcaagtccagcctggacaacatattgagacatagtaattttcttaaaaaatatttttctaaaaataaagataaagtgtagtatagaattaagtttcaatatgagtgttgcaggtatagaaatgttcataaacttttagtcattgataaaagtgagataatgttccacaatggttcaagtcccaatgccatcacttaataggcatatgattttcggtgagttatttaactgctccacggctctttatatggcatatagataataatagctgctaacttatatgagctttttcaacaagactaaatcaatttctgtattaatttacttagaatgattcctggcacaagtaagagctccatgttgtcaattagtgttatttagtgaaagggaaggtggttgaccaagccaacttttgccaccagtgtgtttgggaaatcttagaggcctggaaattatcacaatagatctgaaaattcaaatgaaaaccaaaagataactggtctaaagattataagcaaattattaaaatagggagatgcaagcctttttaacattgaaacaaggttctcatacttgaaaaaaaatacaattactgataaaacaaaaactaagtatttgaaattaagttgatctagattttaatgtcagttctgtcccttattgtctgtgatactgataataaattgttcaaatcctgtcagccttttttttaacctatgaaatttattacattgattaattggagataatgaatgagcaaattttcagaaaatgagttttcttcccattcttccttcattccttttcttaccaaatcaattatcagagaagatttaaggaagtagatgacactgtctttttatcctgaatatttgtgttaagacttgtatgagagagagagagagagagagttttcgcttaagacttgagtcagatttgtttaggtaattttttttgccaattattttttagtttagtgctaaataaatgttatttggttccttacattattggtgatttctctaaacattcaatgttcacatttcacttttgttttctaaatttttgtctaaataagtctcactgaaacacatttgtgaaaacatacctccattccctgttgcatcaaattgggtactaaaagaactggatgtcaaaacactcagggttttctctttttattctcctctgcgtaaatactgatttcatatctctagttatctttagtaaaatagaaatgagtcttttctcttagcaatgctgtgactatacataatattatgtatttttatatattatatatttatatattttttattgttatagatatatattttatgcttatatataataaaataaaaaacaacaacaaaaaacaaaagcaagcctgccattttcgcacaaactatgcaggaagttaggattgtaaaaaagtgattgctaattatatcttttaatgtcacatataaaaaaagttcttcctatgtatttggaatgaaattatatatcttatattttgcctgtttttaattgtataatatataataacactattccaatcacatctgagttttacaataaatatccagaacttatttcttctcaaatactttttttgcttggtttccaaaacaccactgtttatgttccctccctacctcactgcaagctcctcttcaaccttctttgctggctctttttatcttcttgacctctgaatgctggagtgcttagttcttaggccaagaaagacagaaaggtatttttattttcctgaattcactccctaaatgagttcatgcaatcgtatcatttaaaatatcacgtacatgctgaggtttctcaaaattgtctcatataccttatctcacggtaggtcagcaaatgatattggtgctactctcaaaatcagagccaccctcacactttgacttctattccatctgtacaaatatacattagtatatattccaattttttggacccctacatctctatcttcctattgtctccagagtagcaagagtgacctttttataacaaaagatttgatcaagccattcctctattaaaaagcctctgatacggcctggcgcggtggctcacgcctgtaatcctagcactttgggaggctgaggcgggtggatcacgaggtcaggagatcaagaccatcctggctaacacggggaaaccccgtctctactaaaaatacaaaaaatcagccgggcgtcgtggtgggcacctgtagtcccagctactcgggaggctgaggcacgagaatggcgtaaacccgggaggcggagcttgcagtgagccgagatcgcgccactgcacactccagcctgggcaacagagcaagactccgtctgaaaaaaaaaaaaaaaaagcctctgatgcggagtttgcagtgagccgagatcgtgccactgcactccagcctgggcgacagagtgagactccgtcttaaaaaaaaaaaaaaaaaaaaagaaaaagcctctgatggctgcagtttttactgaggattcaatctaaaatttacttaccatatttaaggccatttgggatctggtctcagctactttcttaatatcatctctgatcactctctaatcgcctagaagtaagttggtctctttggtgttccttgaactcaccaacatggttcaccactaaaaccttttactatctccatcctggaacacccatcctcttgctttcttcacatttctgctcaaatgtcattttaacagaggccaaccatgactttagagtataaaatacgcagaccagctgaaccctttaccctttatcccttgatgtaggtggatttctcaccttaccacacccatattactagtaatagatttatctgctttctttctttttttttttttgagacggagtctcgctctgtcgcccaggctggagtgcagtggcgccatctcggctcactgcaagctccgcctcccgggttcacgccattctcctgcctcagcctcccgagtagctgggactacaagcgcctgccaccactcccggctaatttttttttttggtatttttagtagagacggagtttcaccgtgttagccaggatggtcttgatctcctgacctcgtgatccacccgcctcggcctcccaaagtgctgggattacaggcgtgagccattgcgcgcggccttgtctgtatttttaaaaatttactatctctgtctactagtatcctctataagaacaagggctttgtctgctttattcattgctatattccttacaaaagtgccaagctcggaaaaggaactcaataaatacttattgattgaacaaataaatgaattccacatctgccacttactgcaaacatgggcaagtaatgtaaactctcgatgtcccagtttctctatttgcctagcaaaaaaagaaagaaaatctaacttacatggtctatttaaggttaaatggcactatatgctatggggatacctgagcatgtagtaaatcttaatgaatgatttatattgctttgacagtctagccaggaactgtttggattagcacagatttttagcacttgaattttcctattctaatttatttatgagtccgtttcacctgacaaaaattaatgaccatcacaaacatatattttggaagatcaaatgagataaatacacaatatttgaattagtaattgtgaatgctgtatgataatttataacatttttcactgaagtttgtttgtttatgttgtggtatacaaaggaaaatcaaagtatcaacctacatttttggcaaaatatgttaaatgaaacacaatggtctcattcctatctcaatattcctggtgtatgtagcttagccctcataataaactgaagactgacttaatgaatcattcatgattagtttgaactaatcatcggaatgatcagatgttggcaggggttcctgtaatgaaaggaaatgatctaccatctgtaagtgcctcagaattctgaaggttcttaggttctattttttccctaatacttagtcattttctgtagccatttatcttgaataagccaaaaaaaggaaaggtcagccagattcaagatttcaaaggtgtcatttctttagcaaacatgcactattcttgatagactttgaaatattttgcatctataaaggtttcattcagaatcgtaaattataagatattccagtctttaagataagggagtgttttgagcttgaatcagcaaaaccattcaaactcaactttctttgtttcaaataatgaaaggattgccactgctgaaacaaatattgaattttttcaatttttctatctttataaagaaggtggattgtaaatggaaaggtgttgattgggataatttttcttttaaataaaactaaaatatgtaaatatttaaagtttttcagatgatctgaaaaaacattaccaaatatttagctagttaaaagttacctatctaactatctgattaactttctcactggtacttttgatcaaaagtcactatttattaactgtaccctggctttgctatttaccaccataaacaactgatttgtcttggaaacacatacccagccttcaggacttagttcaagaaagcctgcctctataaagaaagtataatttcttattttctccttttttggactgacttgtttacatataggttttcttggctagtttatagaatccttgagttatttaatcttcttttgttttagtttcctagtactgaatacaattatattttaaagctcagagttatttaatctttagtgttagttacctagtactgaatacaattttattttaaagctcaattatctattttaaagcaacagaaacattttttgtgagtagatggtatatataatgactaatagaatcaatgctagtaaatagattttttgcatctctctgggatgaaataagaaaaagagatgtagtattataaatatatgtaagacatgcatatgtgtatatgtattgcatatgtttataaaggagatatagagttataaacatatccaagacaaaatcttttttctaaaaatattatctaaaaataatgaaactactaagataaataaaatatatatagcaggagatgatacaaccacttaccaatgagcattcattccattgttcattcattcatttatttattcacacaaaggctttggagctaacagtaacaagatcttcctgagctatcttttttaaaaaaaaattgctgcaattaaaaatcaaaaggactctggacatcacaggagactgactactctcatgatctcattcatggtctggagctgcatatttcattatgatagccactagtcttcagtggctattcagcacttgaaatgtgtctagtcttaattgtggggtgctgtaagttttattctacctttaagttttatttcagaaataacatgagtaaaagtacaaaaatgcatgctagtttccaagacttattaatttaaaaatgtaaaacttctcaatatttttattaatgaaacattgaaatgatagcatgtcggacatactgggttaaatgaaatttattaataagcttaatttcacctgattctcaactttttattgtgactactagaatatgtcaaattacatatatggctcacattgtatttctactggacagcagtactctaggaccgagatggcaaactttggcttgtgggcattcgtccctccacctgtttttgtaaataaaattttattggaatacagccccactcatttgttcacatattgttcatgcctgcttttgtgctacactggcagagttgagtagtcacaatagatactgtatagtccacaaagtctaaaatatttatgatttggcactttacagcacaattttaaagactcctacactagatgttgttttctcttgatatctctgcttctctttatctgcctttctgccccttcttgctatgaatcaggcaagcccctttgtaataaccatgttctagaagaaaacagactttttggtttatccaattaccattaatcctgtttgttcagagtatttttgaccaggctgtgttatccaacctatagatcaaatgtttagttcagtccagtaagtgactagctttgggcaaaaaataaacctaatatttttacccttcacatacttttgtgagcaggtagaacaggatgctgggcccagcaggtactgtgacccatgtgtccaacatatttagcacgggctgtattagtccctgggtaaaaaagataagagagtgacaaatatagattcatgttaacaagagacaactagctcagattctgggttatgagggagagtctttaatggaaagctttgaggggaaaggaagcattggttgacagctaagaatgtaaggaaaattattcacatttctgatttattttcttgatctttatgaatcacggtgctaatactttattttaaatggagtttacttgtagtatagattcatatctgagtatcaatattgaaatatgtattctaacataaatttaaaatgacctttgtattatccatttaaaattattttaatgatactaccatatcttttataattaagaactgaccaaattgcccaacaatttaaacagaattataacccaaaagcaaattgcttttctatcttatgtcacagaatgaaataaattaacttgttaactttcattgtaaaaggatttacttcaaatttacatgtaggaatgtataatttcttctacctataagttttatttcagaaataacatgagtaaatgtgcaaagttggctagaacagatggatatatatgactattgtgaaatcaaagtggatttcattctatttctagaaacatgacacactgtttcttgcttgtaatgaacatgtaccctagaatgttttaatttagctttaattttagcttttgataatttcatagctcttctaagaggtgtactcaccttgagtgtcaataataacttttggctaaaagtaataactctactttcaacatttcaaactagatgtgtcacctaaacctgaagataaagtaaattaaaaggcaaataacagtgtttctaatgttttatcaataaattcctttcctcaagaatgaagtccatcctcttttattctatcctagaggaggaggagtggtgattggggttagtcaaaatttaaaacatttaattggctattgtgctaataagtgacattttcaagtgatgttagatagctaagtatgactattttcaatgttgttcctatgagaattgtcttcctcccaattatgctttgggtcaaaatacacagaattttaagtgtatggatatgtgtaacctttctgcacaccaaactcagtttcaacagttttactgctggagagggaaaggctgagccaatcacaccacctggttcattatgaggctatttcagtagacgaagtattatgtaaaataaattctccatatggttcattttggcatgctagaattctacattgaaagtttgtaagatagaatgttaaactgtttttctactatggtacctatatcgtcattggagatccaaagaggaaaaagaagtaattggatttaaggaaggatttaggtaccccctaggtttgctgaacattatcatgatgccagctggaattgggagacagacattaatcacattttaacaaaataatcattcttatccaaggcactatcactctgggctattcttactcaaattatgatatatctaattctttgtaaaagtaagaatttaatgaattgtcaagcctacttgacatctttaacctttcttgcttttttgtggacaaaactttagcgttttaaacaccctcataaacaccatattcgataacctattttcagcactacttgacttctatgtgaaatttatactgctaatgcccatccatcttctacttcttaaagttttcttcgccccatgatttctaagacaattctcacttctgtctattttttctcatctctctggcattagtgttcagttccccttgctgaagtcttcttctaacttgttgaagttcaacacattttggttccttattttcacttctaactatatatattttggaataatctcatttacccaatggtttcaactatctgaaatgtgttgatatctctcagatcaatatcttcagtcttgaatgctatacatagttacatctaattgcttattgcacataccacaggttcctcaaatactatgggtaccaaggagtactttcatgctttccctttaccaccacctccaaagtctactcctattcttgtattctttacctcagttaatggcatcaccatccaccatcaagctacaagtcacagagttattactttattctatttctcagtttatacattactggtcaccaaattctgtcagttttactttatgattttttcttgcatctgtcatatctcaattcaacacaataacaggtttttttttttttttttaaaaaaaacctttacagaattttcttggaattttctcccttcactgttaccaacatttttctataccagtctaaactttacagtgctaccatagcaatcttactaaaaacaaaatctgctgaaaatcctcttctagatatttgattataaaataaaataaaaagcctctaatgtgccacataaaggcctttataatatgtcctgatctactgagttagtccagtctcatctcttattattcattcccacccgtcatcatttgtctttgattccaggtataccatactttccactggacccacaaacatcacctattatttaaaaaaatccatacctttttcaattctgttttcttgctggtaatactccatctaccctcaccttctcttcttaggaaatatctatttctcttccaatattcaaatatcctttttgttctttgacactttgccagagttctaccttcaatgggctagtgaataccttcaacattaaatataaatttggctttaaaaattttgagtctgtaagtataagcttattataagcttattcattttatctagacttactataatgtcaatggaaagcttgatattttgaatagcacttagtagttcttcaaatgtctgttttgaacatttagtaaaaaataaaaacatgtaactacaactggacagatttccccaaacataatctatagggaatgaaagaaagagagatggtatcttttgcatctatttggtttttgactgtcttaactctgtgtccatatattatgacatgatataataactaatgctttattactcctctatcttcctaatcagatcacgaactcctccaagatagagaatgtccatcctaggatctctaatagcagaaacaataaaaaaaaagtggctgtagatcaaactttggataagataacttgataatatcaaaggagaatcatcagagaaaaactcaggaatgctaaagtctcaatctttcttttagttccacaagacctctcttggtattcaatgttcattgagaggccaaataaaaccaattacatagctatggttttaaagacatcatttgggaagggctatgatgagagatacactttttgacttttggagtcagtctcatatctatatggcttaatcccaatgtgtggggattttgtgattgtttgacattttgtccttttcttccccttctttcattagccaaaaactctacaagtcaatttatattttacttactttttaattatccacctttagctcactatccctaaaccaatttgtgctgctggtgttttggattaggatgggatggcaaaaatgggaaaaagctggaaagacaaaagatatttggaaggcaaaatcaagagaaatggaaagggacacaacacaattttcagttaaaacatcacctaaaaatctaaatgttgctaatttcatagccaaatgtgactgaaataataatgtgcatgattggttattgcacaggaattaaataactgctaagttacatgtgctttctttttcttccttgaaatttaagaaaattataaagactagatgttacataagtgaggtctctctgggaagaggctgaataattaggaagtaagagagtaacagtgtggcttcttaaaaggttagagactattaaaattgacaaataaccaattccaagcatcagatatctagcaataataaggaagtgagaatggaaattagagaaactgtagacaatactttcttcctaagtggatttaattctgaaaatatcccaagggatagggagggtgataacataatgcctgcatttaactgacaatcagagcaaaatgtgagtgcacagcagaaagaggtgcagcaactgtggattgtgctatgatttatgtggctaaatgaatgagctgtagagttgctactgcattctgaagacattggcaagtgaatggcttatatcacctattctgtctctaattactgagcctgtaatagctaacccaatttccctgaaacattgaaacttttaaaggcatagcaggaaaaaagccacattatatgctttactcagtactgaagttttgaattacatattaattgtgtccactgtttttattagcttgaaagtttttattaaatttcacatttaaaaatctttgcaatattagaatcttacagattcttcattatttagcccatcataccttttcaactaagtcatttcagttgttcttttctacactgtgaggcagtaggtatgactgatgttattgatcctgttctactaggagaaaataggctcagaaatgtctaatgctattcccaattcatataatttattagtgttgaagtcaacattattccactatttgagagttctgtctacaataccacattgtagatttggggactagcagagcatacagattagctgcatcgtaagtttcttcagaatatgcatgctttttatcatcttaattttagaatgtagaggtgtttgtgatctccaatcaggcgatgaaaagcggatttggagaagacacaagaataatttcctgtataaaatgtatgaacatgagagtggattcttgagttaaagtgatttttttttcctctcaaatagagtgggtatagtctcttaaatgactttatttttaaaagtttatttattttcagttgacaaatgaaacttgtatgttcttatggtatacaaagtgatattatatatatatatatatatatatgattaatgtaattggcatatctgttacctcacatacttatattttgtggtgaaaacatttaaaatctagtttcttagcaattttcaagtatacattattaactatagtcaccatgctgtacaatagatttgcagaacttattcctcctaactaaaactttgtaccctttgaccaacatctccccattccccgcttcccaccccggtcttagcccctggtgttagaaaacaattttagataaaatagttacaaaacttttgaccaggaggtgttctggactacctataaactgcatgtgaggctgcaatgcatgcaggcatatcatttatactgcatcctagttttcaatattacagaataatgttttattgttgaatatgttaaaggtgataaaaatataaagccaaacaagataggtcctagactttggaaaaatacatatttctaaaatgtcaacagattcttctttcctcccctcctttttttttttttttaacttttttactttcactttctaaagctctgttgaatttggaggcataaggatgagaaaagactggcccacaacttgagtgcattgttcactgtgaatcttgataataacaggtatccctcatcaagcacttctacatgacatgcactgtgctcggcttaaaaaacatctacaacaaccttatgcaatgggtatttggatattatcagttcttaatgcagaaaattagtcttagagagatctttaaatttgaatttagatctgttgccgttgggttgcaatactgaaattagacttttaaaaaggctgcagggcaagacagaaaggtgactcaatctccaatgaggctagatagctgctgagtcaagaccgtataaggcagcattaatctatgtaagttccttcaagttcagaatctgttagtgattggacatgacttaactgcaggttgctgatatgtcaaccaaactcacaagaaagtggcatacataataaaaatgcaaatttataatttcccacgagaaatatggcaaatggattaaatattttctttatactgacccctaattatcagaaaataatctgtgtaagaatgcctcatcatataacacgaataataccactgtctgtatccttaagtctctctatagaggataaaagtgtttcttttgcaacacgacacttgcattcttgaaaaaccctgtattctgcaaaactatgtactaaaaataaaattacgaggcttatggaggaaacggggctggggcaaaacctatgtaattgtgtaccaaaagcactagcaaaaacagtggttggtacctagagagattacttgaataacttggaaagagaggtcaagatagctggggtttgcaccatgaaatattataaaggctgaaagcaattgagtggaaatactgacttttaagcactgggacaatgcagaagacagcagaactcagacgcattgtgactgctctttagatgcactctgcagtgactgcaacatgccgggagcttagagcaaggcagggagtgaggagacctgcagagggtaatctaggtcaagggctcattataatttcactctcactattccagctccacttgcctagaagaaattatctataaaaccatacaacatttctgttctactagcattattgctgtatttgccaatcatatgagctacctagtgttacagaagatatattgcaacagagcagtctggctatgttgtcctaacagagtactcttagccctgtgtagttcttgggtgagtattgccaaattgccttattaattctcattttatatttatagatgactgaccactctctcttttgattggcacattcttaggctttataatatcttcagtcagggtatctcaacccctctacagacagaaaggattagagttaactagaactctagagttctgctagtccaactgagaaaaacctcacaatagcatccatcgttaaccactctgcttcaattcttacagagatagaaagttcactgacttctaagatggtccatttattcatctacttataaaaaacacatatgatcataatagttctaacattttgagtgtttagtacttaaataagtcttaagcttaagaataagttgaacagaaagaaaattctgatttagagactatgatgagactatttggataacatatgtaaatgttcaatggctctaggagatgtctttttagatatggcaatttaccataggaatgcttatctatagaactggtaagaaaagataatggggaaaataaaaatttatcagaagtatatttttagaggattaatgacttttgtaaatttctcaagaagttaatgatagattgttgcacataaaagctgaaagagaaactaatttgtaattatatataatgttacatttaatttgtaaatggaaaatttaagttcagtaaacaagatgatcaaagtcatttgtaaattatagtaacatatttaaaatagatactgtatttagtaatctatcaaattttgcattttatatttcattcctagaacttattatataccacatttaaagccttttttgttagtgaaaaagagtagagatattttttattaaaaactttttaaaaatatttaagtctagtaaataaaattaagttagagatagaaaacacctatagaaatccctttcctaatgatacagatccttgacagactaaaggacttatataataaaaagtcatcaatattgttctgatttctaatcttgtagtatttcaaaacagaggagatagcgatttactgcagacagcgaggagagactatgcattagaaataagcaaattatcagaataggtcgcaagataaccaatatgttttcatgactgaaagatataacttatgaagttattcaggacactggacatgaagttttcacaagaggtaagttacacagagctagtatgttaaaaaaatcgaaagaaagaaaaccatatagcaatgtgtaccttgaagggtacagagagttctgagaagatctcagggttcagctacttagcttcctttcctctcttctagctatcttttctaccacccacaacagtttccttttcatctgttaacacttctgtcaacatttttcattttattcaccaaaatcttcaaattactcaatttttttaagaacaatttccgcttgccgtgtaataggtgtagaggtgtttagtgaagctaaattaaaagtttactgttagtcactgctcattagttatcagcacctttttctttttgggagttcagtgttgtaaaaagaaggggtgatggatagaactgtagggattataaacttcgtggagttctgcaattcaatgcaataaacctgtatggagtgttgcctgaatattatacatcccacccccttcaatctggagtacctagcaaaactccttccttctagtggggatgttgatgagattaattaatgtaagttatagtaaagtgggctttttgttccttttcctttataaaatacagaaacaccaaataaaagaaaaaaatcacctatgatattttttagagaattgagctttattctctaactggattgttgagtacaaatgatgcatggattatgaccaaatgcaactttctttttgatttttattgatccttgataatgtatccaatggggtgagtttctctggctcccagtgaaaactctaggaggttccatggctttttacattttgatcaaactaacagctttaaaattacttcaaaaaacaaacatagtcttgattaagaaattatcttgtcccttataataatcaaagaacagaaaatattctgtgttaaatattcttcctctttcatctcagtctggcttcaaactgaaaaacctggagcattacttgtagttttctttatcatttcaacctgtttgtctctgcttttccttaatagttaactcactgccaaagttgatggtccagggtggtgtatagagaggagcagacgtggaaaagccagttcttacttgcttgaatattattatgttcattgggctgctagttaaatttggcaaccctatgtggtgttcagttaattgaagctaaccatttcattgtgtaacttttcgggattttcacgaattccctagtgggctctctttcctacagttcagttgatactagtagatgcaccatgtgcagaatggagctcctttctcgcactggacacctggcaccacaccttcagattcattctgctggggtctcttcaatgcttctgggtcgccctattgggcaggactcagagccctcgttatgcattactcccccattgccacccatggtgtgtgggaaattcttacttatttcttttcctgacaaactcgaggagtacaggcacctccatgatcactctccttgttctgcttccaaagcagaaaatcagcttttcccttgacctctaaattcttttcaggtgggagggtaacccctgactgcagtaaactttgactgggtccagtataagttttatgtgtctaattgcagaaaatccacttcaaagttctgcaaatggttcttttgaagccctcttcactaagatttgtatcagaaggtagcaccacaggcatctggggtgaggaggctgagacttacagagacttacagcctggcttgactcttttaggagaaatgtctccatcatttttgtttctttctctttaaaaaaaaaatctctcagaccacttgtctttgagtttaatgagagatccaagagatgcaaacaagtttcatttcacctctttgtgaattcctttctatcctttttatatcattggttttgataaggagaccaaaagagctggggggacatttacattcaaccctttaataaattcctcatatgggactggaaatctaccccattatctgttcaaagtgaggaaaagaagagtttcattttaggttttgtttttttttcttttacactgtcaacataacagttattaaatgtattgtaaatactgatttacaaatgagtcttttccaccaaagataaccatgtgctagaaggcatggactctccttattcatgttaatatcacagtaactagtgcagtgcctggggcatatggatattcaacaaatagtagtgaaaataaactttatgcttatattgcacagctttcactttcattgatatgtctgatcattgattttcttctcagttcagttaacactgagcaaagctttatagaagagattcctaaattagtcttgaagcagattgtaggtggtgatggtggttgtatatgtatgtggaagaaagtttaagggaagcatggccaagagaacagcaagtactaaaacatgggggtgggaggaaaagcatgttgggaaacgttgaatattgctggagtgtatggtagaatgaaaaaggcaagaaatgagattagaaaacagcatacgggttttatataccacaacaaagggtttgcagtttatcttttggataatgggattttgaagaattttcagtggaaaatacattaattgagaatagaatatgtttttgcaaatttataagagacagactgagagtaaaaaattcaattgaaagtgcagtgtgttttaaaatattcagcaataaagcctcgtgtttctgttgattagctatgtaggactttaaatggatcttcaccattatcaagcagtttttactttctaaactttatttttagggaaaaaaaagaaattattgtttaaactatcaaagttattgctattttcacctcacaatcatgaagaaagggacctgggaattttgttcttcactccttgcaagtagattctttcaacaagtgttcatttaattctgagttaaagaaagtaaaactccatacaagaatatcagcatgaaagtatacaggagaaatccatttttattttaaacaagttggtacaaaccaagggaagaaagtagaaactgggttagatgaaaggcagtgcttcaagggaactggcattttgccataacctctctcatttatttgagggtatgtcctgtcatgtgggtaaagtataaagaagcatttctgtgacagcaaattagtcagtataagaaactcaagtctatgttctggcttaaagagggaagatcattcaaacctctttaaactgtgatgaagtttaaaagcaaagaaaatagcaccgacagcaactcttttaggagagagcaacattgtttaaagggtactaaaggaccccaggaaaatacagaaggagccactggaatttcctcagtaacagtgcttttgttatttttggcaaaaattaacttcaaataacctgaataaatgcacaatagtatataaacccccaggctaacgggaactaaccttcagggcagaaaataatcaaaagaagaataaaatgttgtagaattaaaatgcgggctgcagaataggacaaagatttcgaaggaaggaaaaaaatgtgatatttctggagaattagctattaagtcatgcacatttattgtagccagacttggcagtacaactgctggtaaaagaatgtcagaggtttcaatataaaactcctattagaagcagttattgtgtaaaattagctatccagatctttgaacatcccacaccatctggcagaaacgtacaagcccagatgtcctatgtctttatgtagagtttagagtcactgggtatcaaaccaagaaccataaatatctcattccagggaaaagctaagatattgttcataggttcaatttactctactttgtcattagttcaaataacacaacacatttatttatagtacccattctactataaccaaatgaagaggttatatattttctgaatatattctgaagaggcatatattttatgtactgaagagtcatatattttcaatttgcacctccagatccattcttcacccttcacctcctgcaatgtgtttgcagggaaaggggctgatcattgccttttggttatatttggtaaatgggagatactggtagaacatcaaagacaggaggaaaatgaagtccatatatttattcccttcattctcggcctttgcccaaagtcctagtttatttcgcatgagcctttccaaggtgtgtatgcctctccagtttagatagctaactcctcttctttcattaggcttgggatagcagttgttctcttctgctattagccccatggtactgtaacatttcttgttgattttctttaaccttctcatatgttttttatttttcttttttatttttatttattactttattcatttttgagccagggtcttgccctgctgaagtgaagtggtgcaatcatagctcactgcagctttggtctcccaggctcaaggtatccttgtgtctcagcctcctgagtagctggcaccacacctggctaatttgtgtgtgtgtgtgtgtgtgtgtgtgtgtgtgtgcgctacagataaggtcttactgtgttgctcaggctggtctcaaattcctgcactcaagagagccacttgccttggcctcccaaagggctgggattacaggcgtgagccactgtgtcgggtccttctcatactttggtaaatgaatcctttattaaagttctttgttcgaatttgccatttgttcccttccagcgcactgattgataagtatccacttactaaaatgtaaatggcttagcttgtgggaaaatgttttcatgttatgtgctgatctagtgttaggaaaatgtacgagatgacagaaaaccaatcagttagagctagggaagagaaagtaagccctaacattctatttgacacttaccaaagcatctggaggtctttactgagatcctggcttggcgttctcctttttctagttaatacactgatatggtctttctgaattttgaagggtctatgtgtatttaaaatacttttccttttttattgttagcagtttgggtttgatatatttcttatatctgagagttggataaaattcagatataaaaaaataagtacaatgtaagcttcctgaagggaaatattctgaatatctactatagaaattagggcaaatgtggttgtttcattagcattttatttctctacttctctgattgtttcttttgtcatgtttgctcattaacctccaccagttgctatttatattaaacttcctccaggctgtatattgaccttcacctttttatcttttatactacctatctcttttaggatctaatacacaccaggatttcaatatactatatctatatttaaatcactcagtaatttgggcttcttgtttatatttctgagttgtagtccaactgcgtactcatgtctacccttaaatgtcttccctattcaaaactctgacaatttctcatttcattttggccaaaaaacaaaaaaaacaaataccatgacccctgtggctataagtgatttgccttcaactttactgtgttggaatgcagtctaagctgctgtagcaaaaaaagaaaaaaagtaacataaaaaacaatggcttaagaaaggcagaagttgatttttcccttatgtaacagtcaaaagatcaattattcagggctggtcacaaagggttctgctaaccacttacataacactttcattttgggatccaaggtgactgctcgaggtcctgcctttttacttccatcctagtcagtgaaaaaaaaaaaaaaaaaaaaaaaaggaataactggaagacgaaaggaatgaacaccaatcattttaaggacatggtctgaaagtgggaaaacttatcagcggaaaaagaaattggtttgggaattgtgttatacagtcataccatggaggtgcagaccacctcccgaccctggactgtgtttctttaccctgacgtatcctgagaaacaggaatggtacaaactaactttttttcctttagaggagttgggggaggtggtatgtgcaggcattcttcagagtattcttccgcccccagcacccactctcattattttcccttttaccaccgactcttgtcctgaaaggttggttgcctgttatttttggatcaaacatacgaagaaaacccttaacttctccttttggaagtttcaagtttcaggaagccacctagccagttggtttattttcttgacctaacagtagttccatgatgcattggttttaacaaggcagctgaggcaacaaaacgagtggcttaccattctgcctagtcaccctaagcctgagtactagaatgaacagcacataactttgtgtgagtccacatattttaaaaatctcctaatcctatgagttcatagcttctctacctacatgatgcatttggcactagtttgaatggtcccatcacatcctttttacaattgctctcctcatccagaagaaaacttcacaccataaagaattatgttgcaagagatttccaagtcagagaagatagctttcacagaaatcattttccaaagtgagcttaggttttccaattaacccacagaatcatgtttagtccatagtgtagatgatgtgtagcactattttcaattctggatcttaggaatggggtatcatctagtaaaggaaacttaaatgaaaaagaacttcctctctttttgttctgaaaaaaaaaaaaaaaaaaggcattagtaccccttcctcatgtatcccacaagtattccattatacccttgccttttcaaggccacttatatggaaaaggcaaaagaaaaccaacttctattccactactgtgttttctcattaccttcaaattagctactcacactatataaaattgtccctgtctctcaatgacttcagtctgagaggaagaatgttatacgatttaacaaattccactaatatgtgaacaaaaagcaacagctccttaacattctcagaaatcactggagtttttaaagaatgatgattttattgtgaattttttgattcatagaattttaggaaagataacaaggaagtcaagtgaaatcaggaagtgcagagattaaaaatgggaacattcctgcttgagatagctccatagagcctttcctgcctttttcttccttctcctatctctacttcaatgtttacagattctgtgagattttcagttgctttcctggtgatgacattagtgacccagagtgaacagcctttgcatggcagggctatttgtcttattattttacttagctggattacaaactaactaaaccatgtcttacatgtatttttacttttatttttgagacaaggtctccctctgtcacccaggctggaatgcaatggcacaatcagagctcactgcagccttgacgccctccaggctcaagcgatcctcctgccttagcccctgagtagctggggctacaggcatgcaacaccacgcctggctatttttttttttttttggtatttttgtatttttagtagaggcaaggttttgccatgttgctcaggctggtcttgaactcgtggactcaagtgatctgcccacctcagcctcccaagagtgctggaattacaggtgtaagccaccatgcctggacacttgtctttttattatcgtaaagagccaaagcattaggtactcaataaagatttaaagaatgatggtgtcaaagtacatagactttttcctctatttaaataatcaattttcttcctgtgttattcagactttaataatatgtaaccaactccaacacattaggtgagattttctatttctatgtccagcaattcttaacattgtccatgagcacaaatcttttctagatttgccttcttactgattttttttccctctttgggctttttttcccccgtccataccatcactaagatgtgtccgtgtctatgtcaggagaaggatgtcaatcagaatggtggtgaggataagtgagtcggcactatgagaaggtactggaactagggtaaaggaagaggtatttctaagtggagacttgattaaaaaggggagcatcttataccaaccagcaagtcagtgggggaggtctggagtgattaactgacacaggagtttcccctaggtcccctcatgcccttcaggctacaggttgccattttgtaatgacagattttttttttttttgagatggaatcttgctgtgttgcccaggctggagtgcagtggcttgatctcagctcactgcaacctccaccttctgggctcaagcaattctcttgcctcagcctccctagtaactgggactacaggtgtgcactaccacaccccgctaattttttgtatttttagtagagttggggtttcaccatgttggccaggctagtcttgaactcctgacctcaggtgatccacccgccttggcctcccaaagtgctgggattacaggcatgagccactgtgccagcctttttcttttcactttaagattattcttggcatttatttacttcagatatagctataaaaatatttcaagtagagaatggggaaaagtgaggagaagatgaagacaaagtaatttgtctaaacactactctctcctaatgaattaattcttttctttctccctttcatctacccctcctttctctaatcttttcccccttctttcctgcttttctttcgtactccttttacaaatatttactggtacctacttcctgtcaggcattctgccaggctctggggatacagataatgaagacagggctctgattcttgtcttttagatcctcaccttctactggggagacaaacacaaacatagttaggaaaatcataatataattagcttttgtaatgatttccccaaatacaaaaggagaaaaggaccaccctcccctgacccgatttcctgctggagtacacttcatacatgaggaacaatttgagttgaagcatgggtgggagtttgcaaggcagaataacatggagaggaggatattctcatcctgagggatagcgcgtacataatagattgcggcatgacaaaaatcatgttttgaatgttaaagcaccttactgctgtgtataaaatgcacgtagctgagtgatggcagatgagcaatgtacagccagcttttgaaagcctctatatgccatataaaggagtttaggttttgttctgagataatgaaactgttttgatgacttttgagtgggattctgaaataattacatttttaaccattgttggaaagattacgctcacagcagtgctgatggccaggtattattaaaaatacagtataagagagaagtgggcatcaattgttctggtctggtgagagatgaggatctaagccagagcagtaatgaaagaattggagtagaagggctgatttaaatttgattattggtgcagacacggggattggtgattgcttgaatgtggaaggtggaagatacttggaatagtttttgcattggaatttggggtggccctacgcttttcttttcagctggtttctgccaaatgtgaaattgcaatttacatagaaaattttatgaagacttcagaatgaagaagtctgcattttcaagtcttctggtaaactcatgttcttgttgcacatctgagaacagccccacctgttgacagatctttgatggcaaggctacatttttgatggtttccaaagatggaaaaattgcagaataaagttcagaaaacatggtgagcttaaatgaataagttatatttaattgggtatatggtattgttttcaatattaaagatattttgaggcccaattagacaagactttactgacctgaagatgtctaaaattatattatagttcaagaacaagagatgatagaaatttggtcagatcatttcttaatttctctttgttcacttattattaatcacgttgttaggagtatggggactattcctatgagaactaaaggaatctttttttgtttgtagtttatgtcccagtaggtggataatacaatttagttttgctttaaggattttaggatgcatatgtgtttgtttttatgtattttatatatagtgtatatacacatacttatgtattatatataactataatatataagtataaacttgacttcaagataattttttaaagtaaacttttagttcaaaatttatttctttttaaatcagatcttttcacctttgtacatatatatctgtggcataactaatattttttaaagtttatgttcaatttctttcaagtctttgatgtttgattttactgctttcatcttcctttgtgaaagtaatgataatgtggcacctactgctccttgagcagattgaatgtttctgtcccattagggaatagtcttgtgatatttccagaaggatattaaaaatctcactttatagtagaaattatccctttgtgaatactgaatgtctttatcataatgctgtcagttctgctatttttcatacatttcagtggcaaaaactgaaaattagtgcattgatcataatattaaaaatgcatccctttctactacttgatcaatagtactttccagttgattatcttgtctggctgaaatgtctgttatctttcattggctaattctcgagagtagactttaggatgttggtttggaaaacattttaaaaatgattatatctaactccttcaattttcggataagaacattgagtccagagaactcaatgatgataaatatcttagataacattatagacccagggctagaacttacagtgctttgaagcacaatctagcagtttttcaggtgaagtcttgatataaaagattcacaactataagaaacaagactttatttattctcaacaggtctccattttgctttttaaatgtaattattttctaaaaccatccctatgctcaaaagcttagaccctcctctcacttgtggagtaagctgcacggaatattgaatatagactgcatgtaccacagaaagtgggtttatagatctatcagtctcaattccttccacaaccacttattgactagctacagtgtgcctcctctgcggcaatggcaaaaataaaatggattgaatttctggccttgaggcgttcatgagagaattggatacctacataaatgactctaaaaaaataggctgtttaaatgttttagaaaaaataaaaatatagtgctatggggctgtattagggtcttcagaaaaacagaaccaataggtatatatagatatatgagaagtgattgtttatgggaactggctcatataattatagaagcccaaatccccaaggcatgccgtctgcagtggagaaataggaaacccagtgctgtaatttagtctgagactgatggcctgcgaaccaggtggggtgctggtgtaaccatggaggccaaaggcctgagaaccaggagattccatgtccaatgtctgaggcaggagagcatagatgttccaactgaagagagagtaaatgcacccttcctctttttttattcttctggggcctcaagggattggacgaggctcactcgcgttgtccagggtaggttttgtctactgagtttactgatttaaatattaaacttttctggaaaaatattcacaaacatacctagaaataatgttttgccagctatctaagtatctgtctgtccggtcaaagtggtacttaaaattaaccttcatagaggccatggaaagaaaagccaattctgcctgggggaagaagaaatagttgagtgaaaccatgaaaaatcagtaggctttgagagttaaagagtagaacaattggtcttccaggcaaaataaatattgtaaagcaaaggaatgaagactccaaaggcacagatgtgggaatggtagttttaataggcctatagtagaaagtatcaagaaggacaagaaagagagatgaggtcacagactgaaggattttatgtggaatttttcatttttttctaaagccaatttctgattattggcagttttgataaaaagagcagaggaaaaataaacttgctttctttcactgttttcccaaggattttgaaataatatagcttagaccatccacccttaaaaaagattattacagtctgaggactttggttcatttgccttttttttttaatttgattagcttcaagaccccatttacaatgcatatatacaaggttgttattgactctccagtagttagcttttctcatttccctaactcgtagataacactaacaaaaaatttagtggctggatcacggtggatgctaaaaaaaaaaaatgacaaatttaacaactattttcacccactattgggtctatgtttaatgctttgttttttgccaatgactagcactttacacattcgtgtctgtggaagaaattagcgcatgagagggtaaatggattttctagggttttgagtatttccacacaaagtatattgtttgacatcaacctgctgattgctaattatttttagtaggctaactaggctgtaaatatctttatatcattcctcagatcaataatttcatagttactaaaggagtgccttaaagatcctgataccttaattggaccagttttaccctcactttttagttttagacattgtaacggtggctcttctttcataattttatgtcactgtgaagatgctataaacttcctcttatccaggttataaggacccatagtgtcctctcaatgtattgttgtgcttctgctgggtttcttgaaaaaagcactgctttaacctagttctgacagggtctactaatgctacataaccctacaaccaactgatgcctgtgctctgaaccgggcttgtggcagacagcttgcaaatactagatagttttgacatttgcttatctacttttttgtttggtcctgggttcacaactacagtataagccccatgtagtagggattgttcctgatacatttctgagccatgttctctagaaaaaggtgcaggttaaattgggaatgtgaaacattttttttgttgttgttcttcagggttctttattccatctttcataaaagagatgtcagaaaaactgtttctcagtcacctttaccatggcatttgtcttctgagttgattacgactttaattcaacaatgagaagccaatataaactcatcagttcatggtctgtggaggcatgtgctttacagatgaaagtaaatcatataattatccctgctccacaggaagcaaattatttcaattatctgaaattaactctatatctagatttctcccaggtaaacaattgctgtttgggtacagtggtgcggatattgtcagaaaacatttatattaacacttaaagtgacacagtaacacacctacatagtctcatggatagaaagtaaatatctggctaaatcacacacatgcatttagttttagaaatgaaattaagtttattatctgtatgctgatgcttttacttctatggaaacgtaacaacatcctgtggacattagataatgaatagtaaaacattaaaacaaaggttttcagtttttaaaatatatcctttttttgcggcgggtagagaaatcttcaaaacataagaaatagttggctgtattcttttaaaggaacagggttttttggcagctgacttacagccagtcttttctgccaaaatatcaatgttttcttgaggataaaaatagtcttattgcagccagcaaaatgtcatttgaaactacaagtgaccactgtcacagaaaggtattattattaatgcttgcaacacaacaaggagtacaatgatttcggcagagattgctatttccacacagctcagagttatcaaaagagatagcagaagtaaggggaaggtagcagaatgttagcccattgcacagaggctactatcttgaggaaagaatattcaggagacacagggagcaacgcagcgtaatacccacacacagagagttgaaaagatcagggaaacaaagaatatgcaaaaatcaaagaaagagcacgaaagaaaagcaaagtaagaaagaaacgatggaagaaaaaaacagccaacttttaaggattttctgcaagttaacaaaagcctagctatacttaagtggacattattaaattctaataggagattttaagctctttgaataattaataaggacagaatacaaaagaacctaagattaagacatgaaagtctccaaaacactccaaaacgatacagtcaatttgcaattggtgatgtgtgggtatttttgttattattttagagtaaatttaccaaatatatgattaaataattttttttgagactgagcttcgctctgtctgattaaataattttaaattactccattttgtgtttaaatcccatgtaaggaactctgacctggtattatcagtagctgaactgcattgtatccaggtagactgtagtgaccatctggtccctggacagctgcccgagactggacagactattgctgatttttagctgcatccatgcctttttcatcaaatggagaggacttacataattggtaccctaaaaagagacaattacacacggatacaaatactaatacaataatagaattagctatcaggctataattggtattagtgtttttggttgtttctgtcttgctgtgttttagataccgacagaaactattatgtcatgtacttcccacaataatcttataagtccggcttcatcttttccctaaatttgtatataagtaaactgaggcttgtagaagtttataatttctcaagattctactgctaataagtagatgctcaaaaaagttcatctccatatcatgagtttttaaccacttatggtatattctgtaaattagaaaagtaatttgaagtctttaccatatgctggactccaagaaagataacttttcttttcttcccttctaagaatctaaattactctaagaatctcaaaattcttaacacatacattaatagatgtacttggtttgatagtaaggtatattttactagaagtgatacaaagtgggaaggtgagttatgggagtgtatatccccctagctcatggacaacttcaatatttaaaaccttttctgaataatttgccctaaacaatgctttcaataaaaattaggtgatagtaaactagaaattttaccctctggaaatctcagtagtagttatacaaactatgagtcttaccaatttttcaaaggtagaattaacatcttttattaaaatggaagagtataaaagcatttgtaattaaataaaatgaatttggagattacaatcaacactttctcattcaaaacattttccccatagcagttggagaaacttttcacatgattattaaaatggtcattttaaattaatttttgagtttttggagatattctaccttgtttaagagttagaacaaaaagtcaaatttagatctgtttgtatttctcttttccttcagtactaactgtgattatgaataaataccaaatggctcatgagtacaaaaagagcgtagagaattggaacaaactagaatcacagcatctgggagacctgaactgaacatgtgctcggcaaagatttgttggattaaaatacatttcagaactgggagggacactaaggatcactagttagttcaattctatcctactttatgcaaaagaatttttaataccagaagtgatgttgaaaagaacagagatgatctgtaagtgagtaaagacagaatatttaaaatggcgtcctttcacctctctttagtcaactctcatggcaaatcaatggttgctatttttttttaataattgtggccaagatttattccatcaaatatagccttttatgtttagaagggtctttgtggtttcttttttctctttttgtcccatgaacataaacactttaacaccattgcttcataaattaacctgaaaacattaaactttatgaagagggattaggaacaggtagagagtttatgaaaaataatatgtttatactttgtttctttctcataacatatactggaatcatgtaaagttgagtaagatgaactgaataagtagcatcaggttatagattagtacattagttacaaggtagaacatatagcatgagcaatattttttgaagactaatctactgaaaaataagttagtttatctagcatttactaaatgccaggcagtggattctgttcaaaatgttatgtgatttcatgtttatgtagtcccttgagggaggtattattttcccaattgtattatggagaaatgtgtgatttggagagaagtaacatgcttcaagtgagacaagttgtttattgcaatttcaaacaagaagttatttattatgattttgcatcatttgaaccatataataattcccacaaagattaaagataagatacggaaaagaaaaggtatgagcgttcttagagtaaatgaaattttcagtaggactttaaattatatgaaaaaataattttaaattgttatgtttatttaattgataggataatttgaaagtcttctcattcagtttttcaattagttttaagaatctgtttaagacaacagctcaaataaaatttgtagaattatcttaggttattatgtaatttagaaataataaagtgcatttaaaaaattatgtaatttatgccattcacttactttttctagaattaatgtaattagttttgatcattgaggtttcactctttagtagtaaccagatcaaactcttgctcttttacaccaaacatatatatgctcacacagacaggcgctttaattttttcattttcagatttgtagctcaacaacattgcagtactttatgcgctcctttcattctattatatcatcccatagcaagggaaatgggaagaatgtcacataggtctttttttttcttgctttagtcacataatactaaagttaacatttttcttcctctatgtttgttggataattagacattgtataatagattaagagccatatgtgatccctgtctccttaggcatatgctagagcagaaataaattgctaaatataacaaataacaagtttatttccattaacgtagtatattgaaattaaattttatttttggtcttagaatttttggaaggaacaaaagtgaaccctattcttctgtatgtcttgtgggggggcatgcagaaataatacattctcttagacatgggttaatttttacattgctttaaagatgttccaagggaattttcagtgtggagttttgactaaatattgttaaaacttacagtcccacctgctgtctactctgcccttctttcatagttatatcatatccacctctaacactcaatggatgagttttcccttgagtaaaatatgaccaccgatatggtttggctctgtgtccccacctaaatctcacctcgaattgtaattcctataatccccacgtttcaagggtgggacaaggtggaggtaattggatcatgggggcggtttctcccatgctgttctcgtgatagtggatgagttctcatgagatctgatggttttataagcatctggtatttcccctgctttcactaacttcatcctgctgccttgtgaaaaaggtgcctgcttcttctttgccttccaccatgactgtaagtttcctgaggcttacccagcaatgtggaatgatttcagagaatgtatggaaatgcctggatgtccaggcagaagtttgctgcaggagtggaaccctcatggaaaacctctgctagggcggtacagaagggaaatgtggggttgcagcccgacacagagtctctactggggcactaccttgtggagctgtgagaagagggccaccatcctccagcccccagaatggtagatcccccaacggcttgtactgtgcacctggaaaagctgcaggcactcaatgccagcccatgaaagcagctgggagtgaggctgtaccctgcaaagccacaggggtggagcttcccaaggccatgggagcccatcttttgcatcagcatgacctggatgtgagacagggagtcaaaggagattattttggaagcttaaggtttaatgactgccctttggatttcagagttgggtagggcctgtaggcccattgtttgggccaatttttcccatttggaatgggagaatttatccaatgcctgtactctcattgtatctagtaactaacttgcttttgatttttattctcataggcagaagggacttgccttgtatcagatgagacgttggactgtggacttttgagttaatgcctgaatgagttaagactttgggggactgtcgggaaggcatgattggttttgaaatatgaaaagacatgagatttgggaggggccggggtggaatgatatggtttggctctgtctgcactaaaatctcacctcaaattgtaatccccataatctccatgtgtcaagggtgggacaaagtggaggtgactggatcatgggggtggtgtcctccatggtgttttcatgatagtgagtgagttctcatgagatttgatggttttataagcatctggcatttctcctgcttgcagtcattctgtcctgccaccctgtgaaaaaggtgcccacctctcctttgccttctgccatgattgtaagttttctgaggcctccccagcaatgcggaactgtgagtcaattcaacctatttcctttataaattattcagtcttgggtctttcttcatcacagtgtgagaatggactaacacaaccacctagggtaaatatggcccagagtgagagggaagggagtgatacatcctcccactttctattataatttgtgtcgaatgccctccaactagtttatggctttgtgcattttccacatcagaagagaactgggctaactaaaccttttcatagggtcagtgaaaaaaaataactagttcctggggaaaactcaggcttgtctttcaatgtatatgaaagattcattatcgatttagtccagactgcaacaagtgaggaactcacaatcaatcattagtgacatttcctcatgtctgctcatttctctgaaaatgtttttcaccttttaacttttactgaaatctgattcttctctgaacactcagctgccccgaaagaattctcaagccctttgccacacttctctgtcactgtgagcctggcagtgtgaaaagctgtcctccttgctgctaattgcagttttcaggacattattcttttcttctccctacacataagtcatcctccctctcagctgctgaccatgcttcctatttcaccgagaaaatgaaagcaactacaaggaagcttccatgcactcacacactctcttagctgaacttccaacagcatttgtatcatatactttgtcttcccacctgttctaaaggaagtctctgcattcccattttaaaacaaatctctcatgtatcattccaatcagcatcatagtagagtgttatttcttccattttagacattaacaaaaacaaacatgtctgatgccatattctcctctaggtatactttatttctcatttcttttacagcaaaactcctcagaattctccagtttcatgggcttaaataccgtctgcacactagtgattctcaaaatgatatatgcagttcagacatctcccctgaacttcaaataacagctgcctactctacaattccacttggatgtctcataaacatttcaaacttacttacatgttcaaaatcaaactcctgatcttctctctcatctaccaaaatttcccatcttaagaaacatattcccttccagttgggaaaattttgggaattatttccctgttagctaatgtcaacataccaacccattacacatgatttgaacttttgcctcaattttagcattaggatggagttttattttatttatagaatgagtaaaataatgaaagaaagaatatgaagaaggaataaaggaaggaagcaggaaagggaagaaggaaggaaagaaatggaaaaataagaaagatatgaataaaagaattacttttagcccaagatgaataaacattgaaaaaacactggtcattagaatctgaaatcaaaatgactaaaatgttttaggttatgctaaattgaaggccagtttaatcaagccagagtcatctatagtagaagattctttatttgggggaaacctccccaacaacagacttattataaaagaatttatacaaatttaaataattgattaatatgcatgtgtggcgatggtgatgcaatctacagtgcaaagaatctccacttatgattatcatagggtccaatcagcataatttcaacaagcagagacaatcacaatgaaatcatggagaccttgaggtaagatatgaattgggattcttcttagtaatttttgtttagatgattaaaataaatagatcatccatagctagctaggtaggtaaacacagacagagataggaatataaagatagagaatatagagacacttagatttttttaaaatgtattactactgtgatggttaattttatgtgttaacttgaccaggctatggagttcccagatatttgaacaacgaatattttgcatgcatacgtgaagttgcttccaaaggagattaaaatttgaattggtaggctgagtaaagtaacttccctaatgtgtgtgggcctcttccaatctggtgcaggcctgcatagaacaataagcctgagcagaagagaactgcaccttcctgactgcttttgagcttggctatcccttttttcctgcattcatacttgagctggaacattggctcttcctggttcttcatcctccagaatacctgaccagaactataccctctccttggtgtccagcttgctaaatgaagatctgggacttatccgcctacaaaatcatgtgagccaatttcttataatgagtctcactctctgtctctgtctttctttgtttttacacacacacacacacacaatttatatattggttgtttctcaggagaacctcgaatagtacaactaaattgtatgttttttaaattcgatctttcaccttgtttggagttaagataactaaattccagaaatatttttaatctggtacaggttaagtcctgaaatatttggataattatatttttatcattttaataccaccagtggctctctttcttttacatcttcatcagcctctttgcatctcacataattaaggataagaaaaactcaagtcatgtaaaaaagctcttcagtagctcttcagtgcttcacaggcttgtacatctctttgacttcatacatgctgttgccatttactggaatatcttttcattcttcattgtctagttaacctttctttaaggattcctgtccccagggaactctctcttatcctccattctgctataggtcccccactctcaaccctgccacattctctccttgtgtcttatacaggtttctgccatgggacatgtcatccagtactataattattaataaatatctttgggtcctccagtaaaaaatgttaagcactttagaagggtagaaactgtatctttataaacatgttttatgtccaactcctaaactagtgccagctgtaagtatttattgaaaaagtagttaccacataaatgccaatagtccagcctatcccatgtgataatttagaactctgagaatcttaaatatctgaactaattatattcttctttaataattttctttatacattttcttaaacctaaaagcaattctcaattatttgcaattaaataagcaaactatacaacacatttttttctcaattgcacatgaaagaggaaaccctgtgtcactaagcaatcatcatttatttgtctgttctatatgaaatatgcattggttttctaaacaaaattgctttcattggaagacttgccattgcctttggtagctcacgttttgactgatgacagcgatggagaaggaaaaaattgaatcatagtcatcattgtattgaatcacgggtagcctgcggctcacacctgtaatcccagcaccatgggaggccaaagtgggcagatcacttgaggtcaggagttgaggccagcctgggcaacatggcaaaaccgcagctctacaaaaattagctgagcgtggtgccacacacttgtaatgccagctacttgggaggctgaggcccagaatcgtctgagcctgggaggcagaggttgcagtgagccaagatgacaccactgcactctagcctgggcaacaaaaggacaaacgcaagactctgtctcaaaaaaaaaaaaaaaaaaaaagttcttaaattgcaggtgagattttatgggcagatttttacctaacaacaaaatgatttattttttatattataaatgtcaaccagggaaaacctaaacttatcatgtaattcagttagggctgtgtgtaatcctttgaaagccttcttcaataagcagtgctctgtcgcccagactagagtgcagaggcgccatcttggctcactgcacctccgcatcccagggttctagcaattctcctgcctcagcatcccaagtagctggaactacaggcgtctgccgccatgcccagctaatttttttgtatttttagtagagacggggtttcaccatgttggctaggctggtctcaaactcctgacctcaggtgatccacccacctaggcctcccaaagtgctgggattacaggcttgagccactgtggccggctgcaatttttcatttctatattatctatcttcttttataatatttagaccacactgtaatttatgtctatggtctttctaattttcatattcacaagcatagactttagcattatttggctgattatgtttgtttgtacacattaataaggtaattaccaattattactaatatatataagccaatgtattagtttctattgttgctgtaacaaattaccacaaacctaatggtttagaacaacacaaatttattacagttctggcagacaaaaacctgaagagtcttaggagcttaaaatcaaactgtcagcagggctgcattcctttctaaagggtctctggaagcatccatttcttttggctttccagcttctagaggcagcctgcatatgttggcttgtgcatcctttccccattttaaaagtgcatctccccaatctctgcttttgtcatccttgcttctttttctgattctgggcctccagccttcctcttaaaaggaccattttgattatactgagcctacccagaacatccaggatcatattcttatctcaagatccttactttagtcacatctacaaattccgtttggtcatgtaagttaacatatgcacaggttttgcgaattagaaagcagacatctttggaaggatattattttgtctaccacagtcaatatacaatttttattatattttgccaaaaaaccataacacagcagcagtaaatatcattagaaggtgtaactcaatataaaaagaaactttctcataattatttctgattaaaagtaaacccaatttcttgaatactgttctactccccactatcggaaacatatagacagaagctagataaccatccatcagctctgttatagatttgaaatagaggttctctctattttcttataattttagccatctcttttgctttaactttcataagataaagacagtagaaacaaaaggtaatttactcatttatctttcaattaaatttgcaaaaactaatggaagggaagatacagaataaatcttaaataagccatagtgcttgggatgtgaaataagcttatatatttttgtacttaattttgtgtgtgtgtcactatatgtatacaatgaattgcagtgatttttctccaagactttaattctaattttcagcaaaatgaaagcaatatacatttttacctttaacttaaccaatttgagaggctatgagcagaagtaaaaagaatgaaaaaatgatgaactacattttttttttttttttttgacacagagtctcgctctgtcccccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcacagtgttagccaggatggtctcgatccctgacctcgtgatccgcccgcctcggcctcccaaagtgctgggattacaggagtgagccactgagcccggcctgaactacatttttgagagattgatgtgccccatttcaggatgacctaccaaaagtataagagcatttggtggttcaacatactcatcttgtacatgaggaaatggaaatcacaaaactttactgacttgcccagggccatacaactagataattacagagcagttgtaagttccctgcttttctaactcctaatttggtactctgtccacaatactatcaacttttcaatatcctatttagtatatgattttctctgatttggtatgatttctcttttccttaatctccattttgtatgctaaattaatattatttaggttgagtcgcttgagagggaaataagatcttttccaatatcattatgtacaaatagacaaaatgcagtcaagcttgtttcttctttctctgcaaagttaagacgtaagtagggaaagaaaaaggagcttaatgatgttttcttgccttttcctttcttctatttattctttctaagaagtattaagattagttgaactaagaagatcttgttccaaagttgaataccagcagtaatagaagggtaactaggtctcatattaattaatataatcattctctgtgtaggggttgggggatgtaggaagcaataaagttaactgaaatatttaaatacatattgacaaatgaatcatcatctgtaacaacttaaaccatccctgatacgtaaacaaatagctttcctcactgtttttcttttaactgtatttgaatgtgctcacctccatgctacatataaactcatttgtaattttatcaaagtcttattttatttttgttttagaacaaatatttagatatggagtcttaccttgatttgaccgacaaagaggtcatgaagctttggcatcaatgagggttgcaatgaataaacaatgaattaattccattcacttgattcattaccctcaaatgtcttctgctcagtttggggtcattatattacaatagctatctcttcagcgtaagcttcgcattactctttttacatttccttctgcatagtccttgagtactttaagatcaatcaaatgaaagtcattttattctctgtttctagtacccaacttataaagagtagaatatatctgtagcatctataaataataagtataataagaggtctttagagagtcttgagccaaataatatttcagtttgtttttactacagtgatatgtatgaagatttcattatgacacaaaacttacgtacatgtaaaaataatgactgttggtcctgattccagataaataattcccgatgcagccgtaaatgtagatcactcccagaagagatggcatcttttgtaagtcatattttaccagtgacattttggtgctagttaatcaacatttccagtactgattctctatttgaagaaatcttgccatctggaattggtccctctagtaatattatttaaatcatcaaggggcaattcttcttaatcatcttcaacttagttggaaaaattaataggcttgtctattcaatttatgtcctccctttggggttatatagatgtctgtttatttgtaatatttaagcaactttattactgacattttttccagagcattttaacctacaaagttaatcatacaaaatatttaatttctgatactatttagaagttaaaatccaatgaatctgactccactatacttatatttgtttttaattattaaaaattattcttgatggtggtgctatgttcttggaataatgtagtagaaaaatggaggcaatatggcttttctttatatggcacagtaccattataagtgtatatactaagataataatttaaacagaacctttagatacttaaaaaaaggtcagcttttaaaaagagttggaaaaatataggtaatatatgaatttatcaaataaagctaagacattacatacaataaaagtagtcaaaacaacatgtacacattaatgaaatgtttggacttataagtccatgcaaatgaaatggacactaagaggatatactaactttgccaccaagcatcatgaaacacagataattcacaggagtattgaagttgcagcaacctagagagctactacaagtcaaaaatagcactgaggatagtggggtgtgcaggaaattaacaagaaatttaaggaaagctgatttttggcgtaagtcaagataagtaacctggcataagagttctaagtctttaaaggttcttaaactcagtcttacttcactgcctcagtatcttgtctgatggaaaaatggatcaaaaacatagattatattcatgaatcatttaacccaggatttcaagtttattaggtgttccttgacttatgtattcttcatatattcattttttcatgcaaaaaatacttattaaatatcttatatcaataagacactgtgctagctgctagataggaaagaataggatagtgcccaaagcactgaacctgcccttataatttattagaagggataaaatacaataaatgaatacattacaatttagtaagagagatacaataaaataactactaataaagtaagaaaagcatgtgtacactaaatactatttcaaaaagaaaagagtgattaggaattgttttgcaaatttggggtagggaggaaatccaattcaacttttgttcatgaacaactattctgcatcagacacagtacctgtagctaaagatacaaatataaataaaacatcattattttattctaggggttcttagtttatcaggattatccactcttggggtgcaaggaatgtcagggaagaatttgtggaaaaagttgtacttgagttgcatcctaaaatataggtaaaattttgacatatggagaagagggaaaaaagctttccagggagaggcaaaaccatgaatacaacagcatctgcaatcttctctctaaacttatttttatacttctgaaggcttggtatgaaaataacagaaggcatagctctgtgatacatgctttacaacaccttgtttttaaagcaaaaaagaatcaatgttcttggaaaaatcaattttttattatttcagcaacatttttgaatgttgccattgaaattacctggcactgtagatagagatggtcttatgctatttctgtattttagattcccccaaataatctgcaacctcttatagaaagtaacagagataaattaaacctcattatggtatggtgtgtaagtatttttaaacatttttaaaataatagttgttcgtgagtggggtctattctagatattacatatttccttttgtatttttttttacccttcatattatttgcatgttgagtatagaaaagaaaaaaaattaactcatgagctactgaggtggatttgctactggatgagtaacatcagcagaaatattacaatagctaattgagggtcaaggtcttttgaaaaactctttagaagtctctactgagaagagcaagaagatcaatataagcagagggacagagagcaatccaagggaaacagtagagaaattatattcctaaatgcggtcttttctccatgaccctctgccttgattgagtaacttgagaaaatcccttttctgaccttccctccttaatattatttttgaatcttcaaaagaatgtaaactactttctcattatcatagtttgtgaagacataagaagtccatactttgcacactggccataaaaaacagttttatctgttggtagattctttgtttaaatatatctttcccctatgtgatctcttctccatgattagtttaaaagttcttttcttgatgcagttgggctttgatattatgaagccactcttcgtgttttacattttttcctaagaaacttgtaaaatatgcctttttggatataattatgatgtaaacttgtaaggtgacaagtttaaattggagctttgaccaaaatgatgggctggttttgagaagctatgctgataactttatacaatattcatttttcacaaagctgagaagaggaaacagcaagagtgaaggaacgtgataagccttttttattattaggagtccttaatatatggtccgcaatagactttagatttggttataggttgattgatgtaagtggaatatttgcactaaattttatggtttaaaatatgttttcacatgtattaatatcataaataattgtataagctccattgctgttatattatttcattgttatgaaaactgagcttcagacatgttaactcactacggaaaagttgtactgttagagctgaaagccacttcttatttcatgtccagcttctgtttttacactgatttggaagtacaaaatttaaaagtgtatttaaaatattgtcataatagcattagtttcgttaaaaatatagttcatggtggccgggcgcggtggctcacgcctgtaatcccagcactttgggaggctgaggcggcagatcacgaggtcaggagatcgagaccatcctggctaacacagtgagaccccgtctctactaaaaatacaaaaaattagccaggcatggtagcaggcgcctgtggtcccaagatgctcaggaggctgaggcaggagaatggcgtgaacccaggaggcagagcttgcagtgagccgagattgtgccactgcactccagcctgggcgacagagcgagactctgtcaaaaagtaaaaaaaaaaaaaaaaaaaaaaaaaaaatatatatatatatatatatatatacttcgtggtttttgattggtaagtgggcatagactgagtagattaatgaccagtgttaggtgaactaaaatgttcaaggaccaccatttcaacatcatattgtagatttaaaccagggtaatgagtgtttacagagctttgatgttgtcctaatacttgaatgctatcaggaagtaatatcactcagatatatggaaatgtacagataatcccagtgattcactgtaattaatttcacataacctaccaagacaacagtctggttttgtatctttccccagtttcactactgccaattaagttgtgttttgtgcttttaagtaaattgatgtttaattaatacttaagtaaatcagatgcaaagtcttagtttcttagctgaaggtttatccagtctcgcttttttctttatacattttcttagtacaaaaattgaagctttaaaaataattgccagtctaaaatcctcaaggatgtgtctgcctagaagagtcagtaacagaatatgtgctacgttttatatgtagccttcccaaataacctttcacatctctttaatacatccagtaattcttttcatatggaaaacaagtttttactttacatttccctagatgactttcagttaaataaaatacttatggctgaagtaggaaacgtgttggttttcagacatactagattaatgaatgatctcttcaggggagcaatgtttgataggtgaatggattgaagcctgagtatatggattgtgtatatgaatacagggagggaagcagagtggtgaggtggaaagtagaaaattgaaagctttaaaggcaaaaccgagaagatgaaaactgcatgatactatccaaggaagcttgtcctcaggtctcacaaagtttatgatattactaactagaccctacaaaagaattggttaatttttgataaatggtcaaatattattaaaaattcattctagagtttaacaaagttttcagaacatctaggctcctcattctataggtatgggcatgaaaatcacagcttccccaaagtcacatctatgtatatcatcaatagaagaggtagggtctagaaatgaaggaccttgaatcctctgtttctcccacttgtgctgctttccctcccaacagagcatcaatcatcacaattgccactttgtaaagagaatagttgcaaagctataagcagtaagaattttaaaagaaaaatgaagaaaggtgataccatttaactgtttctagttgccaagagaaagagtgagaaagaatatttacttcttccacaataaaagtttaattaggttaaggaagatgagaaaagatgagaccaggaagctatttgctccatcaaaacatagacaggctgccttgaactcttcagtttttgccacatcagggtttactggtgcataattacaggtccttgccaaatgtcatcaatccatattttctgttctaatttgagttgatcctgttatgaagaggatgtctctagcgcacgagagaaacaggaaaagacagatttttaaggcgaattttaaagcaagtagtaatctcagtttatttctcttgcttttttttttttggctttttctcagtttcatttaaaaatagtaagaacaagaactttaattagatttatgtatgaaagctacacttaggcagtttaagtctgattattttctttagcaatatcaaaattgttatggtatattacattatgaaacattcaacaatataattattaaaatattcctactgcttatcatgcctatagggctttaaagcaattatgttatttagggcaagagatctaattgcctgggttgccttggacagaaaccacagtttggtgatggagattattgctgaatcattgttatattttatgtctgtagtgtgagaaagtatcatgaagataagtttaacatatttctacataagaagacagtaaatgtttcctcaaactcagcacggttcccctgatagggcattttctgatatatttatgagacaagtatgactcatctaaagtttagcagtcacaatggtgtgcagatatggccatgtcacctctttttaactgttccccaaatatgtagctggctccagtgtcaatgttgtgtttgaaacctgctcagtcatatttatatcctcctatctttatagttcagagcagagaaattcatggttctgattcacagggattactgttttgttacaatgttcaaataatggtccgctaaaaatcttcctgcaacagaaagaagtccactcttctaccatcaaggtcattactgaaatcaatgccttcagtttaaaagcacagagatgccatctagcagccgccctcagaaattccctacacagaaatagttctttccctataaaattgagcaataattgaattcctacaggctttcggtgtttgaaattttgcttacagaatgatgatttggcatgtcgtctataattcaaacactccattacaaatgaaattaattgacatctcttaaaataggcagtgatatacatctgagtttttctaaaaagaactggaaacttactaattatactttaattaatagaaagtatttcaaacaaatttcctaaaagaaaaattgatcatctgtccctataaaaatacaaataattaattagtgtggattgccttcctttgttggaaaagaataccaatcttgccaattttttgatacagtaaatgagagaaaagaaactaagtacatgctgaaactaagctcagtctatgaacaatgaatcttggccatttttaaaaacctgaaaacaatactgactttcaagtaacttatcttaccataagatggcgatacttaagcactttataaaatgccatataagacctgtaagcttcagcgacagaaaaaaaaaaaaaagacacacaccgcattataaatgtaaacattatatagtcttccatgaaatagaattggcactgttgttagaaaacccagttgtcttcaggtaaactaatatataagaagtactttctaagatgtagatttccagtatttgatatatgtaaaatcctatacctaaaaaaaatctattcaattttaagagctttcccattttgccagtttctgtttatccatgtgaggtatatatattatatacatatataaaataaacaaagtataacaatatagaataatacttaaaattatttgaaaatttgatgatgacccatatcactccaaatgtattagtatgcaaaaaggcagttggttagcatttctgttcatttaagtgttatcacaaattatttcttatttgtccaaaaactgtattttttgtagtactatattattggatttttaattttaatttcaccatatataatttgctttatgaatcctgacttttaaaatctaagcccttaagtaactagtagaatgaaaaataaaattttacaaaattcttagtttataacctaattgacaattcttttgaggacacaatggtgccatctgtaattttttgggggggagcaatataaatatatattatataaatataaatatataatattaatacaaaagtagcttctcttcattttttaaagcaatgttttgtctaaaagtcctaaaactttttacaacattaaaattacttgttttgaaagttttaatattctctgtaatgtctatgatatagaacaaatatcgtcttttaaaaaaatcatcttttgttctttgcacactgtattgcagtatgtggaagctgagaaggacagtttgaaaagttaatgtatgccttccctggatttttcagctcatttgtagcaaatatccacagctcattctgaagaaagtaaaaagttttgtagcattgaatacacacaaataaactcaccaaaactagaaaagattatattgaccaaagatgcattgcttattttaaaaatgtcttcatatttaacagaaaattatctacatatttaattttggaaagaaaggggtgcaagcagtgaagatatttatgcatcaaagataacagacaaatcaaatcacacacaaaattgttaatgaagctctacatttctgaatttattttaaagaaaaacaaataaaactcactttaagtcaagtgactttttctgcagtaacttagtgattaactttgcttttagaaaatgttttaccaagaatattcccaaatcatatggaatgtattcaaaagttttaaacaatatcatataaaaagagtggcagtggatagaatgtgtcactacagggtgcagagtcaagaagaaaaaaaattaaatataaaaacaaaatcaacactttttcctaagtgtaaaatgctttaaagctacaccttagtatataaaatatgcctttaagattattaagatgacattcacacagagtgaagcgtttacatcaataataccagtacaatcaaagctttaaaataaaatgaatttattctcatcaggtccttctaaatatgaaagagtacagaaataattacaaatatatacgacatgattctaagttttaactgtatactatattaggcctacaaatatcacaaccacagtattaaattatgcttggttacatcttagttctattcagtaatgaaaggaaacttaatttgtctacactacacacatgatgtaaagctttaaaaataactttataatattccaaaatatagcttgtattagttttatagcatggaatcattcttcctatattgtcaaattgctgttggccagttaaataagtaaaataataaattgtatctcttactctttttcaccaggtggcttatctcttattccctgtcattatgattttcttagaaggctgaagctttcaaattatctcactttgtcatcaagacttttctcagacatcgttgaaaatatttgtccatattttcctgtctttttatcaaaggagtttagcgttcactttcattgccagtactagataattttcagagttcaacgtctatgagttaactcatccttcctattgccctccttagtttgttaaggttctcacttcctgtttcttaacactgataatcagaacttcctcagtgccccctaattttcttaatgaaaaggaagaaacaaacacaagctcctttcaccaacgcctctcagccatggcagagagtatagctctgctgctctgccatgtgttttacaagcagcatcccaaatgttttggacacaaaccgcagcacgtctgcgatgggagtattattgaccaggatcagctggaaaacgcttccctgctttcaacaaagaaacggttcaccatgtcctaatacatgtttataaattgcattgtttctactgcaaactcctttgcattacccgtccgacttcaaaagagagcattaagcagttggacacggaataagctaaattccccggagagccgcattgcccgctgcccatgcacattatattttctcctagtccctccccccgcgcagtaggactctaccttgaggagctattcctccggtagttcaccttgttatgttccaagcagtggggatacgccagacaccataaggtagctgaaagagctgtctctcgtcccgtttttgacatatttatttgcatttctgttaggtttgttacatattgcacatttatttcaaacaagactcaaaatattgttcataccttggaaggatctaatccggcaaacaaagacagcagcaggaggttgagaaggttggacgtcgcctgcattctgatctgggtttttgcccctctttactctcttttatgtaggctctccactcactgcagagacctttccctcgtcagttgcactttctgcctgccagtcagagccgagtggaagcagaggcggcggcagcagcagtagcaataacagcagcagcggcagcggcggcagccgccctggggggcgatcattccgcaggcattctcagagctaggagtccgggagctctagagagtgggttgggctgcagtgggcgctggccgcggtgctgaagcgcctccaacccgcgcgccccagtttaccctctcccccgctgctatatagctagcccacctcaaaagttttgacccaaggaatagataaagggattaactgctgagagaggtgtggagacctggacaacggatatgacatcactacagctcctgggggtttcggggggatattttgcggggaatttgttaaccaaacaaggattgactctcgtgctccagttcagcatttgccggcaacttgagctgcagagaagtaaagagtcagctaaatacaggattatgaaacaaatagtgcactagaaccttctgctgtcattgacagaggacttgatattgtatttagtgctttaaacaaagtttgcagtgcagactatcagtgtgtgtcatccaaggcacacgattttcagctgttattgatagatgaatgtggtaatttatagatatgtgcagtcatttatgaatagcttattaaagttatatgttttggttaggtattaatgtgtatctatctatctagggatttggtcatctaaaaacactatgcataaataaataaagaggcttatattcttcttttagttataaatggtatattccattagtgatccccccagctgaaatatcccccccatatgcacagccatacctggaaatatagtttttctatcagtctgacttgtgtttttacttgaagaagaattcactgatagatggatagcgggatgggaagagtgtttatttctaagctttcaaacacttctgtaatctagggctcaagaaaaggcagaatagctgcctcacaagagcaaagaaagggtaaatggcaaactctcttaccctgcatcattcaaccttactggagcaatttcatttctttgaatatggaaaaagtgttctcaataatataaaaaggaagaagttggtagccaccctgaaacatccctctcgtacaattatgcctgtaatatttccatcttctattgatttttctagaaattataattcctaagggttaaaatatatagatagactgggtctgtggacattgcttccttttacttcgacatttaaaagacaatgaattgagatatcagacacataccgagtatgaaatctccatcaacctttcactgaaaatatatcctattttttaatataagaaatctcaattaggactcaaatgcatttgaaagttattgtccccaagaatttacatcatattgcatctgttttaatcctaatattataaatgtgtgtatagttacttgaggtctttattttctataaacataaatggcatgaagttcactacatctgataattctttttgaaggagtggatcatacaaaatagagattgcaaaatcatagaaagaaagtgaaattacttataatggtgttaatttaataatcttaacagccataaccatatttagaagtttccattattttgaggtaatagataaaactatagagttgtaccactctctggggtaacttcctagaacatatttgtcagagtttttttctttttacatttgcttcttaacctaaacttttctacctatcaacatctacatacttatctatctatgtaggataaaatcagcataatttttaaaaaatcacacatagaaattgttgaaaattctgcatccatttttaaatatttcacatgactgtgcagattgaaaatgaatttgcagaggtgtgttggctgaatgattataataatacatttttattatccattctctaaatacattttttgttatttgtatttacacatgcttttccctcttcccaagaagtcttctaccatcttttttacatctctacctctcaattagcagacagtagtacattatacttgtttgagtagaggaagctgtatttaacagacacacacagtaatatgaaaatataataatatcaattttatcacttcaagataaacagatattcttataatgaaaataatgttttttttctggaaacagaattattctgatctcatacatggtttacaatattagtgactgtaccaaaacttttatgtgggcacagttttttttctctttaactctccttttttatggcactggaatgtcatttgtaacaagaagttaataagaaggcaaattctaattctatgaaatcttgtcagaaaaaatgtgatggaagaagatgataatatttagagatccaaaataagtaatatatggtaattatgttacaaatgaaaacagatgatcttagcaaacttacaacatattttccataagagaagcttagtcatttgtagagaataatcaagttcagtaatgaatcaaagctgtattaaacatgccactgaaaaacacaagctgtaatctaaacagtataaattcaccaatactctactacttcctctatctctcttctaaaataaaacaatacagttgcatagcttctcttaaagataactattggttttagttagtcatttgcttagaaataaaaccctcttataatatatttccatacagtcaatttaacaacattgtaggtaacatcatatcttattcatacattgcaatccatggagcatttctcattgcaagaaagaaattccaagtagttctttgtatcttgtgtcttgcattagctagtcaaaagagttctactaaaagtaataaatggtgcatctttttgcttttgtttttactgtcacttcagatttgtaactgtagttaactgaaaacaaaattatacataattatatataacataacaaaattatacataacagatttagaaatcttgcatttttgaatgcatgcataacaaagtatttgatagttatgtgtctagtcaaagttggccttcttaagcttatatgaagttgtggtacaatacaacacctagaacaaatgatacaaatttttaaaatatttgtgccttatgttacaaaagttcttaattctatatttgattatagtgttagctaaatgttttatgcatttaattttcttttgataagagactgtatgatatacagttgacgtttgaataatgtaggtattagcagtgttgaccctctgcatagttgaaaatttaaaaataatttttgactcccccaaatttactactaatagcctaactcttgacccaaaaccttatgataacataaatagttaatgcatttttttgtgttatatgtgttatatactgcattcttatgataaaactagagaaaaaatgtgattaagaaaatgagagaatatatttactattgattaagtgaaattgaatagtcgtaaccatcctcatccttgtcatcatcatgttgagtagactgaggaagaggaagaaaaggatgggttgatcttgctgtctcaggggtggcagaggcagaaaagatgtaagagatgggaagggagacaggagatgcaggcactattagtgtaagtttacagaaatacattgtaatttctgttgactttttactattttctctaaacatgtttatttttaataagttgactatgtagtactgatctttctttcatcatttgcttttatttcagtgcccatatcatagaagtgtccatgtcacaaaagaagtcaaaagtagtctggaataattggaatctttccactagattgtctaatgtcaatttgttttctggcactgtgtcttctatgtcttcctcctcattgtcttggcattggtttggaggtactcatctccatcaagtcaccttcttttaattcctctgatgcagtacctattagctcttgaatttctttaagattgataccttgaaacctttcaccccttactttcttttgctatatctacagtatctttcacggtttccttaattgtctctgtcgtaaatcctgtgaagtcatgaacaacatctggacacagttttctccagcaggaatttcttgttgtgtgcttgatggccttcaaagctttttctataacaacaatggcatctttaatggcataagccttctaaactttgatcaagttctctctatggaagttctcttcgataatgttgaaaatcctttctatagagtacatgtgtaatggagacttaaaggtccttatgatcccctaatctaatggctgaaaaagagacatgtttgggagcaagtggaccacttggatgttttcagtgttaaacttttggggttctgggtgaccagagacattgttcgatatcaagagaactttttaaaaaggagtccttactgacaaggtacttcctgtcttcaggggcaaggcatcgatggaaccagtccataaaagggattctcattgcccaggtcctcttggtgcacaaccaaaagactggcagctggtgtttatgttttccattcaaggctatgtggttagcagctttatagataaaggcagacctgatcataaacccgactgcatttgcacacaacggtagagttagcttatcctttcctgccttaaatcccagtgttcccttcccttccttattaataaatgtcctttgtggcattttttcccccagagcagggcatttctgtctgtgttaaaaactggctcaggaagatatccttttctctcaataattttcttaagggtgtctggaaagttgtctgttgcttcttggtcaacaggagctgcttctcttcttatcctgaatttttttttcaagccaaacctctttccaaccttatcaaaccatcttttgctggcattatattgtttagctttagatccttcacctttcttttgcttcaaactgttatataataacttcgctttttctggaatcacattagagtctataggtatgcctttcttacaggaaatcttatatgtacacaaaagttatttggcaaaatatgtgcatgctgacgtagctgcaatgatggcttcaaacatttccttttcttgtttttataatcatccttacattgaattcatttatgttaaaataatgggcagccactgcttcagacctcaagctatggtacaacgttttcttgtaatgtcatgaattttctttgcttcttggaaggacttccagcattgctagtggcacttcatacaaatgccataatgttattcaagggtattgtatagagtgttttactaaacattatgaaaagtacacgagaaccacaagagtcacttttcactgtgacatgcaatttactagatagacaaaaggctcactggagattagtgtcaagtggatactggaaactcttgagctcactgtaatagcaataggaggtggctacaacattattacagtagtacaatatgtaatacagttaaattaatgcagttatgatttaatactgcatctttatattgtttatatttcttggtattacaaatggcaccacttacagtctgttcgtttgtgcaagttttgataaattttaactttttaataatttatttgtgtatatttcatcatagtaaatgataaaataggctagtatctacatatattttatgcactcatgacatagctcattttttcttaactctgtcaatttttctaggctatgcagttggtctgaattttttaaattgttgcaaatttacaaaaatgtttccaatatatttattgaaaaacatctgtgtataaatgtacctgtgtagtaccaacttcagttgtccaagggccaactgtactttttctcatacattttatacttcctcagcttttcagagatattccattatgttaaaaaatgctgttccttattttggtttcatctataatttatcatggagagacctagttagtttagaataaaaataacaataactaagcatgtaatataaactccttgagcaactcttcatctttcattatgtagatgaaaattgcccttgattcatttcctaatgtctgtgacctgtcagaggactgccaggatttcatttcctgcctgctgctcttctactctctttcatggtgacttttcttcctgcctgcttttaagccattttcatctagatcccctacctctcctaaataccctatcaaaaataataccccaattattctctatttatgtttatgtcatttatttaatgtctgtttctcttattaaaatgtattctatgaagggtctttgtctgtatggtgttctaccttaattcaagcatctagaacagtgtccagcacctagcagtcacttaataatggtttcatcaataaatgaatgaatgattgaatttttcaaccttaatttcttcatgaatatttatatacccaagatttactagatgtcactatgtaatttcttccatcgcaaactcagtatttcaaatgaatatctttcctaaatcgtattagtttgtgacacaattttctccccattgcaaagcatgaagcatggaaatcacacttaacttctccctcattttatctcttcattcaatggatcaacaatactgttaattttatctctagaatatctctaaatctatcctattgctccacatacacctaggtcaggatcttattaatgtcatttgaagtattaaaatggtttatttccttgccttgccaccagtttttgtttttttgtttgtttgtttttacttctattttcaacttgcaatttgtttgccacaaaggacttaattgatttaaagactaattttatcttattggtctcagattaaaggccttcaatggcttcctaacttctgcgtgatcaagtgtggagtccttaaaatggttcatgcagacttttgcatgatatggcccctgccttccaatccagtctcatttctaaccattgtcaactaataattggaatccggcaaatgtttggtaattgtacgtcttttaactctgttttactgtgagattaatagttcttcttttgcctaaaaagttcttattctgcatttgaatttcactttaaatgccatctcttctctttatttgacccttggtatcctccctcaaggtgtctcttctcatcatgttttctaatgtcttgtgtatgctttcatcattgtatttactatgcttgattattaaaatctacttttttgtctttcttcacttgattgtaaagcttttgaggatatttaagttatcaattgctctataactaaccattccaaaatttaatagtttaaaataaaaaatatattattaatggtcataattttgctacaatttcttacttaggattttgtatacagttacagtcagatagaaggctatacttgactagatattcaagatggctcactcccatggctacggttgacactggttgtaagctaggagcccaggtggcattattgagtggatcacctctgtgtcatctttctgtgttgcttgaatgtcttacaatatggcagctaggttttcagagagcatcttaagagctagtattctaaaagacctaggcagaaactgcgagaattcttatgacttatactgaaaaatcacattatgacctacattcagaattcatggccgggcatggtggctcacacctgcaatcccagcactttaggaggctgaggtggacagatcacttgagcccaggagttcaagaccagcttaataacagtgaaaccccatctctacaaaaaatgcaaaaataaaaaaattagccaggcatgttggcacacggctgtagtcccagctactcgggaggttcaggtgggaggatcacctgagcccaggaggtccaggctgcagtgagctgtggtcttaccactgaactctggcctaggcaatagagcaacagagtgagtccctgtctcaaaaaaataaaaataaaaaataagaaggcaagtatttatatcgcttttttttttcttaagcaagtaactaaaacaagaccagatgtaagagaaaagtaattggactttatctctcaatgtaaagcacagccatgtgcatacagggagggaagaaactgagggcagccatatttgaaattatataacaaaagggattatttcacacactcatttaaaaatatccatgtttccctcaccaatcactaacctagctgagttgtattttaaaggtggattttgatttgcgtatactttggcagtatatgcagcttttttttactaaaacaatttagtaaaaattagtaagaaattaagttaaatatatatatttaaatatgtatatttacaaatatatatttaaatacatatatatatttacaaataaacaccaatattacaaaggacttgtgcttctagtaatgcaaggctaaataatttggaccaagtctcttactgagaatgactttaagaaccagaaaaaatatgtaaatacaactgcttgaaggcattggataacagcaatgtcggtgatgaaatatgggatcaaggtctgagagagcagagaaataagaagacagcctggcttttaggacctcttttccattaagagtggctatcatcttcagaagaagctacctaaagactgagaaacttattggagcctctgacctcacagggctaggggaacacaaattagaattccaggttttttgcctaagtaagagccctgtccccactccccctcttcttaatttgagtagagatgtttaagtgctaaacacctgtaagtgagggtgaaatcaaaataaaacagtcttcacaggggcttttatgaccagcttctgatcatctctttccctgacactatagtaagatgatctggaattcctagtaaccctagacttctgaaaaaggtgatctgacagaggttaagggagatgttattgcctggaagagagcaaaagttggttttggagggaagaaaaaatttatactgtataatattttgtggcccttctgaagcttcacattatacaacaaaatcttatttcttagtgcttaattacagttgttaagaggaatttaaacttaatttattcttctcctgggcagagcaaaaatgaagttgaaaaccactggtttatagtcagccctaaggggtcctgcaggcttttcagggatggagatggaagaagagcaaagtgaattttaaaaagactaaactgtattaagaaaaagctagccaaggaggcatccatggttcctgagttctacttcatataaacttgatgaaaagaattaagatatgtttgtattattttttgaaccctggataattccataattatttaacagattttgtttctggatatgaattgtacctggatggatttttagacattgtgggcattaattaaataagcaaatcaaatcactacttatttaagcgtctgttctgtacagagcattatgttgtggatgatacaaagacctcaacattttttttatttttaccttttgtgggtacataataggtgtacatatttatggggtacataagatattttggtatacgcaagcaatgtataataatcatatcatgaaaaatttgttattcatctcttcaggcatttctccttgtgttatgaacaatccaattatactcttatctgtttattaatgtgcaattaaattattattggccacaatctccttgtgccatcaaatactaggttttatacattctttttatttttcttggtacccactaatcaacccctcctctcccctacccctcacactacccttcccagcctctcataaccattcttttttctgtatttccatgagttctattgtcttgacttttagattctacaaataagtgagaatgtgatatgtttgtctttctgtgcctggcttatttcacttaacataatgacctccagttccatccatattgttgcaaatgacagaatctcattattttttatggctgaatagtactccatggtatatatgtaccacattatctttatccatttgtctgttgatggacacttaggttgattccaa

SEQ ID NO: 1302 - DNA, 451392 bp, Homo sapiens
tggggaactgattgcattccaggccttctgccctggaaggggtctgccctatcaccaacatcctcacccctacatgattcagcaggctcttcactcttgactcacagtggtaaaactccacccctttttactcataacctctgcctgggctcactcccttgatctgaattaatatactctcataaagctacttctttttttcttcagaggaataactgaagtcctcatccatcccccgtggctttctacttgatcagtgtccccctatcaactttctgacccactgtcatccgcagcccccacctctctagctgcataccacttgggtttctcagaaaagctcaaaggacgaggcttcaccctttatgctactgaattccatttatctccttattactcaccgtccacacctatgatcattgactgatttaaaatctccccacctcccccagtcacttttcataccagacataaacaccagtgcgtaatagctgcctacccagcccagttagaagctcccaattcctcagagtggcctgaggcagaatagtgtccctaaggtcatctcagcttctagatcccaagtctgattctctttccttgccttctcactcatctgctaagcttgtttattgggcaacactaagcaaagttaatgattattccagtctttaactaggacgtgagaagctctctccccatcttcacccatttctgtgaagctttcagggactatgggcctcgcactgatagcacctccccaggctgggctggcccagacagtcgaagagtaggaccagccacttctcagcccagctgacatttggcagctttgtgattttggataagacatcttctcttgggaggtcagacaagatcaactcttccagctatgacattgcgtgaggcaatgaagaggggaaagtccatgaatggaaggtggaacttgattggatctgttttgtgggttcaggagaggtcctatcacaactcactggaggtaggcaaggtaggtgaagacttccatggaaacttctggctctggggtgcctgcttcactgatgattgagtgggcatcctaaagggtacacctctgtcaaagtaattcaaagtcctgctcatcattcagacttggcttgtcaggaatcaggtacacttggataacctagccttaattccattcaatttccttttatctcttagaaaaatatgattacagttgttcctcagtatccaagagggattggtttcaggactccctgcagataccaaaatctacagatgctcaagttccttataaaaaaaaatggtgtagtgttttatataatctagacacatcttcccatatactttaaatcatctccagattccttacaatacctaatacaatgtaaatgctttataaataggtgttatactatattgtttttatttgtattatgtttcattgttgtattgttggctttttaaaaatattttggatgcactgttggttgaattaccaaatgtagagtccacggagggctgactgcatttttaggcttataatgccaacatttctttgacaagttcactctgtgttatattaatttagctttcatctgcacaatcattagtaccatattcaatttataattcataaataataaagcatattaacaaatgcatatgctgtctctatggaaaagtaattacctaaaaatgttataaataatctgttttgattttaccctgcagaaagtcttcttaagaaacaatatattcaatgaaactacagtcacagttacagaagtcaaacgagcacactgggtctgtgatatttctacaacaggctttttcaacacctgttaatcagtcaatcagaggaaacctcaggggctgaagatacgccagcttggtggaaattccttcccaaaatagcaatagctgagcaaattgctaggctgacagaagtagagtatgcacagttcttgggattttgtgtgagacagcaactgtcttcgacggttggcattttatcaaagtttaaattctttggtccaacagctgatttcctcctttgtcatattctttcctatttgcttccccaggcagtgacagccatgtccttccacattagacttcttgggtaagcagcttctgaaattgttctacagctgttagtagctgtctggcagagaccactccatttgcaaggttgctgaatatcgctaagtatctccatgaggcatataaaatgcaaactttaagagaaacaaaatattgttcattttgatttaggtcaaataaatgtcaaagcctttctaaataactaattatcttggtagatttgccttttctttctagtagaggaaaaaaaaatcaccctatacagtttattgatgtcttcatacgtagtaaaatgtcaaaagcaactcagtttaaagcattaaaacttccagccatgcaaagagtcttaactttttttaagttatattcggacttcaaagactattgattttcttcctgtttcccttagcataatataatcggcatttttcctttaatataaacacatcagaaaaatcatattttatggctactttaaaattccatgagtttaagccattccataacatgcacatttagattgctttgattttttcttctataaataatacagaattaaatgtgtttttatgtaaagtgtttactgtagttaggattctgtccttggaacagatcagagagagagtggatcaaaggttatgacattttaaaagtagccagatgaaggtgaatgttcatacagtatatgcagaatatggttcgcttgtatatgggtctgatttgcaaatcagctcacaagagctgatccacagtagaggaaatctggtttaagatttttaaagtcagtaaagtttttttttattctccaaatagaaacatactgcattcaaaatttctttaattgattattctctattttatacccaaagacttaaaaaaattttactctctagtggattaaacaattaagaaaggtttttttaagattaaatggacttcaggctcatgaccggaattttttttttttttttttttttttcctttttgagaaatggagtcttattatgttacccaggctggcctcaaagtcctgggctcaagggatcctcctgcctcattctcccgcatagctgggactacagacaggtaccactgagcacagcaatttgatgataaatataatgcaaatacatacaaatttcaaacacaaaaagaaaaaaatgaaggtttcctttaatcttaccttccggatataataactagtatacgatgtgtttgtttcacttaatgctatatttgggatagcttatttctgtatcacctcttgttttagtaccttagaaaacacatttaaaaatcataattattgatagggaaaagtataaagagtaagaaacagtaacagtcaagataatctctgatgccattttttttctctgatgccatttttaaaataacaatacagcatgtatgttggagtcaacatacaaccctatttgcatcctagtcagaatgcattttctcaccaaaattaacctatcatcttcgaggaaaacttcaaaatgttttattcatatgtcaggaaagagagagaaattataaaaatagatataagtatacatacaaatatgatgatgctctaacacactctcatgtatactctttttatcctaaatctatcttgaatatatttctatgactacatacatatttatccattccactatgattttttttccaattcatgtgagccaaaagaacttcaatttgctgaatgaagtgaaataggaatccagttttttaataatgagggggaagtcagtggaactgaacaaggccaagaaataaatcaaaacgtatgtagttatttaatatatgctgccaattcaaaataatgttctttccatacaagaataaaatatgtcattttattcatccattcctccattccttgtatcgccataagaaatctgttagtactccagtagcaatgaagggctactcctctgcccttagcgttccttttcacacaatcttcctagatattttgccatgctaatttgtctaggtaaattttgtgtcagtttttctaagtccagcaaaaaatgctactttattttttatttttgtttttattttttagaaagaagactttgctctgccacccagaatggagtgtgcagtggcacaatcatggctcactgcagcctgaaactcttgggctcaagcgatcctcccgcctcagcctcccaagtggctgagactacaggaacacaccaccacacctggctaaattttttaatttttctagagacaaggtctcactatattgcccaggctgatcttgaactcctggcctcaagcaattctccttcctcagcctcctaaagtgttgggattacaagtgtgaaccgctgtacctggcaaaaatgctattttaattgagattatatgacagttgtagattattttgataaagaactgattacattacaaaatcaattcttcctatataagaacgggatatagcattccatttatttcgttatttcattcctttctcttctttagtatacattaaaacctgcatattagttgttagtattccttggtgttttatctcattactatatattgcatcatatgtgtgtatggataaatgtgtgtatgtatacacagtcacacatgcacctataccttaaaatataatgttaaagtagaaccattctcttcacttctcacaaaagttttttttttccattgggactagacattgaattttgtctgaagactcactaacaatatatggagctgaccatatggcttttttcttttgagtttcttttgaagaattaaatactagaagtttggatgttaagccaacttttatgacttggctaaaacccaattgtccaaagtgtattattcttttaatacattgttggcttttatttattactatttttttcaaattttattttactattcaaaacaccaatgtgcactcgtctgtcttcattcaattttatattactgaataatgacataatgataaaaggataatataatgatataatgatgttattctgtctttgtaaattccaagacttattttatttgcttaaattcaataaaatctgcttttgaaattaattttactggctttttcaccctaaataatacttgtctctacatttggacccttgtaaggcagatagaaaatgagattatttctaaggatcataatagctaactgtaccccaatactcgtatacagacatagattttgtttccagactatctcaattctacttctattacctatcatcataagattatgtttctctcttcatttttgtgcatatgcacaagttagcaaacatcccaagtagcagaaacatgtgaccaaaagatcacccacaggctcaggctacatttatgcagatttaatcacagttcataaaatcgagctcatgagggacaaatctggagttccctgctacgtacagatagatataccagtttaatcagacaagtctttggggccatacctgattctgtgacatgtacacaagccagatacaaagtatgaggaagaagtagaaagactggtcgtggcttgaaagacacttgttcccaggatccccagatggaccattgggacaattctgcaagtgtttcatgcctccaattttagtgtgttccttgatcagccttctcaattaccattttctcacatgctccgtgatccttgtttcctggtggttgacgctgggaatgaagagaggaataaaagtgaaaagggagtaagtagacttgtttcttgaaacttaggattttcaaacttcctggatcgtaagaaaaagaaaacgtccaagggggatgaatgagcaagtctgctgcattcctttgcacacccctttcatcaaggaaactttgaatacctttactttttctattggctgcccaagagtttgtatctcctaaaacaaagtttgtaaaccagtatcctcgattgacctgaacctgggaggcagactgatagataatctcaaaacagagtgatctacagcctggaaattctggtgaagaagaaaaatcagtgtatgagagagctagaggaagaaagtttacagtcaaataacatgtttgaacgtgcagttgtgaaaacagagcatgccccaatgtggctataggactgatgggttaaagggaatagaggtgtggtagccaactgccaagatgaccaccaatgcattgtcttgccaactggtttttacgcctctatgcagtctcctcccacagtggatactgccaatttgtataactaaaggatactgcgggaaagacgaaatatgacctccaaggctggatcataaaagatataatggggccgggcgcggtggctcacacctgtaatcccaaaactatgggaggctgaggtgggtggatcacctgaggtcaggagtttgtgaccagcctggccaacatggtgaaaccccatctctactaaaaatacaaaaaaatatctgggcgtggtggtgggcacctgtaatcccagctacttgggaggctgaggcaggagaatcacttgaacccaggaggtggaggttgcagtgagctgaggtcatgccactgcactccagcaacaagagcaaaactccactttaaaaaaaaagacattgtggcacaatccagctgccatgaagctaggaaactcaggcagtgacacagagaagtcaacagggttccagccaataacaggactaactttccaggcacgtgagtgagctgccttggaagcagattttccagccccagccatgcttccacctgaaagaagctggggcaacatcttcagtactatctcatgataccctgatctggaattacccagctaagactaatggattcctgacacatagaaactgtgtgaaataacaaatatatattgttttaagacattaatttttgcagtaatttgttatgaagcagtagataagttatatctgattttggaggtggaggaggtctgtttgtgtgatctgtaagaggaacagagatgaagattcatagagaaaagcaggtccaaaaccaatatgccaacatatagaatagacaaatgggtgctgagtcacccagaataatggcagggtgtggagtgaagaagagaaccaagagcccaactagatccaaagtcttaattttaaaaagtgggatggaggatggttgatgcaaatataagtgcttcaaaagagcaggaatttctataagaagaagtaatcatttgaaagctgaactggagccccatgaaggagccacagactccctttcccaaccttcgtgcacacagaaatgggctctggtggaaaatatgaaagtgcatgagaaatgatattactgtccacacactaatctcatccttaatatcaactggaccttgctatactaacttaagagtgttgatcaaactttctaaatttttttgatgccaattttctaaggaaaagaacttcttataagatttttaaaacaagcttggtttgctgcactatttgcaatacacacacaaaaaggtcacatttctgtgtccttttgagtaaagtcatatccatctttgaagcctctctcaggaccacaagctgtttttttttcttttttcttcttatggcttcatcacttcactggtgttataccaggatttaggaaccaagcaatccaaagaaatgtgggagaggcctcgtctggccagtagtccaacatgattgcctctggaattcaccatgagactcacagttcaccagaaggcagaggcaaaaatcagagttgccaattaaaattatttctaaagatgggttcactgcttcctattcccaagcctttctgagactccatggggtgaatcacttgcttcttttctgtatctcctcctgcaggcatttaagctttgtaatttagttacatgcatacttatatttatctctttccaacaattttgttcatttctgatatcttctattgtcttccctcccaatttctgcccttttcagtttttactattatcttgtggttttaggaaaaagcagatataaatatgtgtttaagcaatgctatggtttgaaggtttttgtccccttcaaaatttttgttgattcctaatcccctatgcaacagtatcaggaggtgtaacgtttagaaggtgattcaggaggactcctcatgaatgggatttgatgcccttagggcttgatggaggaagtttgaccccctcttgcccttccaccttctgccatgtgaggacacagtgctcaaggcatcactgtggaagcagagacaggaacttcaccagacaacaaacctgctggcaccttgatcttagacttcccagcctccagaactatgagaaatcaatttctgttctttgtaaattacccagtctgtggcattttgttataatgacacaaactaagacaatcaatcagagttatatttccttgtaagtataaattttatttttttatttttatttttattttttttaagaaggagtctcgctctgtcacccaggctggagtgcagtgatgggatctcggctcactgcaagctccgcctcccgggttcacaccattctcctgcctcagcctcccaagtggctgggactacaggcacccgccaccacgcccagctaattttttgtatttttagtagagagggggtttcactgtgttagccaggatggtctcaatctcctgacctcatgatccacccacctcggcctcccaaagtactgcaattacaggcataagccaccacgcccagccgtaagtataaattttaaaatcacttcttaattaatataatagatgaaatgacccacagaagtatccactcacagaaaggaccatttctaaaggaccagtttggcctataaagaaaatacaatagcagaccttcacaaattttctaacatcagaaaagaaaaaatatttagatattaaactgaatcaaatgtgatggtcttacccagacaaaggaagactcagcaccccatttccaagttaactgggagcttttgtgttgctctttttgccccccttatatttgattctgctacctgacctttaaacagaaaagctttctcttcttgctatctatgtttgttatttaaaagatcaaaatattaaactcttgctatatctatttgtcatttgaaagatcaaaatattaaatgattgtgaaacattttttgcaactgtaagagggttgatacttttcctgaatattattcattcaacattcatttatttctttgacaaatatttaagagatgctcatgatgtcctaggcattgagctaagaactcaatgttgcaatgtggataagatccagtccctgtgtgttcatacttatttaatactattatagacaaggcctttaatacataccatagtcatatatcaatttttaattagcaatatgaaataagagaacaatgggactttccactcaatttgacaggtggctaaattttcagttactgaatttactattttagggtaatctagcacatgaccaaaatttaaatgcacagaacagaagatcagagtaagaagagcttccatttggattatcactttttctacttggagtcacatactgtactttaaattgattaagaacatgttaaaggtccaggtggtgatttccagctacaagtccaaagtatagaagaatgtgtttaaatcctacgtttatcagatccataaatatagttccttctatgttaagtggctttatttctaagaacccagccctcggtcctgggggtgcttcccagcccgctgctggaattcctgatcgtggcagtctgctgaaacatgagctcagttaccaaatatagctgagtggagtaagaggacagatgagagtctgaggccacagttgcctcaaagtgaccacggaccaggcagtctctaatgaataggcaaggccacaacctccattctcccagaaaagaagaaatgctcatctgaaattcatcacctctctggagtcttcaaactgaccaagcattgaaaaggtctgtaaggtgtatcttaatatactaactagtagggcaacattttaaggacttaaaaaaaaaaaaactaaaaatacaaaagtttttctgaagatatgatactatttacaagataccttaattattcttttgcttggagaggaaacgtaatgagaatgttacggttttgccaaaaacagataatacgtaagatttgcctgcccacttcatctctgcctttgctgtcagagaattacactttctgttataagcttaagcatgctaagatggtgctatcaattccaaaaggattaaatgtatttatggagccagcttttgtcaagatcgtgtatgtgttatgtttcacagaaaaggaaaacgcagctttctagaccctcacccatatttaagctagataagtgatgatggcttaaagtgatagaccttagatttcagtaacattataaattgttaattacactttcaaaagattctaaaagtaactcactggacataattaaatgagttgggatagtaacagcaggtattttaaattatattcatgcataaaatttacatacatatttttaataagataacgcttactaagggaaaccacagtgcaatctcgagtccagtcaagtttaaacatcacagaataatttttatcatgttgttttaagttgcacatgaaattgtcttgaatccaatataggaggttgacataaaatgatttcaggctcatattacttattaacatttgctaaaaatactaattgccttctagtatgaataatgtggtgacatataaagccatttcttggcaatataaaactattacaaatctattcaatcacatatatgcagaaattaaatcctcatttcatgataaatgtgccttccaatgttttttctcacagaaagaacttgaatactcacctcaattattcagatttttttttcagatttttaaaatcaaagtctctttgacaagttattgctaacagcagaaaaggccgatgaggtttatctggccactaactgccctgtaaatacatgattacacattcctagaatataaattagtcctctggcatcctagaatctggtatggattagggtctgtatcccaggggttctgtgtcagctcttcctctgggtttctctgttattgctagagctgaatattaaaactggccttatagcatatttcacaatagaatgaggatctggattgcactggacaagtacaatcactttgacctccttacctcattttttaaaaatgtagagggcaatcattattcaggtttaaaaataaatatgacaagttctttaagagataccaagtggaatctgcaaggcccagacaagagctccacttcttaaacaatatgtgtgtggaggctgtcaaagggtattgcaattactgagctccagttagaaattcaggccatctagagttaatgactgtgtcccggtgaaattacagcaaagaaaacaaagattgaacaaagtatcttcgactaaaatttctaactgttaaatcatattagagaatatagaagcaaatttggtaaataggttttgaatttaagtgagaagaataaagccctgaattggataatggtaatggaaatggataattcagaagtaaaatctaaatatttgcaatggactcagtatggtgaataaagttgataagatgaacaggacatgggataacttcaaaaactctgtaaagtatcttatttggctgtttctgcattaaatgagctattagattatgtccttgaaattgagattaaataagctgtttaaagagatatttaaaactgtaggataaatatatctgcctgcattgacaatttaataattagaaaggaaaataatccatgtgtatttattaagaaataaattataaaattgtagtgcattttctgcatcaaacataaaatttcataaaattttcgtgtttgacttttgccctaaaggaccctttgtagcaaaaaaaaaaaaaaaaaaaaaaaaaaggaaggaagaaagaaagggagacggggaagaaggaagggagaagggagggaggaagggagggaggatgggagggaggatgggagggaggatgggagggaggaagggagggagacatggaagaagggggaagggaggcagaagggagggaggggggagggaggaagggagggactttattgatttagtctaggggggttgcctgtgattctgaagcatgaaaattaagtgttaaagcttttctaactttggttttcatagtttaggttttattaaaagatatttcaatatctaatatttgtatcaatggtttgcattacttttttagtaattgcttaaatatgaaaataaaactgctaaacctaaaattaaaaatcacttataactttttttcaaaaattacaaaataagcaacaaaagatccccctgcatgtcccacctttcaactcctacccctgcctaaatccccccacagaggtcagtgttgattgtttggtgtatgttattccaaccattttcatatatttattcctatctatgtatacatttttaaatgactatgggaatttagctattccacctggactctctaaagaatctgctgaatgtggtacatggtattaagtgatccttactgcctgtcaatgtttttctaacatcaaactttttctttcaaaattgtagcagttcttcatcgactcaaagtatttcacaaacagacttcaaaagttttccccttatctaaatttttaaagtaatttcctataatatctccaatgagagaagaaaactttgcagttaaatgcaggcttccaccctgagtctgccactttctgatggctcaggttgggccaaataattgaaactttttctgctgcagttgtgggtaatacaaacaataaaatagaaaaataacatctactacatggattgttctgaggatcaaactgttcacttttgaaagcaggtaacttccaagctgttatgtaggaacaacttgcattgtcactgaattctttctacttactagactctgctctttctcatgtatattccttgtcttccccaagttcctccacgtcaaagaaatctgttgtaatttcaacagtcaatagtgccttgattcatggggatcatgccagggggtggtcccataagtcttgtttgtttgttttttgagtcagggtctcactcttttgcccaagctggaatgcagtgacctgatcatcgctcactgcagcctagaactcttggactcagacaatcctcccacctcagcctctggagtagctggggctacaggcacacaccatcacactcagctaagtttttgggtttttttttgtatttttgtagagatgaaatctaactatgttgcccaggctggtattgaactcctgggctcaagcgatcttcctgcctcagcctccaacagtgctgggagtacagatgtgagccaccatgcccagccccctataaatatttcttaactgacaacatagaggattctcccaaatatcatagagctggctttcaggtaatctatccccaaaagtcagcaactttaaaggcaaatggtagtcataatttttaaatttgtctattttttctatcatttgtatattcatatatgaatgtgaaccatatacatttatgcctatagtacatattcaggatctaaaaaataaatgttttgccaaatattaggatagtcatgccaagataagattcacaaaattacttatgtcaaatgtgtaatatacataccaatgaaaacttatttatatgttctatattttatagtataccatgaatctaacagaattcagatgacactaacttagggagaagttgcgaaccataaaattacaattaaaattaatctataaattaagtgacataaaattccttaagaaagaatgaaatagccaggcctggtggcttgtgcctgtaatcccagcaactcaggagcctgaggcaggaggattgcagaggccaagagttcaagacaatactgggcaatgaaaggagaccctatctctacagaaaataaaaaagaattagcaggacttggtgacatgcacctgtagtcccagctacttgggaagctaaagtaaaaggatcctttgagcccactagatcaaggttgcagtgagctatgatcacaccatcgcactactacagcaggggcaaaattgaaaagaaaggaaaagagaagaagaagaatgagatatgcccagggagttaacaaaataggtcaccgtggacatttacctttgaaagcaatatttgcttaggataagccaagatgcttataaggatataagctgcctgttgacaattcaaggttgataggattctgtaatgactcacaatatttgccaaccctcccaaacctttgcttcaccaaatgtttgcttaagatgaagagtttggcattaggcacatgttgaaattcacctgggagaatttcccttcagagcgccatgaggtgacatggcagctgcccccatggtacactctgaaggaacctaaaggaccattgacctgagcatgttctcctcttgtgactttcaccaccctccccgccaagggtgtgccccccaaaacaacagtggtctgtagatgtgaacattaacatgcgaatgtgcacttcattttatcttatatgtctgcaccctaacaactttcaaagctagtttgaggctgtatgcaataaaagcatagtacaattgcccaaaatcaattaagaaaatgcagatcaaaccaagtataaaaagctttgaacttgaaatgttttctcaatttactacctttgtcctttctcttcttagaatcttaactccctaggacagagaatctatcttctttccagctatgtccctggcctatgaaagaggtgcctagcacatagtaggcactcaataaataaatgctgactgaataaaacaatgagaaaagtaagcaaaataaattttttttttagctaaaaacatctgaatttctatgactggaaatttaaccctgagcttgctagtatccgtgtgaaagagtcatcaaagtttacagaattctttgtctaacagaattgccagaaaatagaataaatgcttttctagttccaaattttttcatgagaaactttctttgagggtaatgagaaagactgacatccacgtctttatagatacttttttttaacacaatgtctgacctatgactgattttgctttagcgaaatgagcaggtaaagtgtattttatatgtagacacaaacagttatgtgttatatgtatacactaacatttagcactgattactctatcaagtttttaccagaaaacagagcccgggacacaagcaacagttgataaaacagaagaaaaacctagtttaagagcagaataatgtttagctgcactcagtggctcacatctgtaatcccagaactttgggaggccaaggcaggaggagcccttgagtccaggagtttgagactggcataggcgaaaaagggagacctcgtttctacaaaaatatattttaaaatttagccaggcctgacgatgcacacgcgtagttctagctactcaggaggatgaggcaggaggatcccttgagcccaggaattcaaggctacagtgagctatgatcatgccattgcagtccaggccgggagacagaatgagaccctcactcaaaagagcagaataacacttagctgaagagagcatgtcccagagaaatgtcgcagcaggttctgggaggctgaaagcaaatcagtcatcagaacatttcctgcctcgtgcctttgttcacatgtgtgtcaaatcctatccagggctcaaaccacatttcaaacacccggtatttcttagcttttctccatcagctgctgtaacccagtgtgctaagcatttgccatacaaagacgccagtcacagctcctgcttccattgggctcacagttgaatgaggaaagcattctctaaacaaatacttgtaatttaatatgatgactgctgtgagaaacgcaatgcaaagtaacatgcttggaagaagaagcaaattatattgattggggaactgttagaaagcaccaaaaagtggtaaaatttaagaaagttttcaaggatgaaccggagtttgaaaaacagaaagagggctggatgcagtggctcatgcctgtaatcccagcactttgggaggccaaggcgggtggatgacaaggtcaagagatcgagaccatcctgctaacaaggggaaaccctgtctctactaaaaatacaaaaattagccgggcatggtggtgggcgcctgtagtcccagctactcaggaggctgaggcaagagaatggtgtgaacctgggaggcggaggttgcagtgagccaagatggagccactgcactccagcctgggcaacagagcgagactccatctcaaaaaaaaaaaaaaagaaaaagaaaaagagaaaggaagcacattttaagcaaaaggagcagcaagtgcaaaggtgtgaaaaccagaaagaatctgaattgtttgaggaatggtgagtgggccagggaggcctgagtgcatgtgtgttggtgatgacagagggtgaggctggagcatttccatcagctcaggctgtccacgggtatgtttaacctgcacatcgtgctttggaacttttctcatcagccggggagcatcataggaaaaaaataaaaaccaaaagagtgacgtgacacaatttgtacctatgatctctcttaccatttttatcccttactgcaatttgttgaaactattttaatagaaattatcacgctcctccttgtaactgagttattttttactcttgtctaatccctcctactggattgtaagatcatttaaggagaataactacgcctgcctcatctttgtcctccttgaagcttctcttgcacaactaagcagttgttccgttgatttcatgttcaacttactattccaggaaagggaagtagaagaaaggaagcatgactgtaagatgggcgaggccaaggaagagtcatttcctccatggtgaagaacataatgctacgcaacttcaagcaaattaaaaaacagttgtggttggccaggcatggtggctcacacctgtaatcccagcattttgggaggctaaggtgggcagatcacaaggtcaggagttcaagaccagcctggccaatatggtgaaaccctgtctctactaaaaatacaaaaatcagctgggagtggtggcaggcacctgtagccccagctactcgggagactgaggaaggagaatctcttgaacccggcaggtggatcttgcagtgaactgagatcatgccactgcactccagcctgggcgacaaagcaagactccaactcaaaaaaaaaaaaaaaatggctgtggctaatgagcgttttagggaaaatgacaattaagctaaactgctaaagctggagatgatggataagacaaggatgagaaaaagaagaagacagaagaatttctaggaaattcagattccttctgagaaaagtgaggaggcaggggacaggacaatttaaagatgccaaagaatcctttattcttcaaaatttcaaaatctttcaatgctacttactaaagtagaaccactttaatggcgttggtgtttacctcatttcctcttcactcattaacagcagtattagtgggtctttttagtctatttcatcttctgtgtctatcacaccggcatagaattaccaagagcactgtttgacagaaaacatgaaatctcaggcaaatgatggagatgtttgtgattgtgtttcattccttttgattttgaccttttcattttggagtgctgactgacatggaaatctctgaagcacaattttccagtgaacttggcccgcttggaaaccgcccttgttcatcctcattgaatgagcattttccctagaccacgtgcatgttcccgcggcaataactggcttgcaaattaagcctgaaccagatatgccatagaactattattttctttttcaatgtgcaagcagttttaaagctacacctaatcctgactactggatcctgtcagatggcgcctctttaaaaccaaaatatgagttaataagcaggtgagataatctgcctccagcaaacactccctacattaagaattgaaaatgttttcatcattcagaagtttgctttaagctttgttatataatgctccttgtgaagttttaaaatgtatcatattatgttcatttggaactaaaaagcaattgaattaatagcagaactctgatttctgatccacagttttgttagtttgatacattgcttaggattctcaattatgaaaactacaatggtaagatggtaaagtgcatagaacatgagctctggagttattccctgggcttaaaccttggttctcccactcagattttctgcctccatttcctcctttctaaaccagaggctgctgtgagggttttaaatgaaataatctacatgatgactctgggcacaatgcccaccgcagggtaagcagtccattattagccattatcattatcaatcatcgtgatcattaattgcctttatatgtgttatatgaagtcattaggtagctaatgttctatagaaggggttggcaattttttcctgtaaaagtgcaggtaaatattttagacttcatgtgccatatagtctctgttgcaactactcaactctgacattggttcaaaaaaacaaagacaatctctacattcaaactcctacccatgaattccaacccagcatatatgtcaaaggccacctattccttgaccatattttcaatggccttgcccacttccctcccattttacctgcatgtcaaactgggatcatctatctctgtaccttcacctggatggctgagctctggtggagagaattgcacaatcacacagattaatgacactataaatacatcacatctaacttcaaccaggccctcacctctacccataaatccttcttacaaaacttccttccccctttttctacaacagctatttcaaatcatcttctgtcctcataaacctccaatgcacagaagtctcagtttgggaactctcctttctttctattacaaattttgcagagaatctcatgtttctctctctctccctttctctcttaccgccccccatgccccaacacacatacaccctttgttacttctctcctttaacaatgaaagaactgcccccttcctactggaagctgaacacctcatactccgtttgtcctataataactcatttcttcttacatcttttgagagctgacctataaatcatccccgcttttttacatttattttcagcttctcccttcttactgcctaatttggtttgtataaaacatgttacagcgctctatcctaaaaatgaacaaacctcaccagagtctatacttttgttcaactactaccttctgtctctccttctttctatgatcttttcaaaacaaaccaccacacctgtaatattttctttctttccttctttcctttccttccatgtagcaatctggcttatatttctgttgcatacaccgaaagtgctgttgcaatggtgctaaatattcccaagttgctaaaatcaaaaatcaaaaggacatgtactgcttcctgagatattttctttcccagcttccacgatatctagcttttcttgcttccctgtgattattcgaaggattctatcttctccttcttttttcctcgatgaccttatgcattcccatgtcttaaagtgccacccataggctaataatccccaatccagctctgttctcccttctcctgggctctagatcagcatctcaaatctcctagacatcaacaccagagttaccaaaggtccctcaactgcaaaaggctcaaatcaaaatcaagcttaaaaaataaaataaaataaaataaaaaaacttgttcctccacttgtagcatgtaagttaatggtaccagtcatctggttgttgaggtgagaaacctgtaaccctgcctctgcatcacctctgcctttaatcaattaccaagttctttcctttctatcatctatcttatggaccctggacccactgcttccctgaatcaccagctctcacttcagagtccaagaaggacacatctaatcgctgtctaggccaagtgccaagacttgtgcccagtctccaagcggctgggaaagaaaatacttggagatttcacatcccattacaagtgagttcagtttctcactgagcctcagaatatgaggaattctccaaaatgaagacgtccagatgacagcaacaccaaacgtgaaaccatgataaatgtgtgcaccccctggattactgcacaagccttctcacggaccgccctactgtcagtcttgtcttcctctttccctacctctgtcccggatccagactgcaatcagttatctctcaaaaatgtaagtctggtgatgtttctcaaggacttaacactcttccttgcctactgactacccataacataaaatgcaagttctctgcatggctccaggccctctctgacctaactcctgctttctagccttatctctggttattttcccatctccagatagatttctgtttagctgaaatgcttagtagaattacctgagtctgccatgtgctctctgggatccaagtcttaaaatacatatttgccagtatcctcttcacctccccgctcttcctcatccctcacacatcattctttcagctttctctctttcacaaaggtttcctgatcctgaccttgctgttgcttctaggtgctatcacagcactttgtttttctataccactgcaggatgactatagctaacaataacatactctatagtttcaaatggctagaaggaagatgttgaatgttcccaacacaaagaaatcataaatgttagagatgaatatgctagttgccctgatctgatcactataaattgtacgtattgaaacatcactaggtaccccataattatgtataattattatttgtcaatttaaaaaataaaatacaatttaaaaaaagacatactcaattatataagcttattatttagttgtaatttgtattaagttccatgagggcaaaaaccttctctttttcaaggtcatatccccgtccctagcgcactaccaggcatgtggtagatagtccataaatacacttcgagtgggtaattctggtccatgtagtacatctatcccagcttaggcttcacaatttcgtcatgtcaagaatcaaaggttttgttgcaattatttccttggattttcagcttaatctaccacaggtttggttgacacaaaatgtttttcaatctcctttagcactgatttcaacacaaaaactgaatttctttcaggccataataaataaataaataacaaataaaaaacacagtagctttctttcaaagaaaaataaattttacaagaaatgcaataaatgaaaatatagtctgttgtgcctttggtacacaaacctactttcagcccccgagtctccccctctccaccttcatgtctcttctggatccatgttacctaatggctcatctccccacaccttgtaagagttgatcctgatcctggcttcccctaaagttatctaccatgtgtgctgactgaggggccaattgtacttcagagctcattactgagagaaaccaggctgccttggtaggacaaactataaaacgttttgcaatatacaaaatggtactgggtgtccttgcaatagacacccagtaccattgctggattggctctggtggacgttccagggtcatctaattccacaggggtctatgccttttattgtctttacaattttacaactctgtaagttggaaaaatctaaaaacaatgcaaattatactggtgcatagatatacaaatgattttttttctagtagaaatgctatagttttccactcttatgattccaaacattgtattttattgctctatagatattaaccagtttcaaatctattaccaacttcatatcagcatgcctgattgcctacatgtgtctcatcttcagcgtctcctttgaaataattgtaatatattactgattttttcaattgttaaataaaagctcaaatacatgttatttgatttttatatattactatacctttgccttttcaaaatcatactttaactgcctgtttctcatgaagaaaatacattcaagtattaaaaatacactgaatataattgttcctcatatacgagccatatctgaataactggagaccagtcaggatgtttctatcctgcagcacagactggacaaaggaattagagtgatatttgggttagtaaagtcagggagaatgatgacaccctctgaaggattaaggatttacttgaagaagagtgcgaaatatggttcagtagatagagtagggctagcatgtggtgaatctaataattcaggcacaaaaaaagtaactatctttctaagaagacatgtaagacaaaagtacagtattccacttaagaagatggggtatgttaacattgagtttcaggatctctgattaactaccctctgttaaacagcaggtctatgactcactgcatccagtgaagcagtaggctcttgagctggatttctacaaccccctcgactcttgcataatgtattttgaaattagagattttcttagatgggaagatacttctacgcaagcaactcaattcagtcctctgaagacacaccatttctggggaatgtcccaccaagtttactcctgactgacacaaggtagaaagttgaggttcaccacatccaggaagcttccattattcactcctagactcagtcttgtggcagacatcaccgctgatgttttctagatcgtccctctcagtactctatgaacaatatatagcaaaagaatggcacacttagagtaacaaggagtcattgcttcacaatataaagttcaaaatgtcagtggaatttaaagctgtaatagcttacagataatgaaataccttttatttaattctgctgatattcccatgtaagtgttctatgccaggcctctagttatctcatgccctttaagattagattagactctcatagcccccaggtttttctcactttccttaaaagccttatcaaaattttatattattaacatattatttgtttaatatcttctctatctcctccactttactacctcccatgacttttaactccttgaacatgataactgtgctgtaagtctggatgaagggtcagcaaatttcagcccctgagccaaatccatcccaaccctttttgtatgccctgcaaactaagaatgtttttctcattttaaaactattgtttaaaaattaaatatcaaaataataatagttttaacacattaaaatgatataaaattcaaatatgagtgtccataaagttttattggcacacagtcatgctcattcatttccatcatctttggctggtttcatgctcatgcagagttgagtaattataatagaggctgaacagctcacaaagtcaagagtatctaccatctggccctttccagaaaagtttgcccatccctggcatacagcacagctgtacttccagcacctgaaatttaataagtgattattaccatctgttggactgttgagtgaatgaatatgaatgcacataactggagacaataaagtttcaaagatttcactgaaaactataaataaatgaaaattggaatccttaaaatgcattttgtggtttagggttggataatcagagtcagatttactaaaaatatcaatattctattgatctcattacattaatcaattagagtttgagtaaggtgggcggggggctgactgtgagccctatcctactaatagtgcctactgcacacatcatctttttgaatgatttaatactgcctagtgagatatttgatagcactcacagggcatgtattaaaatcataaaatgatcaacacaagtatacttgatatttcttccaacttgtaaaataaagaaaacttatattcattcactttaatgtttctcccaatttgtgacttacaagttttatgattaaaatggggaaaaaatcattgctactaatgacattctatgctgtctttcagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcaggtatgaatttttgtattatgcatagcaaatgatcttgttgactttggtgttactttaatatgggaggaagaaagatttcctgtgtcattagccctctggagactgaggtagagtacttgcaaggagagaagcagcccagaatcgccactatgagttgtcctagttgtccctggcctgatatatctgtggtcatgcaccctctgtgctaaggaaggaaggcaaaggacttgagaaggcaaagagcagtggaaacagtttgttctctaagatggtggaactagtaacaaataggcacacttaagatgtgaaacttatttactcgaagtactgtgaaaagtgtgtgtatatttgaatatgagttgctaaagacggttgaaagcatggctaaaactagctgctatctagaagtgaaaggcacgagtgtgtagaggccaaccttcagattagcccccaataacgcattaaagggaacaataaacaccgaggcctacttgaggggggagagtaggagaagcctgaggatcaaaaaactacctatcaggtactaatctcattacctgggtgacaaaataatctgtatgccaaagccctgcaacatgtaatttacccatgtaacaaacctgcacacgtatccccgaatgtaaaagttggaaagaaaaaaaaaaaagattctcatatacaagaaacaaaaaccaaacaaaaattatcccccaaatggataatctagtctcaggcatggactaaataggcacatattcagtaacataaacacacacacaccccttcaatgtgatgcaaagaaggaaggcagaactttcctaagaaagaaagataaatcaagtcaggagctccgcaggtctgcccgttattcctacacaggctctggccactagagcatggagacagcaagaaataacagtgaagggagtatgcacttagagttaataggcactcataccaccatgttcattagaatttctatacattcttctgacttcattgtagagtttataccttcccctgagcaaaaatgttaaggggaaagagatcctggagtccccctgcagggtttccagtcatgattccattgcccaagttactctacccctctgtgactcagtttcttcatctgtgaaatgggaagtataatgatacctacatcattctgttttatgattaaataatacatggggaaaattaaagcagtaccttgcagctagtaactgctgcagtagtgttacctattatctttattatttctcatttcttaattttatatggcaaaatgaaaataacaagtcaggattatactacacaaataatgaatattcatttatctgggaagttttgcttttattcatgcagaatgctttacctaaattacataaatatttaaaaagttaactcaagggccaggcacagtggctcatgcctgtaattccagcactttgggagattgaggtgggtagatcacctaaggccaggagttcgagacaagcctggccaacatggtgaaaccccctctctactaaaaatacaaaaaattagccaggcatggaggcgagtgcctgtaattccagctactcaagaggctgaggcacaagaatcacttgaacctgggaggcagaggttgcagtgagccaagatcatatcactgtactccactccagcctgggtgacagagcgagactctgtctcaaaaaaagaaaaaaaaaaagttaactgaaaattatttgatttggaaaaaaatggtaaagtagacatcactggctaaagattgaattgaaacactggtactttcttactaatagcatttcacagatcacaaacttccctgtatctctgatcctttgctcactaacacaagctttgctagtgttggtttcttaatctgacctcattgtgcacacacatgaagtaaaaattagcattactggctgaaaagtggtgtgattacaggtgggcgatttttttcccccgaccaatttgttcaactaattcactttgagtcagctttacagtaattttactataattctttaagaaactgacagcagggggcagtaaaaaactttttcatgtgttcatttaattaaatatgtcgttctaaattctgcatttatatgttatttatgtagattatttatacagatttatatacatgaagaatttgtttcttacattttacctttgacagaaatgaatgtttcagattctatttagattttttaacctatcaatcttgcaaataaataattttcattagacattcattctcatgtcactcaaaacagttccacaggttttcaaactacatatggttccacctacatttacttccaaaataacccttgaagtatactacaacctttaaaaaatgacagaaagcagtccatttagcattgaaggattaattcaggtgaacagaccataattactgtattaaaattcacttaaccatttggtgattctaggggtcatcaaattcacacttctgcctctttgggggtagcagaactaaaatttaatttagttagtatctgcagtattattaactagttttctcttattctgcagtctatgaaagtccaaacttgacaaattatgcccttctagaataattaagtctcataaaatgttccattgttgaaagttagctggtcatgtttgtatcctatagagttttttgggtttggaggctgtttttgtttgagagggagagcatagatgctcattggattttttaaatttctgttccaaagatcttgatcctccttgtcatgtatttgtaagtgcaccagacgcctaagaacattgagctcttttgaccacatgagacatatgacagtcataagagaaaatctttgaaggaaattttctatcaggaagaaaacctttattaaagatttcctgcaatggggcattttagaacctgactcagactgtgtcagtccagaggacctaggacctggagcttaggcagacctattgattggcaggccatttcctgaggtcacagaagcagttgacagacgtgtggagaggcaaggagatgtcaggagaatctaaagcaagccataagcagaagcccaagagacactggttggtgagagcagagacgctcctcagtgttgggtagttggcagctgtactgggaggtaagtgaggtatggtgccaagaagcttggcggttggccaatggaaaggtccaggctgacttatagggaatgcgtcacaggaaaacatggcagcagacagtaggatcaagatacaggagctggaacacgggggagaaacctttaccttgcaagagtttaagcaagtgaaagttaggaccatagctccagaaagacaaaagaacagagcagaatcttagtgactcaactgggtccagattagggaaaccaattgctaggttaacatgcctgggctactaagcagctggctggagcttagattaaacaacagagattgtttgcttttgaaagctggcatgatgaaccttacaaatgtggataaagaagcccccactcagggaagaagtaacagaaacaacagggtaaaaccaggccagtcacttcaaggcaaggcatttgtacttcacatgcagtcacttcaccctctcacactgtgtgaacaccacttatgactacaaacaggactgaaaatatgttttcctcctttattattgcatatccaacaaaatctcaacaagagaaagaagagctgatagaagaaaaccctatgcataaaaaaggacgttatatacaattgaggtagtattcacatgatatgcaaattatattaacaatttgaattactacattaaatgaaatcaagtcagaattcattttttctctgcttatgctcaaatgtcccatattctcatatactccttccaaacagcataaagacctgttccctgacatcactcaccttccctgttctctccactcttgactttgtgagttagtaaaaaatttgtgaagaattttagttcaaaattacctccggtattataaaaaggaggccttatatttttaaaggtatttatttatttttaaaggtattatttatttattttaaaggtatttatacctttaaaaatattttatcaactgtatgttttaaaccatttaaatgtaaggagactgggatcaaaaactgtgaaatgatgtgcctagtaatacaaaaatcattcattagtcatggagactggagtataactcagctcttatgattcttgatcccatgctgcagttgttaatgagaagacttagccactgtcactgtggagttagaagttatgcatagcttactgaaagcctccagaaatggagatagtggaattgccacctttaaaaatctacgcttggaattcatattccaaatatcttcaaagaaaatggtagcctggcaatttccagtatctttctctatggaaaaagaaaacaaatcccttcatgggtatccttccctttttttgtattaagttaatcatggtcaatcaacagaaaatattttttaaggtgggtatagttagtgtagaaacattcagtgttgggtagttggcagctgtagtgggaggtgagtgaagtgtggtgccaaggagcttggcaattggccattggaaaagtccaggctgacgcacagggaatgcgccacaggaaaacatggcagcaggaagcaggatcaagacacagggactgggacatgggaagaaactatgttattctcaatcaaattactacaaataaagttattattcagaaaataactacaaataaaacaaagcattcctgttttatctacaagtagtccaaacacatctttatattattaatataaggtaaatgtgtacatatgtcaaaaaaaacttttaaacacccacttattgtagtaaaagtggaatccagtaatgtgctttaatagtctaaatacaattactcatatctaatcataagatacctactaggtcatcattgttagccctgtaaagttttatttactatatataattaaaagtaatacaattatttctttttataatcgaaatacagcatgtccaatgcctccaattagtttacatcagcaagactttgatcatcatcaaaagccaaaacaagaggattagccatatcaaatctatgcaactctgtcagtaaaaatttccatctcctcaaaaacgacaggaagaaaaacaagccatgaatttacttttcttactaagggtaagaaaatatggtatctcccatcttttggctgatttggtttcggaaaatgtagcaacagcaccactagccaatagtttatgaatattcagtgcttgtaaagtgaagatccagatggcttagcccaggagtatcgttgttgttaaagaatatagtcagcaatgagataccagataataccatcagatcatcaaaatgaaaaaatcctgacaatacacgtgttgtgactgcaacatgaaatgtaaataggtacaaccagtttggagaactgttttacgatacacaattaagatgtgcatacactaagcctttatagatacacaactgcctacttgacaccactatatcgatgtctgatactcttatcaaatttgtcgaaaactaaactgattctcctctcctccaaaaaccttctctttccaaatcttctccatgtcaacaaaagacaaccctccttccagctgttcaggaaaaaaaccttgaagccattctcgatccctctttttctcacaccccaagtccaattcatccagcaaatccagctggcaccacctttaatgtctccagatctgaccacttcaccccacctccataaatgaggctgcacgtcaagccaccatcatctgtctctttgttatttgcattaccttccaacccatctccttgctttcgttattgttcatcacagtctacacagcactcagagtaattctttttcatgaaatcactatcacagcactgcccgaacaccgtccaggggcttctcacttagtccgagtaaaatccatagttcttatacatcctaatcaggcttcatctctctgatttcacctcttgccactcccccagtcacagtggggttcttggctgcacctccatcacaccaccaggcttgttcttgtctggggcctgtgtactttctgctccctctgtttgtaaatctctctccccagatatctgcaggattaaatccttgatcccctccatatctctatcacctttacaatatggcctcctataactactctatgtaaaagaaaggtcctgcctaccttactctctattccactctcttgcttttctccatagatctcatgtgatacactgcacattttatctgtttgatttttgtagttgtctttcttccttcactagaatataaaatccttgggtgtaaggactttatctgttttactcacttttgtgtcctcagagcctagaacagtgtctggcatgtaacaggtgctcaataaatatgtgctcaagaaactggaaagaacctaaacattcatcaaagagaaaatggataaattgtgatatagtcacacaacaaatgaactagagctgcatgtatcaggatatatgaaactcataagcataaaatcaaccaaagaaaagcaagttgtaaaaacttacacataaattacatggacagatgtttgcatatgaagttacatttgcaaaatagtactatttcaggcttacggatgtagtagtacagagaaatgtgtgggaatgaggaacagtcaattccagacagcagtaacctttgagatgaagcacgtgatttgtgaggagtcaactgtgttggcagtattttatatcttaaggtgggtagtagagacacagatataaactacatcattttaatatttaatagtgaaaaatactgactttcatgttaatctactatcctcatgatgtatcaataagttcagcagcaatgtctctaatgaatactttgatttaccccataaaaaccatccagaaaatatcttggtgttaagcactgtgaatcggataggttggcttttagccatttgtccatataattttcagggttgttttagttatattttagagctttttaaaatgtttttttttgttttgaatttatggtgtttcagtagaatattatatgtattcagtcttgtgccatggatcttttatggtatagtctactttatttgctgcagtcaattaaaaaatctgtatatgagcttcttgtttttaaggaaaaagtctgcattaggcacaaacacacacacacacactatggacctggttaggactagtgagagggaatttgaaaatgaacaagtgcttcctgtcactatctcaccaacccaattgcctctcctcccatctacatacctagacaataggaacaagcacactagggcagaatccataagaaagcaaaacctaattttatagttgcctattttcttattcttttatttcttaattcattttaaatctttttttttttctgtgtatttgcactgaattgaacaaacaaaagcctttatattttgcggaggacaataaatattccctagaacacccaattactgttgaactagaaagcaaaagaaattcataagagaatggcacctttcgccgggcacggtggctcatgcctgtaatcccagcattttgggaggccgaggcgggcggatcacgaggacaggagatggagaccatcctgactaacttggagaaacccagtctctactgaaaatacaaaaaattagccgggcgtggtggcgggtgcctgtagtcccagctactcggaaggctgagacgggagaatggcttgaatccgggaggcggagcttacagtgagccaagatggcgccactgcactccaggctgggtgacagagcgaagattccgtcaccaaaaaaaaaaaaaaaaaaaaagagagagagagaatggcacctttattttcacttaagtgaaaagatagccttatctctgactcctaccacacaatttctgggagttaactcatgaaaggcatgcgacgcattgagaggttttatcctctttctatcttttccattctttcttaaccgctgttttcatccagtacctacccacttgtaattttcactctgaaaactagctatgcctctgcagtagcttacctgcaaggccatcattaatgagaatattgagtctatttctgcagaccttagcgaaatggaataattcagaatccagcaagcccaggaaatattgcccctgttgcatggaattcttgtttaatgacttgaatattacagagtggcagcagctgccttattacctcttctggtcaacccataacaccatgatgttatgaaaagcccattccagctgtataaatgcataaagctgtgaaaatgttgctctcactgataccttagtgaaccaagaagtaaggctgatattcaaggcaaaagtggaatatcactatacagttagaagtttgaattggttatgacagtcattggtatctagtcatgagtagcagtagctaaattagacagtagcatcagtttatatcttaatggacaagtttctggatttaacaagaaaacaataaacaccaaaataaatgtagctgaagaataaaggtagagattttttaatgtcttttgctttgaatttgtggtgtttcagtagaatattacatgtagtcagtcttgtgccatagatcttttatggtatcatctacccagtttacctgctgcagatggcaaaaaaaacaaaaacaaaaaaaaacaaaacacctgtatataagaagcttcttcagataatccctttagaattaaaagggattcgtgaaacaagcatcagaagcgcttagtggtggacagtagaggttctagaatcagaatgtgactcttggctccatcacgcatcagttaggtcactgtggcaagttatttcaactttctgtgcctcagtttctttgttggtaaaatggaaataatagaagtacccacctctagggtaattatgaatgttaagtcaattaacacagagaaagagtttaaaactgttagcacattgtagtgtcttaataaatattaatgtattattttaaaagttacttattattttaaagtgtttacttttatagtttattgttattgacttagaataaactccccgcactctaccttttcaaaaacctttgactctgtttcctctctttaaaatcttcatactgccattttcttttatactactaagtattcacaatggtatagagcctatggagatggaacacttcaacagcataaaataaacaaatgatttatcagaaatacaatacatcttgaaagttgcttttgactatttgttgagtcctagatttgtatctcagagtcggaatcatcacaaaggctgccaggaagtagtgggatactttcccttggtctctgtataacatactattttttttatacatttttacctcacttggccttctgttccttcactgctgcagggtatgggatcaaagccaaagaaaagtgatttgtttctgtctctactcctccttcatacaactaattatctccccatcctctctttctaaatgtagaagctgtgaaggtcagccgtactgtggattactgtcaatttagaacaccttccaaaaataaaatctctttgactattgttttcttgctgctttaaaaattgtttagcaatttccctcagtttgctttgtgagcatgtgttaactatttgctagagttaattgaaagtggttccccaatactttagccactctttgtttttgtatttcaataatttcagcaggaagaaaaatctaaaataatttaagtaacaaatgcaggcttttcctcagctagataaattgaccttttattttgcattttcttactactaagtattataccatgctgcaaagctctcaaaaggaaaaggatgtgcttttcggaagtttaatttattagtatgcaaactagtatcaaatagttgttttgaaagaatttgaccctgaagtttcagataccttcacagtcaaaactactcaatgtctcaaatcttttctgcagagtctattttaagtacttttcaacatgtttcttcatttgccttggggccatacctcctcatggatcactgaatctgcttaagcataattacagcaattcaaggactccatttagacattgcattcttttgacgttttggagttactttataaatgtaactgtagcaaatacaattttaagtatgaaactttatatagcttactgtgctgaccaagatgcaaaatagttctaccagttggtgtttgaatgatatataacaatagaaatggttctttcctatttaattttaattgatttgagccaagaaatagcatcctattggatatctgctgaaataggactaaactgctggtctcctgaactgtgatagagaaatccaatcaaaagcttttcctggccaaaaataatactaattgcaagtgaaaactagctttgttctctcggttatgagttccaatggtgaagtctagttccatataacagtgcatggtaaattaggccacagaaacaagcttccagtcactgtttatatgatccacatgttgtggtccaaaaaatgtaaataaaaataccctagggaataagaactttttcctaagatgacagcttttagccttggttgttgaaaatggtgagtatttctaatgaaattgaaaacaagtctagggaaatgaatttccaagtaatggaggagaatctttgagaacgagaagaaagaggagaggagaggaggggaggggaggggagggtaaggaaggaggaagggaggaaggaggggggagggaggaaggagggaggcagacaaagaaaactctcatctgaagattaatggttcttttaaagtcagaaagatcttcaaaataattttcaccattatatagacattacagaccaattgctttgacagagaatattctaattgtgttagtgcaaagagaatgcaatagatatacagttgtggacatctagggagatgagaaagaaaatgtttcagttttggactttgaaccactacaaagaccaagaattctccatatcaatatatgaatttgattatgttaatggaccagcatgggcccagcatgctttctagaaggatagtaatgagaaggtattgataaataagaggatttgttcaaggtcagggcttagctaagcctggtcactccagtccaggggccttgttatcccctaatgaggaggtcttgaaagttaacaccagaagcacggtaacattcaaccaccatcatatatgtctgtgcagtcactgtgtagaattacacatagtactaaattgtaggaagtttatgctaaaattgccattttcatgcttgtcaaccctatggtcatcattctaaagtcaccaattaaaatgattcctctttattttcttacagagctattaacactgaaccctcacgaaagttattgtcattctcctagtaatactaatagatataataatattaatagccaacatttcttgagtacttagtgtatgccactcttctaagggcactacctgtataaattcacttattccaataagctagatactgccagatttctgggattctaagacatctattttacaacactttaacatctttgtaatcagaactctttacagaaaaggacatacttaaacaacagctgtcagatgactcattttgtggttgtattgcttgtacacatacaaatttggtcagaattgtttggcagcttaattatttacttggccagtactatatgctgtttctttattagtggttcataaaacaatggtatctagtggtgatttcatgttagattcagtgaactagaaatttgttttctccattttaaaaataacatactaagatatgaatagtttagcaaaacttcccaattgtccagttactggtagggatggaattcacactgagacaaactggctcctgggtctatacttttttgtttctaatttttatgggtacatagtaggcatatgtatatatggggcacatgagatttttttgatacaagtatgcagtgtgtaataatcacgtcatcatagaaaatgaagtatccctcccctagagcattaacgaatctgtacattttaactgctatactctactgccataacccttctcaagatctgtctcaatggagtttgggtgagtcctcctgaccatcagaaacaccaccacagatagtgagcagttctctaaaagcaaacctcatgaatcgcttccttccattgcccccagacaatgttaagaaaccttaaaaaagaaaagagccatgattgattctttagtggtcctcatgagaaaactgtgctgtatacattcccagcccactttgtggtgtcacatgaggaagagccagcgtctttactcttagcaacaaccttccttgttgcaacttgtgagggcctgagctacagtgcctcctctatcaaagccattttgctgggtttctctttcttttataaacagaacactgatcccaagcagaatataacagatatgacttgtaatccgttatagtaccatttaatccttatgtttagctgccagcattctaattaagaatgtgttggcatatgttggccagaatcctgcaacatggaattattccatgggccaagcctgaggacacacactgctgcctaaaatcgaggaagaaagggccccaaccacactttagttcaagtgacttctgatataccttttctacaaaaggccattgcaaaatacaattctgcaagatcattttttacgaaataaataattttaactttgaacagggagctaagagggaagcatgaagattgaagaaatcaaattaactttggaacgagagattgtcgtcatagcctaaaaagtcaatgagcacatcaaaaggagagagattcctctgcccacagtaaaattcatcagggggccacatggtatagtgtatctaggtgttaggtgtgcagacaaggaatggcgtgcctcagtttggggtcagtttcactgactgaacatttgtgctgccccattgtacacactcagctctacaaatatcttgaccaattcatttccaacctagatgctagatatttgggagaaatttttaattggaggggattggcacatatgttgtaagtgccccatttgttttactatttgttaatggaaaatgccaatggtatacctcaaattaaagataccatcacccttagtaatagtttaaacaagatattccacagaagaagaatgagaagaatcactctagtatgagagctattgtgtttggattgtattttcttttctaaatcctaataggccaatgcaggtaaaatgatgaatccattaacaaggtgtttctatcctattacaaatcaaagtaactttactaccactgtgtaacctataataattatataccgtataatatataatgtatactgtaacacttatgttgccaattttaaaattttatactgatctagtccctttcacctgcaaatcttaaaatcttaacatttgttcatccagtgcactatgtaaaatggctttagctctttggaattggaagttgtatcttctaacatggcctaggagcagcccctgccttccagcatagagttcagcttccaacacacgcctcaagaaccatgggtttttttggaacatgaggccagctcttagctacctgcaattcggaacgtactatttggtttcagcagtttcttgacccttcatggggtcatcttcaagttctgtattgttgcatatgtgttttttctctttgcctttggatagttttctggctttcagattttgatctttcagattttgacaaatcagaaaaagaccaaacccagccaaaacgtgtctttcattacagtttgttctggttgaaatgttaaaccttctcacatccgtggtattgaagcaaattatgatccaaaaagaaagaggagttgggttcatcttctctctctcacatccacattgcaaatcagtcctttttcactccccatatttagtgctatctgttgtcctcttgcctcactttcttccaggaggtcttcgtatcctcaggtaggtctacagaaacacaatttagttttcctttcatcatgcaaacacaatgctacacctgcactaatcatctgtgctcaaagccaatggatgatagggggcaagtgttagaaattacccaaggctcttagcacctggagtgttttctcacagcctcacctgtatggataattttatcagccaaatagagtaagtggatcttagttgatcagagcaggaaacaagcttgaagccaggggtaaaaaaaaaaattaagagaagcaaatgaagcctccagaaagggaatctgaaagagacaaggtgaaggattagaagcagatggcatgagaaacagttccaagaagcaatgagaaaaggcagagctggtgatagttcactgctagagaccattaaacatccatatcccaaatggttccagatcagacctcccagggaatgaaattaatatgcaacagtctcctcctttgccagctgcttgtggcatttgtctcagctctctgtgaaaaattgtgtgtactcacaataacaaacatatacgcgacagcaatccttccgaggtgacacgagtcattgttgaagagtcgtgctcccagcacgttgggaggctgaggatggcagatcacctgaggtcgggagttcaagaccagcctgaccaacacggagaaaccctgtctctactaaaaatacaaaattagccaggtgtggtggcacatgcctgtaatcccagctactcgggaggctgaggcaggagaatcgctttaacccgggaggcagagattgtggtgagctgagatcgcgccattgcactccagcctgggcaacaggagtgaaactccatctcaaaaaaaaaaaaaaaaaaaaaagtcatgctcatggcattacttccttaaaacttcgagtaggatacagaaggaaataaagacagtaacctctttggggttctgtacatcttcacaaagcttttcttcatagatcagaaaagaaacttaaatattccttgggtttaagctgccacagaattgtgttaagattattaaaatacaagcatttaaatatgaggatcataagtctgccttactacttttgctccattatcctctgactcatcatctttcatagaccctgacagatcctcctcttcccactcttctccaccccactgtcttgccctgagtggctgatctgtgtagactagaacagactccttcaggtttccggttgggctaagtcctggagggccctggcagatcagaaggaagaaagagaggaactcaaggtacttagtgtcccatcttcctcctatgggcttgccttggccctctaagtcaaatgaaggtctccatcaacacaatgcttccctgtgttcaggaaagtgcatccaccttctgttcctttagggttaagagtggtagcaattctgctttgtagtccccaggtgatcccttatccctgggtttcctcatactctgacgataccttcagatataatcttttcatgaaaccctccttgcattgtttgagttttagtgtgccctctctttctagctaggaccacaactgctacatcctcctcctgattgcccaaacctaaaatgatgatgacccataattattatccagatacggtgacacaagcaattcctgaaatgctttcctctgaaattgctaaggattactcacaggcaagttacacagcttcaaaattacttttccagctctatattccctattatttctcgctgtttgcttttagacttaagtaaacttcaactccaattctataacttagtaaaagaatcacattgatgtgaaagtccaaaaagacatttgatgttgtaagtggaattttctcattcgttcactctctgtcaatgagaaattaaatgactaacactaaatggagtgctacatatgtctggcattttttacaaaggaatttatatactgtctctcatccagttatctcgcaagctctgtagggtaggttctgttattacgtgttttagatgtgagaaaactgagactcagagaggtaggcaaactatccaaagacataacgtgacagtaatgtgtctgggattattaacaccaaaagttggctttttggtggaatttgtaatgatgagtgattcatacatttgaagtggtgcttgacttatttaatggtacataacaaaccactccaaaacttaatggctcaaaacaatttattattttctctcacttactagtctatttgaagactagctaccacaggggaactcttaggcatttttttcacgtctgttatcctggaatgagtaaactctaatgagaacaaagaataccgaatatcatggagtttggatgaggagtgtgatacaacagggttacagtttgaattaggagtcacgccaaaaggaaggtagaaaggaatccagatcagtggaaaggaggaagcacctaacataagaactaggtgtgccattaagaattatgctttgggccgggcacggtggctcacacctgtaattccagcactttgggaggctggggctggtggatcaccggaggccaggagatggccaacctagtgaaacttcatctctactaaaaatacaaaaaatttcgttgggcatggtggcacatccctgtaatcccagctactctggagactaaggcaagagaattgcttgaaaccaggaggtggaggttgcagtgagctgagattgtgccactgcactccagcctgagcaacagagccaaactctgtctcgagaaaaaaaaaaaaaatgtgtttttctcttcaaaatctgactccctccctcagtcatgtaacctgcagcatagtattagcgcaagtgcagggagccaggcgaagggggagagtggtacacaattaagaagggcacagcctccccaggctcttactgaactgcattaccacatgacgatggaaagtcttcagctagttttccccccaaagaaatgaatctggtaaatcactatgtttaacttacatctgttttattaaaacctaagaacaatcgtttaatataaaaaagttttttgagacattttattaccgaaaacaaagatccaattacatggcttctgtagtgggagttctcagcagacagaagacaattacaaaatcaaataaagctgttataattttaaatcaaataattacagacaaaatgactaagtattgatatttttgtttttaaaaataaaaccaggctaaataaatgaaaataaatacttaaagaagtaattgttgcagctaaagcaaagcatataccttcttcacctaaaatattagcttacatgtttattttcattttaatgaaacccagcccccgtacaatatgtgtaaacgtcaaactaattttatgtttctctattaggtttcccaccattctaaatggtgcacatttaacaatattttatatttcattattactatggccctcgggttctgtgttagaacaattacatactgtaaagaattagaagtttttgaggatttactctccagaatagtgactgaatgtactttgatagaaatggagtaacaatagctaactctaatttatccactgcaattggtaataaaggaagatagttaagatctcaaatctggaagtctgatattttagccaacaatctcaaccttctcattaaacaaaatatttctttgcagataaggcctctgcccttattctctcatcttgctattgatgtccattacgtgcatttggactatgttatgcatgtgttggacatttatagaacactccttgagtgtaaagctctgttgggtattgaagggtacaaagactctatccatcccttcaataaacctagaactgcagagagagatagacacctgcaactgaagttcctgcctctcacaatattgatataattggctcctcccctcgccaattttatggtttgtgaaagttcaaagcatgtcttccatatcttttctcacctattggactcctgttgctgcacatgctgcttctgtgatgcattcagtggactcagatgtaaaactgcactgtctctttgagttcacatttagcaattttttattcacacttatgagctgaataaacttcacagaagatggtctgaaaggagacagatgaggaacttacatcacaggcatgcccacaatctgtaagggagccaagaaggcaggtcatctggaaagctaaatatcattttaagacattcatattctcctataaccatcaatgaccactactcacctctctctccaaactgccctttcttctcagctttctcttttatcctggattgcagaagctccagattcttttccctctaataaacagggaatgtccccctcctctgaagtcttggcaccatctgatacctagatattcccaacagagaatccagtctctggaagaagtgtttgtgcaaattacagagcatatttttaaaatattctcccttttgtcaaatacccttaattcaaggcatgaataaaaaggactagaaaataataatgttatgatattgcttatagtagtaagatttcttgattatgtatgtgtgaatatatataattgtgggaccatgtggtgattttttcccctttttctactatttgtcagaatgtttggtaataagactgctttggagtaacaaagaattgcttaagtagactagctataaattttaagctgatgatgatcaatctgaaatggatggttagacccagaaccttatgattattttgcctgaacaaattacagagatgaaaggctgccttcaaatttttggacaggatatcccaggtaaagatggaattcatcctaaaccagaggagtgatgtaataccaattccattaccactcagtgtccggcactccagaccagaacaaagctgaaaaatcggcaggtgtgaatgactcacactggacactgagtgataccattcacgtatcttctgtccccatgacggaagaaaattggcctaagaaactcaggaagtgaagcttatatggtgaaccaaaaaagttaggccatgcatgcttaaggaatactcagtgaaaaatcatgaatgctgatagaaaaatcctccctcacattgatgctactacagtgaagatataatgtaggtaaaaacactgtcttcataaggtattggccaccaggtcaacaaaaacagctgccctacagagggcatgttaaacagagaaccactctatccctgaagtaaatcctttcctgctttggcaattgaggggctggagttttacaggggaaggggaatcttccaaaagccctccttttttttctttttttaaagatttttacttctctcattttatttcttttttaacttttaagttcatgggtacaagggcagatttgttgcacaggtaaacttgtgtcttggggctttgttgtacagattatttcagcacccaggtattaagcctagtacccattagttatttttcctgatcctctgcttcctcccatccttcaccctctggcaggccccagtatctgttgttccctgctatgtgtccatgtgtttttatcatttagcttccacttataagtgagaaggtgcggtatttggttttctgctcctgtgcaagtttgctaacagcctccagctccatgcacatccctgcaagggatatgatctcgttctccaaaagccctactcttattctctacagggaaatcagatcttcactacttcagaggaaacatagcacattacttataccagtcatcctaagtcttcattcataaacataatctaactatcagaatagccaggtattataggaaaacaagaacttggcctctctatctctaccaaaatgaatgaataggaccaatccaagaagaagctgagttatctcaagaaaaaactttaggagagaagatttttaaatcccaattaacaaaatacaccatcaataaaaataatattatattgctttgggaaaaagtaggatataataaaattagaatagaattacgtaagtaaaaatttcagaggattgtctgaaaaatcagaggataaagctaactatcttgtagaagaaaaaatgacatttcttaaaatgtagatcacacaggaaaagacatcataaataggggaaaaggatagagacttgagggagattcatggaggccaaggtgcattcagtagaattccataagaagaaatcacagataatgaaagaaagggaaaccattgaaagaaacattagaagaaaattagcttttgctgaagaaatacaggaaccttctgattgattgaaagacacatcaatcaagcattgggcaggatagatgtttaaaaaataataaagctcttgatgcaatctcaagatgaagagacaattctaaaagcttctaaagaattaaaataggttacccaaaatgaagaatcagactaacacctgatatttcaccagaagcactaaaaccctcgaggacaataatggaaagcatatttgtgtgtatatgttttagaaagacatctggaaaaatatacatcaaacctttgggagttgagggagaagactggctttttactttctaccttgctgttgttttaatttttaagatcatcttttattacttttataactaaattattttaaaaatatctttcccttctaattaattctatccatggacagaattaattagtaggcaaagagactagacgctgttacctaattagaatgttattataacagtcactgacgagaaactgagaggggaagaacctacagtaatagaaattaggggcctgaatcaaggaatgttttgaagatatttttcatgatttggtgagttattgaaattaagaataaaggagaaagaaacaataaaggtgattcctacaagtctgaatgactagatgactagataattatgccattcagatgagaaagaccaaaggaggaatagatttctgttggatgttacggagaagtccatacgatgtttacgttacggacttgagtctgaggtataggaagagcattcatataaagggtctggcctgtggtctgaaatgggggctggagcttgggagagatgttgactggagagatagctgggccatggggtgagcagacaagaaagaaaaggactcatgacagatccatgtggagagcctgcaccaggggaaactgagggaagagaagccagtgctgcgggagaaggagtgttcatacggaaaggaggatctagagagatcaatgtcacagctaaaggaggacattttctccaaaaaggagaaggatttgccacattgacgaagacaagaaggaagagttgaaatgcaagtttttgataactgacaatgtcatttcttcttcaggaatttcaggttaataaatattagaatggccaaataatcttgtataatatattatggttcatcaggttgttctcatacaggcatctcttcattaccaaggggcttttaacatcttaagcaaggcaaaggtagaagaccccttacaaggttgcactttatctagatttctggagaaaacatggagtcaaggagtccaccccttagggatgagtttccagaattccaagctgaggtcaattcctgaaccaggaataccaagttcaaggaaaagatgggctgaagtcaggacacagaggtgagaccaaagccaccaggagcaagaccagagccagagaccagacagggaagacaaaaacaccatcagcgaacgtgttcatctgagagtcagtcagaggacatatcagcagtggcactatgaaactaataccttcttgcctttcaatcatttgtctgtcttattagggaaatgaattgttatctgataatatttcccacagaagaaagtgttaatcatttatattctcaagatctatgacctataaaatatgcatatggagaagattgatacttttctaatatgcattatgatgaaaaagaactattcatttcaaatggtataataggggaagtggttccttcatcatttttggctttttgtatcttccactgaacacattttctcttctgaacttctccagtacatattgtaatagcacatgtctgcttctaatcatttattaccttcatactgacatcttttcaaccacatacattgtatctttgtcatgacagccacaggggcaccaattctgtcttattttcctttgaatcctctatagctactagaacagtttacataataggttatctcatactaattggctgtcttttatcgcattacccaaagataatgactactgaggattattcctaatacaacctaatacaacctccatatctgcatctgtggattcaaccaatctcagattgaaaatatttgaaaaaaaatggtgtctgtactgaacatttacagaccttttttcttgtcattattccttaataatacagtataacaactatttacatagcagtcatcatattaggtattatgagtaatctagaagtgatttaaggtatactggaggatgtgcataggttttatgcaaatactacatcattttatattaggaacttgagcatctctgaattttggtatccaagggaggtcctggaaccactcccccatagatactgaggaatgactatattatttccttatgtaggtttttatattttttaaagtattttaaggtacataagatctcttgattttcacaagaattaagtggcttaaatgggagagagggtggattaccacttaatagatgagtaaactgaggttcaaataattcaatgattttccaaaagattcagtattcaaactacagtctatactttttaattcttaactgggttaccttctactaccagaagtgctgttgattttctgtaattgagattcagataaccgaacccacatatcctaggccagtggttcttatatggtggtggctggggctaggggaagacttcaggggtgtatgcgtataccactttccaagaagagattggaaatgtgcagagttatcacatggtgggtatcacaatggatggaaagtgattgtggcatttagtaggatggggtgtttaacaccttgcaatactgaagccaccacggtgagaattgttccatttgaacacccattgcatccctcttaagaaactcagcaagtttaggcaaataaagggaactatagccacctctacaaatatctgaccaagagtcctcctttatgctgtctataaggggtaagtgagcaaaagcaggaatttagcacacaatccaggctcgtattctttgtacataaaaatacaactattacatcatcgcattaataatcacataagcaacgtggtgtgtaatttacaagaacacttaaagaactctcagtaccttggtgccggttagagacttcactgaatacattttaacttatactcctttatttgttttgataaaaaagagagtcaaacagaattgtctggaatcttttcttaaggttaacagctttctgttcccctttgttcaagtgttcattttaataatctaattattccagatctatgactcctgctactcaggactctcccaaaagacccctgacttctgatgttccacttctgcctgtcctttaacccaaatagattcctgttgcccttccagcaaaacaaaacgaaaggaaatgacatgctacagaaggctttcttctcagtttgcaacaaaccctgtaacaaggttttccctctgtttaggataaaggtctctgggcacctaaggcattaagccacagagcattgccctcctgcattattaccatcctgggattaccttttgaaacattctagcatttgtatttgaccgtgttcacactgctataaagaactgcctgagattaggtaatttataaaggaaagaggtttaactgactcacagttcatggctggagaggtctcaggaaacttacaattatggcggaaggcaaagggaaagcaagacaccttccacacaacgcagcacaaggcaggaagaaatgtcaagcaaagcgaggaagagccccttataaaaccatcagatctcgcgagaactcactcactatcacgagaccagcatgggggaaacgacctccatgattcaattacctccacctggtctctcccttgacacttggggattatgggattacaattcaaggtgagatttaggtggagacacaaagcctaactacatcagcattgaaaaggttctctcttttttttttttttgagacggagtctcactctgtctcccaggctggagtgcagtggcgcgatctcggctcactgcaagctccacctccggggttcaagctattctcctgcctcagcctcccgagtagctgggactataggcgcctgccaccacgcccggctaatttttttgtatttttagtagagacagtttcatcgtgttagccaggatggtctgatctcctgaccttgtgatccgctgcctcggcctcccaaaatgctgggattacaggcgtgagccaccgcgcccagcggaaaagattttctagagtttagtgctttcaaattatctttactacagatacatttctaaaaggatatgcctttccaatttcattaagttgcttagggtgagaacacaggactgaggaaataattgggcacaaaaaacagctcttacctgtaaccctttcaagtgcaaactgtgatgacaaatgctttactcactcaataactaataacatacttttggttacacaaacatactgctaaaaaattgtattttcaatgattgaagcaattattctacataattttcacttagcagttctaagaatgtattgatttgttttctgctcatctggtatactggagcaaattgtttagctgtgatgctttacaaagtgccatgtatcactttgtatctccaattaaatttcaattaagaaatcttataattatcttatatcaaccagccaagagcagaaattcctcatattgaatcatacttacactactaatgagactgtcaaggtttggctttatgtttacctcagataggcgtccaaaaactgtgatgattgtccaaactctccgaacatcttgagtctgcaaaatttcgctggcagtcttgtgggaagaagtttcttttctgcatgagccatagtgtctgcttcaagtcctggctcaaagtcagactacaaaggcagacaaaaatgagagggaaatttttatctaagtagttcaaagcttcaaaatggatgaaaggttcaggaaaagggaaagtttattttctttaaaaccagttcaacatatttggtgcctatggccacattcatgtttaacctgttacagcagtaataaattgaattctatcccccttcaggtgagaataaccagtaaggaaactttctgtgacatattttatattcttggatcttttccctgttttaacacacaagagtggcaataccaaaacaagctgtgtttttatttgaattgtgcttatacataggcatcataagtatatactgaagtatttgcttaagcaagtagggtattaagtaggattttaaaaataagtagaagcaaaacgggaatgataattgaaaatgtatagaattataaaatgtgcctcatgatttgaagtatagatccagggaattattctgagtaagtaaacaatccacttccttttttctatctggaatctaataaaatgttttaaaggctttgcccttaaaatgaaaaggtaagtatacaaagaaaattgaaagatttaaccgaatgagaaattgcttaatataattcctacagtcatgacattccaagttcagaacaatttgttttaaatttaaataaaataaaataaaataaaattttattttaaataaattttaaataaaataataaaattcagtccattttagccatagaccttgtttttcaaatgaccttatgattcagttattatacctgcgctcattctgtgacaggtcattccagaagagacacaattgtacaaagctgaacataaaataaatcttggtttcttattgaattttaaattacattgggaatgcttttggaataattccagaccttaggagaaaaaacgtctcccaactctaaagtcccaggttccatctcaacgtttcacattcaccggcaaaggctccaaaaataaattacaggcaagcttaaaagatcagaaaggctttcccattgtgcaagtgggtgattacccgcgattggtgtctgttacagtcattgtgtctttctctaggattctctctctgtttccgaaacacatatgttccaagttttggatgctacgacttcgtgttcatgtggttcagaatttagccctcccccagcccctaaaaaggctgatcttatgggcgtgaaaaacaggcatttcacagatttagataaatgtatagtgtgtcataaaactagctcatagaattataatttgaaattgttaagaacattgtgagtacctactacctgagggatgaatttcaatggcacaccttattttgtttcatccttactacagctgtgctatcccattttacaaataaggaaaactgaggcttagagaaattaagtaacttttccataatttgtcagctaggaaatgatacaagttgagttcagatctaagttttcagaccccacgtcaaggggtttcagctttaaaaattacgagtcctgcccgggcgcggtggctcacgcctgtaatcccagcactttgggacgccgaggcaggggaataacaaggtcaagagttcgagaccagcctggctaacatggagaaaccccatttctactaaaaatacaaaaattagccacccgtggtggcgcacccctgtaatcccagctactcaggaggctgaggcaggagaatcgcttgaacccgggaggcggaggttgcagtgagccgagatggcgccactgactgtctcaaaaaataaaaataaataaataaataaataaataaataaataaataaataaataaagatgctttggaaaacctaaaggttgtgcaaaggcctctcacaatttcttttcatagttaatttatgaaaatgcaacacacagtctcatcaaagctcaaaattatctttttcatccccgttggtaccctgttgattcttccaaactaaaacacagctgcatataattcagatttattatactttattttatttttttaaataatttcaacttttagattcagggggtacacgtgcaggtttgttacatgggtatattgcgtggtgctgaggcttggggtacgattgatctggtcacccaggtattgagcatagtacccaagagttagtttctcacccccttcccttctccctccctcccccttctagtaatccccaatgtctactgttgccatctttatgtccatgtcatacttttttatgatgtaaaccaactatagtgtagtccaagaccttaaaggcacctgaagctgaaaaagaatgttaattatggcaccgtattatgaccaagtcatcccagtctgtgctgcgacatgagccctaacgattttctcattagcagatgctctagctggtttccatgaaggctttccacagtgacttccatagtcgtcataggcgactactatcagattccatctcaacgtttcacattcacaggcagaggctccaaaaataaattacaggcaagcttaaaagatcagaaaggctttcccagcatgcgagtgggtgattcatttgatttgtgcctgttacagtcattgtgtctttctctaggcttctttctgtttccgaaacacaaaactacagaaaccacctcaccctctttctgtccttagggttcatgctaattatgtttttactctgaaacgggttttaggattgaagggccatgtcgaatggtgataattctatttcagttagacaagagcctggaaaaaaaattattttaaatgagtttcagtttgcgcatttttttaaaaaaagagcaaaaagtatgcatgtatgtttgtttttacattcttctttatttttatcttcttactttgctttttaatgagtcattagcattggaaaatgaaaacaatttttctctagccaagaaatattgcaggtattacacattctcctacatcaaagcaaaggcactccaagccccctttttaatgaaaagagtttttagcaggtgggaagaaaaaaaaaaaaaagcacttgctcctgagatgataaaaagccatttttcactgcaaaattattaaattagctgtaaggagttggagtttgtatttggcattccttctcacctcaccccagccttcatctctcattgcatttttgtggaagggttatagatatactctaaattgttgacctatcatggagacggtagttagtctccaaattccctgtgggcaaagatgattgcagcctccctgctaataagtacacttcagttctatgaaatttatacttaaaagaaaacaatggaaaatgtggcacaaacacattgtcatatttacgcagatatgttgactcactgttacttaagcgtcaatgaattattcagggctcaagatggggataaatattcagggaggtaactgcactcattctttatctgtttgtgttattcgggtttttacttggtttctttatttttgcttttttctcatatgagaagtgttcagatgacagcacatccaacaacaaaattcagcccccatcctataaaaacgtcctctcttagactgtcttgttagttgtgacatattttattgtaaactaaaactaactgggaattgggttgtatttattttacactctcactcattttatttatttatttatttatttatttatttatttatttatttatctgttgagacagtcttactctgtcgcccaggctggagtgcagtggcatgaggcccaggttcaagcgattctcctgcctcagcctcctgagtagctgggattacaggcgctcgccaccacacctggctaatttttttgtatttttagtagagacagggtttcaccatgttggccaggctagtcgcaaactcctgacctccagtgatccgcccaccttagcctcccaaagtgctggaattacaagcatgagtcaccatgcccagcctctcttactcattttataatagatccagtctttaaagaaatataagccatttgattgcccaattatatgttgcaaaaaaataaaaatgttgaaaagtgtcccttccagtcaacagatatttattgagcacctactcagtgaagacactgttcaggatgcccagaatacaggagtgaacaaaagagacaaaaatgcctgccttttgaagctgacatttgagttgcagaggtgaggggaaagtggtggtggatctaccctaacatttgcgttatcactatgtgctcaaattcgtatgtgtatgtttcccaaactggtctcatcatcacaaacacacacatacacacacctttaaggttatactgctgttatccacgttttgcaagtgagaaaactgaggcacagcaaggataagtaatgtgtcagtcacccaggtagtgaatgacatgtccaagactctagcctgagcagtttgtctctgggatctgtggttttatggtaactaaaaccgccactcatggctagacatggtgggttgtgcctgtggtcccagctactcgggaggctgagatgggagggtgacttgaccctaggagttcgaggctgcagtgagctatgatcataccactgcactctagcctgggcaacagagagaaaaaagaaaattttttaaaataaattaaaaaaaaaactgctgcaccctattaacaattattgtggcaggtttttagtggcaaagaattctgaagtactttgttgagtgctcccacctaggaaactagtcttttacctaacttggcactttatatcaaccacaaccacaatccagcagtttccataaacagaaaaattataccatgactacttatgtaaagctatatgtaaggctccctatatatttatgtaaagctctctctctctatatatatatatatatggtttacatgtttctcccagctaacctttccatatatatatatatatatatatatatatatatatatatatatatatggagagaaagagagagagagagcttaggcagataccaaccttgggtgggaatctttcacatccttaaaaaggtttgggcctatctgatggccttgttgcgtcattgccctctacgtggctggacccagagcaagggccatttccagacagtctccaccagcccactggattcacctggctcctcagacctctgcctcttccatttccgtatgacctaatcacctgctgtcttttgatatattaagattttgtgccactctcctactgagatggaccttaaatcctcatgagctgatactgtctcgtctactttatgagaaagtatagcacagtaattaagagcacagcctctgagcatgtcagctaggaccacttcctagctccatcatttgcaagctgtgtgacactgagaacgtcacttgccttgtctgaccctcatcttcttcatttgtaaaatggagacgatactactgttgagaggaatatatgagttaacagatagaaagtaattaggataacacatgacacctagttgatagtatataaattatatttatcttttttttttttggcatcttccctctccacataatctcgtctcaactgcagggactacagttaagtttaactgggcttactaggcaagatgtggtactaaatgggcatctagtttaatgtataaaacacaatctctgtaagttttcctctattctgcctccgccacagttgtaagagagagacatttctacctccataatggtgtagatgattgaatgcaaatggcaggagggcaaaaaaaaaaattaaatgaagtaaatgaaaatgagctaaatgtttgaaaatgagctacatatttaattatattaaatactgtatattataccctgtcccaagagtctgagtcatcatttgaagggtaccttcccacaaccagccaagctgggaaaagataccccaccttatagacactattggctccctccagcctttcgaaaagtcttaacaaatactaaatctgcagactgcatttcattgctaaagtcttacaaaattttagttctcagcagagacattagtatctttggggaaaaaaaacccaaaggaagagatccttctagttttgctcactcattaaaaatgtgttgaataatgaatgaatttggtgtatttgtgtatacatgaagatgtactcacgtatatgcatatatagagaatatttgccaataattgttttatatatattctttctccatttttactgcctgaatactgaaaacaaatttcttgacttaattctacaaggcaaatatcacataatctgctatgccaaatgtcattgataaatcatgtatttatctgtgtgaatgtgttccaacttttaaaattagaaactacatgttctgtttatactttctctcactgatatatactgattattagatgatttgaaatttagttctaagtgcacatttctgcatatcctgcagtgttagcaagataagaacttgacttatttgtccatttcaacaaatattttcagtacctattatatgcctggcataggccctgtggatatcaaaataagtaaatgctgtcttgccttgagtagtataatattgcagcatagctcatggtcctggtaattcttgaggttaatgtgtgtgttaattacctatttataggtgtatccattaatggaaaacttcccaggatctactaggcatttaaagatgggagagtgagcttgttattataaataaattaagccaaccatttacttagaattttttatcctaatttaaaatacagataagattatatgacttttaaaaatcatcttgaattactaaaatacttaagtgaattgcaaaatcaaaaaggataatttcgttttacacttatttctattatcagcatttgtagaaaattttacacttcttatttcctagtttattcagaaaattccaaggctgttcactaaaaaagttaactgattttgcaagtaatctcatgagctagcccaccctaacagaaagggaccatttttacaccaggacaatgtttctcccagctaaccttgtttctggagggttgtccaagtcatccccagggaaacaacgtaaaagctacttcagattttgtgggtctcttgggacacaaacaccatacacgtgcctatatatgaccgtcactcacttgggtagaggctagcattgtcaggacagatgcaggtctgatttctcagatccagcaacttcaatccttggaatattagattaactctctcagcctgtgagaggaaatcaaagtggtggcagaaataatcccggagctcagactgaaatcatttcctcatgagctttttattttcatcctctctggtttccaaaactcaaattccttacttagtatctctctaaagcctgagtccttagtgtaaatgactatttcctttactctcttttaatagaactcaagattggccgggtgtggtggctcacacctgtaatcccagcactttgggagggtgaggcaggcggattacctgaggtcaggagttcaagaccagcctggccaacatggtgaaacctcgtctctactaaaagtataaaaaaattagccgggcgaggtggcaggtgcctgtaatcccagctacttgggaggctgaggcaggagaatcacttgaacccaggaggcggaggttgcagtgagccgagattgcaccactgcactccagcctgggcaacaagagagaaactctgtctcaaaaaaaaaaagaactcagtttctttttctctattgcttcctacagctaatctatagcaaattacataccttgtttgattttttacctattcactcttttaatctgagccttctgtctatcctccttttcccacatctgtcctagatccattccagttgtgtgactattgcactgctctttcctatttcaaacacaatatcattaggaataccagtatttatttacaatgacaaaacaactgagttttgtaattacataatgtcagtttatcaatatataatatccacttcctacagtcagaaagaggaacagttctatcatgtacaattatgatgggaaaggtggaatgatcccttatgcagcaattttaagtgagttcatgattttaaattacttaaaataagtgctaggaagctcccattttcaaaccctttattttcctggcttaacagaggaataaaatgctatttaaatgcacaattccattctaaaagaatggattctgttaggaaagaaatttaggggtagctctttcatttaaccaagcagcttgatagcttctgtatatgcacaggttggcctggagctgagtttgagagtaaggaacagagaaagacgaattactgtgtgtattcatctgagaaacatatggagttcctgcaggaaatatgagaggaagagaataaagaacaataatgagagtgagagcagtcagcaagatcagagtgctcagaacatatcggaagccagtaaaaaattccaacgccccccaccccccacccaccaaaagaaagtttaagaacagagatgcctgcttttcaaattaaaatgtttatcattccagctccttaagctttccttgcctcccccaaattaccagtaaaatctcttagcacagaaaatctttgtgtgagtgaaattctgtgaaaatcagaacaagaagctgagctattggggtccacaaagcaaagaacaggtatagcccaggcaagatgctgggatttgaacttgaagatggatcttagagccaggagttaccatgagaatttaagcccctgaaaattcatagacatcctgcaggtctttaaactttccataggtgccgaaatgaaaaaagttggtccagtataacccagtttttgaggatacccgctgatacgtgtactataatcaaacatcggtttgtcactgtcccacttaaaatgtgagggctaaaactaagcgcaaattccaaatgatttatttccagcacagagaagaagttgggacctctcttatttcctgaacctgattatacttctatggatactataaagcagcctaggtttacattatgtatttcaatccatcacatgctgatctcatagccacagatttttttattcacatgaacaactgtcttctctccctgttccccaaagctgtatttcataatttttttaaagtaatctgaacttaacaccttatatttttccctattaaattttaccttttgggtttttgtggccagcattccaacctgttcatacattttagagttctgattctgttaccccttgtctcagctgcagatttgatccatctgcctttacctgacaaggggttataaggagccgtggacaaagagaaagaatacaaatctcaagccctggaccgtcgccccacacgcctactaactgggtgtgtggcaagcacccggccagtgatttaacctttcagaaactaagtttccctgtttgtaaagtagaaaagccaatttctggcaaacttgcctcaggttattaggaaaaccaagtggggagtgtgtgggagtgtgtgtgttgtgtgtgtgtgtggccagcataacaccgccaataacaccacaatgaacgtggagccctctggggtaactgtgaagatctccttccaggccaggcatggtggctcatgtctgtaatcctagcactttgggaggccaaggcaggcagattgcctgagctcaggagttttgagaccaccctggccaacctggtgaaacattatctctaataaaatacaaaaaaaaaaaaaaaaaaaaagccaggtgtggtggcaggtgcctgtagactgagctactcaggaggttgaggcgcaagaattgcttaaacctgggaggcgtggccaggcacagtggctcatgcctgcaatcccaggactttgggaggccgaggcgggcagatcacgaggtcgagatagagaccatcctggccaacatggtgaaaccccatctctattaaaaatacaaaaattagctgggcgtggtggcgtgcgcctgtagtcccagctacccaggaggctgaggcaggaaaattactggaacccgggaggcggagcttgcagtgagccgtgatcgtgccactgcactccagcctgggcgacagagcaagactccgtctcaaaaaaaaaaaaaaaaaaaaacctgggaggcggaggtggcagtgagccgagaatgtgccactgcattccagcctgggcaacaaagagcaaacaaacaaacaaacaaacaaacaaaaaagtctccttcaggctcagcacaattaattatccagcatgtgcttcttgaacaccaactacacgtcagacccaaagtgttcaacataaaaaaattaatgagacaaaaggatcttatctaaagccattaataagaaattctaaaagattgaaggggagagttcagtcaccaatgaggtaatatttactgttaaattttattgctctgacttaaaaatggaagaggctcttccttactttttttcagatgaaaaaaggaaaagagatcatttccttctaactcaggaaaaaaaaaaaaacagggaaacactaatactctcagcagatcatattactcctaaattatctttacacttctttgttttctggtgtacacaaagaaaagaagcaatgatttgagatgattttgaagacaaagttcttcccaatgactagttaaatctaaagagattccccaaggctgaatctcagaagaggctaataaaatactgatatgagagatgagagagtctggcgaaatggtctggtgtggggcctgggcattatcagggaaatctaatgcaagtcctaggtgagaaccattgtaggagagacaaagtaaggagagttgaagttcaaagctctggggaagagcatcctatgatataataaaggataataaggatatacaagtcttatttttaaaactatcttacatgtttcctttgaaaggttgctttaaaattattaccgtaaatgattttattcttgaaattaacgatttaaatacaaatttgaggagcgtggtaaataatatgaaagttgcagactgggtacagtggctcatacttgtaatcacaatattttgggaggccaaggcaggaggtttgcttgggcccaggaggttgttgtagtgagattatagtgagccatgactgtgccactgcaatccagcctgggtgacagagcaagaccctatctctaaaaaagaaagaaagaaaaaaaaattaaaaaagaaagttgctattaaatcttgaggaaaatataattatctcagaaaaacaccatctgatgatttaagccaccatctgacaatttaaatcacttactctctataaatatttaaatttccatgtggtctgctttttgagtgatgaattttctttttttacaaagatatcattgaaataattaaaattgtcaattgattgcaatgtcacacttctcaaaaaaaaaaaaaattagtattgcagcgtctaaaccaaaagcataagggcagtgaatgcaaaacagatgttcatctcggtgggtgttcaaaacaattttttaaagtcagatgtctctgtatatgtgtttgtacagcctcaagacacggtcttaacagtttatatatttaaatgctcactcatttgatataatgtcaagtaaacaagatagcattaaaatcaactactcaattaatttattttttccatcctttatttctacggatttttcaaacatctagtactgaaggatcttgacatttttaacccagtacattccctccctcttattaatacttcacccaattatcttttttaaagtatcctatttagagggaagctagagcctataatttattttaatattctggtgagagatgagaaacaaagatatccatcaaagggctatttaattttagaaaagttaaccagccattagacattcatgggcaatagttcaaggaacaagaaccacaaaaaaaaaatgagagttagaattgaagaaacaaatctttaaccctcagaaaaccaagaggttttttaataccttattttctatagtagcatttagcaaaaggcaatgaaattctatccccaaaatgaagaagtttatgatggttctgacaataattcatttatgtagaattatattatttacactttcatccatgttgtctcatttattcctcccaacatctttgagtaatcattttacaaatagaaaataaatctgagtaatttctccattagccatagtgaatacaacacattaggaaattaatgccaggttcatctctctcaatgctcagtgccatttcccctgtatcagcaaatacttaggataactgtgggcctgggattgtggagggattggaactaaagcacacttaataaaaaggagagaagagttcctcagggctaatcctaagttaaaagggatgactttactttgtctgagtcagtgcaaaactacatttttttttatcaaaacagaaaacgaaaacaaagaaaaatggtaagtgcttcaatcataccatccaaagcagagaattaccatattcaagtcatggagctcccccaggcctacaagtatttgagttattctagttctctgttcctctgggataaaatagaataaaaccctgcaagactcacagggaaagccaaatgtggaaccgaagcaaaaggggcatttttggcaaaatgacaaaacacagtaagcctctataactaatctggacttcaagctagagatatttatgagcttctaaagagccactgggagagtctccccgtgcccagtgcccacctaaacttctgtagttacattcctcactcactatgggggcgccctctttgggaactttgctaatcaagctgggcactcaagatcaaatttttgctatacaagcaaattagtctcacttatagggggtcagtatttcgttttgtctctttagagacatatgttatgaatccctcaattactaatttagttttgcttttcagtttgatactctgcccccaatccatgttctttcattgaactgtaatgttttactacttgtcattatttttggaaaaacagtttctaactctcttgttactagtgctaatttgcataatttgaattaatggagaatttgccaacacttacgtagcttctacaaagtttgcagttgcttcaagaattttcacattttataaatccagtgacaaagtttagagttatctatgcactgtagtgtatacccttgttacattataatttttatacccctgaaagacttattacaaatcacagaaagccaaaatcattgtattcttgcctgaattgggtagtctgtttttttcaatttctcttaatttgatgaataaaaaataaatctatttttatgtgcatttttgaatatgaattatattttcaaatgtttttattttctctttcgtgaattgtttgctcaggtcttttgcctattatttcagcaatctgaggaaactctagggcaaaataaggaagctgctagccacattttataacttgcttaagaactggcaatgacagtttatcaggattttatacataaggattccaggagtatacttcataaccacaaacttgggagtcacaattcttttattgtgtaaatggtagaattcctgagtgcttggtgcattagttattaaaggaaataaaacaaaatttcaaaatatagtaaccatgaggactaatttgttacctactctttgtaaaggagatatcaatgtggataaaaacaaacctgggggtacatatattaagactttcaaaggcccttgacaatagtttagaataaaaatgatgtttcatttttttttaacattttataacttgtttttttaaattaaaaaaaaaacaaaacaggcaatgtgaatcatgtatttagagcagcttgtccatggctagtgaactggcttggaggtagcaaaccaaggacaactctccactaaatgaagtaaaattaaacactcgtgttggcttatgatcagtgctggaaacatctgactctgatattatagtgtgatttggaagagaaaattcacgatgacatttccaattttcagatgacaccaagtttttccaagtcatgacataccaagtcaaattgggaaggaagatagaggaagctcccgtgagtctttggttttgaggtactactccacaagggtaaacctttgagatgtatacattaaatacattaggtaaaatctttgagatttaccctataaggtaaatctctagtgtcattggcccaatttaaagatgtgaaaactgagtctcagagatgttagtttaagtcacccaagttgactcagccagtaagtgaggagtttgtatttgacatcaatctaaataagagcctatcctttactgcccccaatgtgagagaggaaggaatcacactcatgaagggacccaaagccaacgtggggtgaggggagggcaggaacctgggaagttggattcatttggttttttgagttggtgagaaacaagcaggtatatttaaatgtggggaagtatgaagtgatatttttaaggaagtccagtgctgcaggaaaatgaatccctggaatccatgagctttcttataccacttactggcaacacaggctctaaacactaacctgccagcaacatcaacccagttcattagctaacttttcctgtttggaaacacaatggcaaatattatcctacccagtacaaagccataaccccctatacaggaagaaagctgtggaaatctgaagtgaaattttaaaattgttatatattcctatgtatttaatatgtgggttttttggggggttttcttgtttgtttttgttttgttttgttttgtttttgagacagagtctcactctgtcggccaggctggagtgcagtggcatgatctcagctcactgcaacctctgcctcccgggctcatgcgattgtcctgcctcagcctcctgagtagctgagactacaggcgcgtgccaccatgaccggctaattttttaatttttaatagagacagggtttcaccatattggacaggctgatctcgaactcctgacctcaggtaatctgcttgccttggcctcccaaactgctgggagtacaggcgggtgccaccacgcccagacaatatgtgttaagcattgtgctaatacttcatatgctgggcaacatccaacaacctataaccctacaaacctataacccaacaaccctataagataaatctctagtgtcattggcccattttaaagatgtgaaaactgagtctcagagatattaggtaagtcacccaagcttacttagccagtaagtgaggagtttggatttgaaacccatctaattgaaaacctattctttactgtccccatatgtaagagaaggaaccacagccatgaagggactcaaaacgactgtgaggagggcaagtctggggaaaaaaagccttataatgttgtaatggctctggtaaaagtctgcaaaaggtagagatgggtgaagttaaagcaaacagagtctaagtccaagataaggtaattcatttataagagtcattaatgcaagtgctacaattgaaaattttttaacgtaaaatgtttaaactagtaagtgacatatttgcaatcagtggattcagaaaaattaagttactggagagaatattcctgtgcttgggttggcactaaagaaagataactctgtctgcctacaaaggaacctgtggtattgctgtcagaaaaagaaggctggggtgaattagactgaacgtttgtgtataatgattcttaatctgtacttcaaaaatgtatcattagacatgcagatatgtttacccatttttgttgttgttgttgttgttgttggccttgctttgtttttttggactgtttttccttatgtctaacttagattctgataagcaccaagctgcttccctacctgagtgccttggaatatgcatttttcctcttactggaatgttctttctcctctccctcctactaccattcaatggagagggcttctgggtagggtaggggcatcatgttatttttatttgctgaatcagggaattctacattctggaaggaaacttctgatatttgtgacaacggcgattttaaaaactgttcatttaccacatctttccctgagtccaaggtccgtggcagcagagaccatgtctgtccagcccccactgaggccagcgcagtgcctggcacacagggaactatcactaagccctggttcaatgccggacatccttcggcttgtacatgaagcccggtagctctgttttatgagggtaggaaacatctggtcaccattgtttatgaaatatttgccacctgaaaaaccattattattaggtcattccttgttccttgctttatttttctgagtttttttctctccattaagaacatatttcctggaactccttattggcaaggaaagctaactcactttttactttctccaatacccttattgagtttctctcttactcttcagaccgccaatgattagtggggaaatctaccaatgctggagcaaagacactatcccatctttaacggggagaaatttgtagaaccataaaactacagcaaaagtgttgaacacctctatgtcagccaatccgtggtcaccacagatgttcatagtctcacagcaatgcatgttacctgtatttttagaattgtttaaaacaaaagcgactattattatttaacaagttgtaatgctgacatggtaaacattaaaatatttgaggctaagtacgctcttaatttttttaaaagatttttgttatggagcaatttgaaagtctttaatgctccatatataaagaaacctttttatattttgctttatatatctttcgtttaataatcttgatttcagaatctaccagaatttaattctagagccctccaaaataaataatcagctttcaggttatctcaacaacttcactgatattttaaagaaaaacctatcatatttatactatttacttttatactatcatgtttatactatttatatttatactattcatatttataccaagatacaaattaaaaacactggaacaaaatacattaaaatggaaacaatgtttgccttcgtagggcataattttgagtgattttttgtttctatttttgtatttttatttgtatacgatgagatttatatgcaaggagaaaaaacaaacaaaatattcaattttattggagtccagtcttctaatgaagtatgaaagaaagaaacatgtagatctactattattaaagatttatacgaatattaaggatgttccctggggtgttttccccagtgaattgaacttgtgaataagtcctaagtgccagcaatgaaagcgaagcaggtatctgtcaaggctgattaggaacggagcatagagaatagaaccacagaaaccaaagaagactaaaactggttctaagggttgaggcctgagaaaaatccataccaggttccagcctttccctaactaaaaaggaggaagatggctgaatctgcctggtggggagaggggtaatttgctgcaggtggaaccactttattcagacctgagcaccgcagcgagccctctgtggacccgctttgctgagaaaacttgctgctccctgggttctatccagagcagcctggcgattgtgttctaattttccttttagatagctgaatatgagtattagaatgaaagatctgatattagcagatcaatcatctctttctccactttctgttacacaattaaaccagcaggtgaggcagagtgccgcaaaagtaagtagaccagctgttccatttcagaatagacttgccaagcataacacatttagaaacaaaatgcagttcattccaaagcagttgatttaatccctcattatccatttatgtattcagcatcatggcccatcttgacaccttattaataaattattcaaaagcttacctctggatagcatagttgttaagacctagggatccagtcaaaaagagggatcgattgcaggctcagatgcaaattaactctataacctaagacaccctatttaaccttcttaaatcttcatttcctcatttgtaaaatgtgtatagaaccaccccgaagttccgggatcatggattagagagagaaaaggtttaagacctcttagcacagcttctaacacatagtatagtcagtgttcgtaaatggagttcatattaataccctttttttttttgagacagagtctcactctgtcgcccaggctggagtgcagtggcgcaatctcggctcactgcaggctccgccccccgggttcacgccattctcctgcctcggcctccagagtagctgggactacaggtgcccaccaccacgcccggctaattttttgtatttttagtagaaacggggcttcaccgtgttagccaggatgctctcgatctcctgacctcgtgatccgcccgcctctgcctcccaaagtgctgggattacaggtgtaagccacggcgcccggccatattaataccttttaaaatagggaccagaagttgaagaagaagaagtgaagaaaaaggtaaagtgttttccctcttccattcacatatatttttcattttttaaaaatgggctttccggaagtgaaactcctgtaccagcgaagcaggatgctttcaatgtgtgcaaatcaacctcttggtagcctgccttttaaaagctcaaactatccatccccacacaagtctgggactcttaccctgtgttattttttaagtcatttaagtcatgcttgagaggaacatcattgttactatcagtcttaacatcttaattcaaaccagcctaacaaaaaagactgagaaaatatgaaagtacagaaatttgtgctagagaaaaagatgggaggaaaagtgtcacaccttggggctgccccgatgtctctttgcctcttaggtgcagggtactccatactctcgtgactaaggcatgaagcctagaagaagtggctacttctgcctgtggtttatagccctactttattctagacagctccctgcacagattagaaggcaggaagcagagcaagtgttcctgtaatcagcctcccccgggaactgtcagtattcaatgggctctcaactcacatttccacttgtttttgttttgttttgttttgttttgttttgagacagagtctcgctctgttgcccaggctggagtgcagtgacgggatcttggctcactgcaacctccacctcccggcttcaagcaattctccttcctcagcctcccgagtagctgggattacaggtgtgtgccacctcatctcagtaatttttgtatttttagtagagatggggtttcaccatgttggccagtctggtctcaaactcgtgacctcaggtgatctgcccatctcagcctcccaaagtgctgggattacaggcgtgagccaccactcccggcctccacttgttcgttcaatatacgtttgccctatagagttccatgcatctgagaatattccaacaaatcttagaccatttccaagcaacggatccctattgtactatttcttctatttctctctgtaagcattaactttgaaactacagccattaaatcatattcattagttcattccaggcataatcaatatgttggactaggacaactcaagaagtaaacaaatcataatcaattcctcttgtcccctacccctttaaacttattccattggactgcagtaatcttcctgtgtcccaatgtggaaacacatagacactatccactgttacgtaaggtgccctacatgtgcattaaatctcaagcacggtctccttcagtagtaagaaggcctaatcccatgtaattctcaaacctctgagcttgttgtggtatgagattttctcccctaccccagttaggacctacttcaggcttgagtcagctgtgagcagggggattccctcctgctgttaatctctccctgctcacccctgtctgtgcacttcctaccagcagggatgtgggaaagggagggaaggtggggagataggacaatccttacttggctgggtagctttgctctctctggtcctggtgatggctaaaaccagctctttttctcattgagtgctttgtaggctctacagagcctatgcagagcccttcgtctcctcattaccaatggccatttgggactccttcctcagctcctgcaaatcagttcctcatcttcagcctttttctgatgaggtcacctctcacccctacgggctactgtgttgtaccaacagcagctccatccttcatgtcccatgtttactcatcccccagctctggcccccaaactgcaagtgaaaaccagtgctggcagatcagcgcttccctggctcctccacacaaaggcactcagatctcctttcctgtgaaactttccaggacaggttagaccccagtccatggtacactttacctttctcaggcaggagtcaggcgccagccctctgggtatcccacatgcaaggaaggcatttcaaagcggtagaggtggcccttcctccatcaccaggcttatggtttggagataacacccctccctcagctctttcacaaacagaaacgtgcctggcagcagctctctccaagtgagtctcttcaccagcccttcttccctctccgaactctgaccactttttatatccttgatgcgctgaagggcccaagagtcttggaactggtttttaattcctttctttgaaaatccaaatatatggatctgtctcagatacacgtgggtacccattatccaccaccatgcttgtgcttccattgaagcagagaccagaggagccccattctaacatcctgttacataagtgaaaatggaatttctttggaatgccatttattgtcatggtgccaggagttcatcataatcaacattacaaaggaaataccaaaggaagcaataatgatttgccatttattgtaaaacatgacctaggtgtgtcttttttctctgtttataaaatgacaaggttcaaattataatgtaactttccacatagcaattgaaatcacagactgagaggttattacaggactaggttggaatgaatagattatccatatgatttgatttaccctaatatagtttcttttagttccaacatgaaatctcccccttttaactcaccctgaattacaaatgacttaacagaagcagaaatattttctctggaaaaacatagtaaagtgtaaatggaactctggatttttagccataacaagatttttacactgtatttcccccgatgtatctgccttaagattcttcagtcacttcatgttgactgtttagcctctgaaaactctaattagtttaacaagttagccagccaacgccacagcaagactatacacaaatagagaagatcaggtcagttttgctgaaaagaaggatcattaaaggtacagagcatgagatattgacccaacccttctgataaatgatacagaaactatttgctcatgaacgagtaaactatgcccccaccttgacactgaattttaatcactagaaatggaattatatcaaaattcaaacatagctgaaaaattttaagataacatgtttaaatatgcacatttcaagtaaaagaacattattatagtgataatatcagagccatttgcagagaacttttgagtcttatcaagaaagcaatacataggctgggtgtggtggctcacacctataatctcagcactttgagaggccgaggtgggtggattgcttgagcccaggaggtcgagacaggcctgggcaacatggcgaaaccccatctctacaaaaaatacaaaaattagccagatatggtagtgtgcctagctactacaggcacctgcctgtagtaccggctacccagggaagttgagcttgcagtgagctgtgatcacaccactgcactctagcctgggcaacagagtgaaaccgggtctcaaaaagaaagaaagagagagagaaaaaaaaagagaaagagagagagagagagcatgcaagcaagcagtatataaaccagtgaattttacctggcgcttttaaaaataatatttgagttcatatgaaattcaaatagcatcttacaaatttcaatgtatatttcctagaagtaattcaaggtaccctcaatatatgctgtcaggtagagtataaaggggtgtaatgatcaatgcagcaacttcatgacagacatgagctgaaatgggttgtagaatgttctttctgaagacccataattagatttctagcttgttgttcaataaaatagttcaggtaccctaagtgaagtacatgacctctcaaacaagaaaactgtctcattctgcaaggccagttgcttgcttttcacagtgacacccatcaccttactgaatcctttaagaatgaagttcttcttgtccagtaacactgcagctggaaacaaggcagacgctggaaagcactagaactgtgcacaatgttgacagtgtaatctgaaactactcagcagttcctagtatcaggttcacacataatttgaaccagacagatttcttttgaaactttctcttaaaagtttcatttaaattggaagacgaagagtatgagtatcaagaaattactcttagtaatccaaatgaattaaatgatcctaaaatgatttaagtgattcatagcactttcccaagcagtctctgtccccatagtaccggtttctgtatcaagctgtcaggagatcagagaagaagctcattaacccagtcagacatgtattcaaccaacatttgagttcctagtaagtgccaggtactgtcataagcaccaaacctattagttttgtggaaggcaggtctaaccctgtctttaggaagctttaacccttatatccatattcacagaaagctgacctaccagttgaatgcccactctggatatgggcaaatattttattctatttttaaagtgcatacatacacacaagtactctagcataactaagctgttggttatgatttatttgctttgaaaagcagagttgcctgcaataatagaggaagcactgtcagtggaaaagtaggaaaacacatctgcagtcaagagggaggcatttcagtgcctgttattatgccctggagccaagatgatgacagtgagacatgagcagccctatatcaacccagttctgttgggttctgtgctctgaggcctccctggatgcagtcaaggataagtcagtgaagcccaaatcaccaccaagaccccttcctttcccaaagttgctatagacagatacactacctaataagggctaataagcagacgaccaattttctttttttttctctctctctttttgaaacagggcctcactctatcgcccaggctagagtgcagtgccacaatcacagctcactgtagcctccacgttctagggttaaacgatcctcttacctcagcctcccaagtagctgggactacaggctactacagagaatggaccattgtgctcagctaatttttaaatttttttttggaaataggggtcttgctatattgacttggctgatcgtgaactcctggcctaaagtgatccacctgccttggcctcccaaagctctgggactacaggtctgcacctctgtgcccagccccagatgaccaactttcaaaaatccttttcaagttagaaaaaatatattcaaaacatattcatacgcttttttcttaacttatttttcttaatcttcattcatgcatataactcacagattattcaaacttctcttattatttttctaaccctttaaagaggatttccaaagcttagctttacttgaagtagagtggttcccatccattgatattcgggggaagtagttcatctgaaatgaggccagtattgagacttcaacatatataaacttaattatttcaggaggaatgtccgtgggaaaaaaaagagctaccgtgacttttccctccactaatcaacagatatttccatatgataataatatttaaattacatgtatttgctcagcactttacactttacaaggcacttttacagacattgcctaaatatttattctcataacagctggattattatctacaggtgatgaacttaaaactcagagaagtggaaagattggctcaaaggtcacaaggataaaaaaaaaaaaggaatgcagacaccgtacttctaattctaagcctcttttcactctatcaaattaccttccagtatgtgccatgagtcataggaagaacatcatttctacagtcaccgaatatctgttctgtgccttttatatttctggcactgtactaggtgatttacatatattatttctaaacctaccagtgtttaaagtagcaaacaaaggcacagaggaggtaagtacagcctgagattcattcattcatccatcattaaagaagttcaggagtaagtctgtgttctaagcactggagatatcgctatgaacaagacagattaggtttctgccttcaagtttatgtgctggcaagaggaaaaagatagcaaatacataaacaaataagtaagtaatgtaattttaaatggtgttaagttcttgaaaaagataaagatgcaggctggaaagtaaccaggactacaggattactttaggtggtgtggtcaggggagatctccctgagaaagaaatagttcagctgagaggaaagtgttgctggaaaagaaaaccagtagagaaaggcactgaaatgggaatgagacaggcatgtttgaagagagggaaggaggccagtgtggctgaacatggagggtccaggaggtgaccctgaaaagaatggagccgtgtggggactctaggccgtggaaaggaggttggccctcattctaattgcaatgggaagccattagatgattctaagagagaagagtgatctaagttttgttttcagaagatgcctgcagctccatcgtttgtgtagagaatggactatatagaagggtatgtgaaaggcaagagatgagtgaatccaaacggaaaatagaagtggagatggtgaaaagaagttggatttgcggtatatttttagagagagagctggaagaacttcctggaagattgtttgtggggagtggcggacagaagaataaataatgatttggggcctgagcaagtgagtggatagtggatctgttagctgaaatgggaacaactggtgggtgggcaggtttcacaggcaggtggttgagaagacagttggtgtcaagcttctgttttagacatgttaagttggagatacctattaggcatctgactagtgatctcagagcagttgtacgtaagaatctggagctcgggggaaagggatcagaagtggcttacataaggcagttaaaggcatgtcttttctgctaggaaatgagacttaggcagagccttgaggttctctatcatttaaagacacatagaccataaccagaaacatcatgctgtcagtcagatatctttctattacatcactccatctccatgattaaagtcaaatctcagtaaaactgagcacatcaagaaaccccaaaaatattacatataaaactatttgccaattttcctcttcagccttttcttttgttagtaattttaatttgtcttttaaatgaatgtagattttcaagtgtgacattttagcaaggtcaaactgttcattatcagttaaagtcatatgaaaaagtggtaatgttccctatttatatatataatgcattataaaaaacttttgcttgatgtgatgtgagttacaagctaagattttccaagaacaggtagttctccattatataaatctctttctcaaggcattgattgtctgtctgtgttctactaatgaccaagaattgtgaagcaactctagttctgtggaagaaaaacatttttaataaaaacttattcatatgaatttatggggtacaagtgtaattttgtgacatgcatagattttgtagtgtttaagtcagagcttttagggtatccatcactcagataatacacctcgtacccattaagtagtctgccttcatcacccttctcccagccttcacccttcccagtctccattgtctgtccacatggaagaaaatctctctgggcttcattaggatgagaagatgagagttttattctgagcctagctgtcctttactatgacattatcatagttcatagtatccaaatgtgactcacagggaattcactcaacagttactgagatacctgaattaacatttctaggtcttttgttcaaatgttaataaagccagtgcttcttagaggcgaggtgaggttagataaggtcacgtagactccaacataaccagtgtctcaagtgaggtgacctattctccttcaacctaccatgacgttagcatttcatctcttcacaattttttctataaacatataactgcatattacatttatttctttgtctacttagcaaggatctgttcagtgtctatgacataacactgttaggcacagatagaaatacaaatgaaatgcattgctcttcaaggtcttactagaaaagatgaaataatctaaaattgtggatagactaaacaagatgttttctatatatggtcgaggagggattatataatgcctattaaaattcttgactgagactaatgacagaaatccatggaggatttaaacatttgggggctaaacctatggtaataaaataacagcctatataaattacatgtactattatatatgcacaaaatgaatttctctgggatctcaaggacattaatgtaattattcatttcaagtttatatatttatgtttttagagaaaatcactatagattaagtcataggtctctacattgatcaaaagcagatccaccctcatatttgctcccataaggggaccacatactttcttaaatttaacattatattacccttaagaaaacttggctgggtgcagtggctcatgcccgtaatcccagcactttgggaggccaaggcaggcaggttgcttgagcctaggagaccagcctgagcaacatggtgaaaccccatctctaccaaaaaaaaaaaaaaaaaaaattcgctgggcatggtggcacatgcctgtagtcccagctactcaggaggctgaggcagcagatggattgaacccaggaggtcaaggcagcagtgatcctgggaggaaaatgagaccctatctcaaacaatagaaggaaaagaagctttagtctttcacttttttttttctgaccaatgccaccaacaaaagcaactattcctgttcaaacttacattcattaaacaaatattcattgaatgtttattataggctagatgtttcagtagcctctggggatacaaggggatatttagagaccattccatgctctcggcacaagtaattacacatgtgatgagtgcagcacagagctgggggagatgcaacacctctgcaggaggcttagagataagtcaggaaggaaggtgttccagaccaagaaaaccaaacctggaggtaagaaagaacacggtgcattcattcagctaaaacctatccagcttgacttaagccagaggagctccagagagaggcacatgaggagactggggaggtcaggtggccaggtctaatgtcatctggaggtcaagggaaagccaggaggtcctccagcaggaaaacacaggtgcagatttacactccgagaagaccactcctagaagctcaattctgcttcatggtattactagtttattagtgaataatatactttacattgtcaccatcaccccacttcatgaaaaagaagagctcataaaaaagaatctgtattgaattgaaaggtaaagctgtcataattgaaaagctgattccttgtcatatttttttaatgctccatgaaattttatagccttgagaaaattttgacttctaaatctagccaaataatgctagtggctgttgcagaattagtgtgttttgtgttatataatggtgtggatttttttttcttccttaaaatactcttagaacttttgacctgtcctgtgactgaattctggatactattggttataatagtgcaaaacaggtcagagataacataggataaataatatagtctcttagcacttagccaatctctttggccatcatcccacagaaaatattcttcaggagtgctaaggtatcagttattagaaagtaatctatttttagaaacaccaaactcagcttaccttcttttctagatttagaccttgttttaaagaatacaattctttcagtttttcacagggagacatttatctatactaatcaattccactaatttatttatttatttttaattttgagacagagtctcacagtatcacccaggctggaatgcaatggtcgatcacagctcactacaaccttgatctcccagggtcaatcaatcctcctacctcagcctcctaagtagctggagctacaggcatgagccaccaagcccggctaattttttatatttttgtcgagacggggtctccctatgctgcccaggctggtctcaaactcctagtcctatgagttcctcctaccccagcctctgaaaatgctgggattacagggataagccaccatgctcagctatctccacatatttatgtcatggaaattgtactgattcttgagtccatgaagagtccatgaagatacaaacatgttctgttcaataaacatattgttgttagcatgcttctttctacagtggcgtgaggattaccatctcattattttcctatactcttagttttaaccagctattaaaataaagtgctaagcagaagaaatctgcatattaatataaacattgggctcatttatttgtgtgtttttcatgaacacatgatgaggtgtttctggatagtgtggattggtcaggcccaacagagatcagcaaatgcagtgaagccagagatacaccagattgttctttcaaaacttcctcaggaaacatgttgtcttaattgaggaggcaacacagaaaaacaactggaaccacattctgcagcactttttctagctatgagcatttattaccttacttgaacagtgagttgtctctgtagctccattttgtaagtagccaaattttagtagcatcatgtggttctcacatgtttgagttaaaaaattatttttataaaaacaaaaatagacaaataagatttagtttaactaaaaagcttctgcacagcaaaagaagcagtcaacagagtaaacagacaacctacagaatgggagaaaatattagcagactaggcatctgacaaacgactaataattggaatctacaagaaactcaaacaactcaataagaaataaacaactctatgaagaagtagacaaaggaatcaacagacatttttcaacagaagacacacaaatggccaaaaaacatatgaaaaaatgctcaacattactaatcatcagagaaatataaattaaaaccacaaagcaaatggaaagcaaaattgtggaatcaacctaagtgtccaatgtccatcaatggttgattggataaagaaaatgtggtgtgtgtgtgtgtgtgtgtgtgtgtatgtagatatatatattatacattatatataatatatataatatacacacatgtacaccatggaatactactcagccataaaaaagaatgaaactggaggccattatcctaagtgaaatgactcagaaacacaaagtcaaatgctacatgttctcacttataagtgggagctaaacaatctgtacacatggacatagtgaatggaataatatacaatggagactccaaaaggtgggaggatgggaggggggatgaaaaattacctatcgggtacaatgtacgctatttgggtgatgggtatactaaaagccaagactgtaccactacataatatgtccatataataaaactacatttgtatcccctaaatctataaagttttttaaaaaagaagtgattttaaaaaatcaaacttttccattggattatctattgagattcttttcaattatctacaaatatttttcattttagtttttaaaaatactctaaataaaagctgaaatttcttactattctaggccagagtttaaagcaacatgggcccttttggttttatgaatatattagtttattagtttttatttctattagtaaccaataaatatatagcaaaaaaatcattaggctttatcgacctagtgataaagagaaaattagaggtacatagataatttccatcataattgatcatttttagaaattctatagcagaacactgaaaagcatcctacttgttaagcaatttattccatttttctcatggtattgggtacactaaaaattggtcattaaaggcatattgaatattcttgttttcatgtacctctgttcattatatgaagttcaattcaggatttgaagtctttccttcacacaatcccacaaaaatgcatatggtgagtataaattgaaaaaaatagggtatttctctaaatgcaaaaagaaaaacatctgtctttaaatttttttaaaccctgcctaaattgacatgtgctttacattagtcctgtattattcaaactttcatacttatgtgtgcattatgtatgctcacacacactttagtgatggggtttgtgtatgtataaggtacctgcaaatccaaactacttcatttgaaatttgggaaatttttcctaaaataacttccacaaatatatgtgtgtatgtaggtatatatgtatattttatatgtaaatatttatatatgcatattatatataatatatgtattctacaaatgtattatatatctataaaatagtaccatggaatgctttaaatatattgtaattggttttcagagttggggtgtgtgagttgttctatattttaaggatagtgtcctttttaggaaaacatttaagtgtgatcttttagatagatgtgccttcctgaagaaggaaagactaatttaaaaaaaagaaagaaaggaaagaaattatctcctggtctggtttactttttgcaacagctgttaaaattcggacagtgacagagaaatatctgtagcagctctacagatgtttacaaaagaaaaatatctcctttacctgccttggtgagcatcttatcagcaagcacattaactcaaacaatagctactcttatctgcagaggacaggttcaggctcattagtgaagtgaactggcagccactcccctctacatagcaactggagcaaatattgttccagcccgccaagtgaccaatgagaactgagatagtgccgtggaatcttttcaatacgagtagtgttagtgtgaacaacctctctttgactctcattcgccttctcatttaatcctaccatttcaagagaatgatctcatctacagactgtaaatacttggggacttttatgaagggaaaatattacaaagggctgaagtttgcttcaagaacaacttaggtaggcacttcagtttaattactagcaacttgcatatgttgtggtatttcaaaagggctgtagtgttagtacactcattatggaaatttctaaatgtcagtgtatgaatcagtaacggtgatgatttttattattctaaaaagatctctaagataactaaaattaagcaggctgcacgttctctaatcatgtaatgaatgaatcaggattcttgtctgagatgcaggccaaatgtgctctggaactggttagtgcggcatatggtgaatctacatcagacttgacccccgcaggtttgtaactgaaactttgtataaattgaccacacccttcattaactcttctgctgcctagaaaataataaaaattgtgaagtgggactgatggcttttgaaaaatacaatcaggggcttgtgtctctttgcaattctagaagaaacgtcacaggattttaattcctgccaagcaatattgaccacgtttcctgtctcttcccttcttgtgctttttgccttgctttatgatgctggcaagtatggaagcctttatctaccgtgtaaatgtatatcgttgtaattcaacagggaaccgggcttcaaattacagcctccgaatgcaataaccttggttatttaccgagtacaaagtaaacaacttactttactgtcaaaagttttactgcaatatgttgcggggcttactactagaacaaccattcaataattgtctgtctatttaacgggcggattttatttcaaaccaaatagatactgtctttgtaaatgctgaaatgtttggtttttgtttttagcccagaagaaaattcccataaatacaaacccattctggccacctaagaattttgtcctagaagtggcatgctttctttcccttacgggttttaaaacttggccacatggtatttttaagttggcaaagtaataccttttagacacgccttcaggattttgcttaattgagtacagcaggttaacaaaagtgccaatgttcctttaaaacaaaaaccaaaatgctctgtggacttaaagctaatgctaaatattagattaaattgccaattgcacttttccatgtttatcttctgagataggaataaaattaaaatgtgttaccatagaagcatctgtaacattttatgagacaaaagatccttttttccacacaaagatccaagccaaaagcattatccattaaggaaagcaataaggctagagggacatttttttatagtcatattatggaaatactaaagatccaatgtcctgaagtcaaattgggaaacacagctgttcacattcatttttgtcctggattgacactcttggttaattcctgaatattgatcagttcttatcctccaacatccctaaaactggaaaagttttctcctatccacatttattctcaaatcacattttagggaataacaaagaggtgaatataaatctatgccttgtgaagcatttatttaggctctatgcctgacttggttttgtaatcttgatttttattctctggagcttatttctttggctctcttctttgaaaataatggcagggttctcatctaaagaaaaaacatagagagcttttaaaaccttgcagtccatgaattttctttgcatttcatcctaaccaccgttgccttctttaccattcagttctcctttctcccagaagctttccagagtttcttccctcttttccttctgcttcatttattctgcaccacatgctctaaaacttaccagttcattcatctatttactctatgtgtgattctgtgaactgtaagtagaagattctagctggatccattttaaaactaagataacttttttcccctaaacgtaagcactatgtccaagttatcaatcaaatttatctgctttgatagttgactcattacatacctgaaactggaaaagttttcttccattcacaattcttaggttagcttaatatttacgtaacttatcaaccattcaattagaagtttttaagtatatctaaggaaaaaattttaattgcaatccctgacttcatttaaattccagttgactcccaaaatgtgttacttttcacagatcgagaatttgtaaaactatagaagtcaagccactcagttctctgtattctccttgtctgttgacaatttttagcattctttagaaatctggttttatcggcagaatgcaagattcttgaaggtaaatttcatgctatgaacatcagccttccacaactgcttattgagtagactactaagccaaagaatcttaaagctttctctgtagattttaaacctgaagagaagttaatgttctgaataattctattgcctcgagactactgtagatgactgagttacagcatttttgtttataagaattatcagtgccaggcctgactgagttacagcattttttatcagtgccaggccgggcatggtggttcacacctgtaatcccagcactttgggaggccgaggcggatgaatctattgtagtatggtggctggtcaataggcttggcccttgtaatacctgaagcactagaagcttaaagcctgagaagaaaggccttgcttagtaagaaatcgacttcctgtccctcctgatacagtactcagtgcagtggacacagctttttcttcttggcagtgaaacctccctctgcacttgtcaccttaagcactgcctcatcaccaccattatagccgtcagtttgtggtatcatttttcagcactcagtgtggtccaggtactctataaatataccacatccatgatctgatttaatcttcacaataatcccatgatatagatatatttgccagatacggaaactaaggctcaaacagaacagttatccaaaatggttatgtaggaaaactggggtacaaactcaggtcattctccctccaagggccaagattctaactgctttttcacagcggtagaaaaatattaaggggaacctccaccttttgatttgctctgggttagtaaaccctttcactaggtgtggacgtttaataggcctctcaaactcaacgtgtccaaaccgaacacttgatttgatatcccccttcccaatctgttcctcatatagtctcagaaaatggcaccaccatctagccacttgcttaaagccaaagcctgagagtcatactctgttccttcacagcttacttcatcagcaggtcccattggcaaaacctccaaatctgaacacgcttcttgccacccacactgctcagccctggtccaagccatccttccacggacatcagcagctacctcctaaatagtataccttcttttgtgctccatataatggtcagagtgttctttttaaattgtaaatctgatccagacatcagcctgccaacaacccaccagcacaggtggttgtcagcaggctgatgtctggagcagatttttttttttattaatttagaacaaaatcttctgttcttaatataatctacaagtaaggcccagccagcatgttctagagtctgtccacctctccaccctcatctaccactcttctccccaactcacgcctacagctgtgttctgagtaagctttctttccatttctcaagatttccaagcacaggaagtctcagggcctgtgcatttccagttccttctgcctggagtgctctttttcctagatcttctcatgatgacaggtctcagctcaaaagtcaccatctcaggaagccctgctctgaacactcccgccaaaggatccctcccctaccccatttctttctaccccattgcctttttttttgttaattgtgtagcatttaccactctctgcagtcatttgtttatttacctgcttatgtgttgaactatctctctcctttcactaggtctttagttccttatcagctgagtttgtctgtctttcccaattctatacccccagtgtccaaaacaccttgacatatggtttgaatgaatgagtgaatgaatggctaagaagattgatggtcatgtaaggaaacatatcccaaatacccttctggtttttattggtgggggacaataaatcagtaactacaatttagagagatgattgctatgactgaaaggtatgaagagttctaaaagaacgtgggaagttgggaaggaaccatctcaggctgagagggttagaaaaggatccctggagaaaatcatgcttctaggaggccctctttcctatggtctgttcataaagcataaaggtacccttcccaattatacgaagctgcataccattattggtgtggaaaaacagtaaccctggtattgtatttctaaatgcttgagactactaacataatcttgatcactatgttcatttatccttggaatacaaccttttacgtttgaatcttaattaaagagaaaacaacttctgggaagcagcttttttttttttgcaaggtttatcctcagcttgccaggatagctacatttttggatgatctgtgccacgtcttgctttcagactcttattggtattgtcgtggtgcttaattaagcataatactagcataaacagtatagtcatggaatgctggagataataaaaagggcatgttgagaagcatcagacacttattgcatagttaaaaacatgactttcagaaacctcccaaagtcagagaatgtttagaaacttattttggatatcctgagtcacttcttactttcagtgggtacaatgggatcaatcactgattataaattattgtgctttacaagatgcttaccacaaaaaacccccaaagaaacaaaaaattaagaaagaaagaaagaaaatgctcacacagatgtcccttctagcttttgccactatttagcctcttggttaaaatgttccagtagcttcttacttgtcttcttttcttgttattctcatcttcaaaccactgtcaggccagttataataaatgatcattttatgcctccattatgcaaggcagcatattgcagtgaaattatttatttgttatgtctgtctccctaatagactgtatgttccttgaggaaaataactgctattctatctttgaatttttagtatccaatatcgtctaacctgtggtagatgctcaataacaagtttggggaatgaatcattccccaaagccttcattttattgtctctcccatttataagagtggagaaaagaaatatcaagtaccaactcttttgccctgaatgagttggaagttggcagcacttcaaagtagaacttattagctactatagagaactcataatatgatggctttgtcacagaggctctaaagagtcagaaaaacaaaacaaaagctagagtaagagattaaagctagaagagattcctgaggcttagaatgtatttatcactctctgactcacttaaaaatgagagatcaacattcaccagcatattatgtcctgtcttttcccaattgttctatctgctattattttaatatccgggattaaaagcttagttagcctttgagatgctagttaatgcttcttaatcaccatgactgcaaatcaggtgtctgccaccagctgaatccctttgccttgcatgaatctgattcgctacagcaatagttctctcactttagtatgcatcagaatcacctggagggcttataaaaccgtagataacttgagctccaccccacttggattagtccgttttcacactgctataaagaaatacctgagacttggtaatttataaaggaaagaggtttaattgactcacagttctgcatggctgggaggactcaggaaacttacaatcatggtggaggggaagcaggcacatcttacatggcagcaggtgagagagtgtatgtaggaggatctgtcaaacacttataaaaccatcagatctcatgagaactcagtatcacgagaacagcatgggggaaaccgcccccatgatccaatcatctccctccctcaacatgtggggattataatttgagatgagatttgggtggggacacagagccaaaccatatcaccactctaaccccagattttttattggtgaggtctgacttggggatgaagaattggcatttctaacaagtctctcggagctgccgttgctggtcttgaaaccacaactttcagaactcctggtctacaatgcttctctcagtttcatgcacctatgaatcacctggaaatcttgtgaaaatgcaaattctactttagtacatctgagctggggcttgagattctgcattctaagaagtttccaagttatgccactgctattggcctggggaccactgttgaaaagttctctcctctggctgcatgttagaatcatccaaaatcttaaaatatcttgctgcccagaccctgccacaaaattccgtttcaattaaccttcagggaagtaggggcagaaatctatatttttaatgaggagctccaggtatttctattacaggtaatccatagtccacaattggaggaaaactggtctagaaaggataaaatcatctatggaattttcatataaatataattgtctaaaacatatgtgagttattaaagaatatattttttaaagtatcattgcatttaattgttcctaagatgcactttttaatatttcaatatctctaaaattggaacacttcataatctgtggtgcttacaattatttaatataattggcagcattttctttttttttctttttttattattatactttgagttttagggaacatgtgcacaacgtgcagtttagttacatatgtacatgtgccatgttggtgtgctgcacccagtaactcgtcatttaacattaggtatatctccaaatgctatccgtcccccctcccccaaccccacaacaggccctggtgtgtgatgttcccctccctgtgtccatgtgttctcattgttcaattcctacctatgagtgagaacatgcggtgttgtggttttttgtccttgcgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagagcatgatttataatcctttgggtatatacccagtaatgggattgctgggtcaaatggtatttctagttctagatccctgaggaattgccacactgacttccacaatggttgaactagtttacagtcctaccaacagtgtaaaagcaaaaccacaatgagataccatctcacaccagttagaatggcgatcattaaaaagtcaggaaaaaacaggtgctggagaggatgtggagaaattggcagcattttctttctctgtgatacataaaatgattagtagtgataaatgaaaaacttcaaccgaattaaatttaaaagagtttaattgagcaatgaacaattcatgaatccggcaggctcgaagactccagcacagccataaggtggaagaagatttatgaacagaaaaaggaaaatgatgtacagaaaatggaagtgaggtacagaaacagctgaattggtaacacgttgatgtttgccttatttgaacacagtttgaatgctcagcagtgtatgagtggttgaagtatgactacaggaattggccaagactcagctattgttatagacacatacacctaagttaggcttttcagtcttttctaccgactaagttaggttatggtttgcccacaaggactcaaatatggaaatatagagtccttctcaggccatatttagtttgctttaacagtagataaactatgagtattcttatttctattaaatacagtatatcaatttttaaagatctgaaaaaaatgcatgacattcacaggattgtaacatttgttagcacccatttaattcaggtttttcttacataggaaggatttaaaatatatcaaaagtatttgcaatttttattctctaagagattgtttgttatgctggggcaggagtcaagagtagagaggcaatttggaaactgaaagaaaggctaaattgaccattactcaaaagaggccaccagttccagggactcttggaggacccaagagtagagaggcaatttggaaactgaaagaaaggctaaattgaccattacgcaaaagaggccaccagttccagggacttttggaggaccttggccaaagaaagaagaaggggaatgaaaggacaaacccagcatgcagcaatgggcagcagaagaggaaaagaaaacagctgaacagctgcctggaaagtggaacttcgataagagaggacacatgaatgggggcggggcggggggaacgttgtgaatctctcatcacttcctggagaaaatgttacaaagacccatactacttttcaatgttctttcaatttaatgtgtgcttcctttggatgcaggatatactgaggcaaagtagcctagaatattcacaaacaacttgttaatttgaaatctgataataaataacattggtttgttctacattatcttctagggtcagcaatttccctggacatacaccttccattaagttaggatttaaaaaacatctaattgtgaatcaaatagcccttacaaaagcatttccaaaatttgtgtttgatatggttcagctgggtccccacctaacgctcatcttgaattgtagtttccataatcttcacgtgtcataggagggacccagtgggaggtaatttaatcatgggggtggttaacctcatgctgtccttgtgatagtgagtgagttcttacaagatctgatggttttataaggggcttttccccccttttgcgcggtactgctccttgctgctgccatgtgaagaaggacatgtttgcttccccttctgccataattgtaagtttcctgaggcttccccagctgtgctgaatgtgagtcaactaaacctctttcctttataaattactcagtcttgggtatgtctttattagcagcatgagaacagactgatacagtgttctaaacaataagactgtggaaaatgttttacatgtgaagaaaaaaacacagaggagttagataatagattgatagaatagacagatgatagatgattgatagatatcataggtagataaatatgttggtaggtaatatgatagatcaatggatagatagatagtcccagtgcttaaaaaaaaacctatagtaaagaaagttatttgtgtttttaaacctattacttcccaaactcatttaaaaagagaacactgtttgaggctcacccattaacatttggtaaacactattctgtaaaattccagtttgtgtgctctgtatgtgtcaatttctagttttaaccaactcctagtagatttctattttcaagtagggaaagagttttcacaggaaaagaagagcatttggagatcaaagaaagggataaaggagactatctgaaaataagcttcagctctgtaattttgactaaggcagtccttgctttcaatccctagaaagtcctagtaaatctcccacagtggggaggtcaaggtagttcaccacaatggctaatagtgccatgtaaagtgcagctatttgaaagttggttaatctccctaaacgtcatttcgtaccttcatgtaattcgggtaagaatgatgtctcctccagagggacattggggatattaaatggaatgtcatattgaagcatgccataactaatcaatgactgtcagttgtcattattaacaaatgcatccaattgctaaattttaatctctaaatgtttgagaaattgatttggaaaaacataggaatactcaaacattgcagcaattttttttagctatgcaatacagcgcacaaatatgtataaatcaacatatatctagttaggtaaacaagcatataatatcgggtagttaaagacggaaaaggtctaggtcaatgttcttaaaataaatatttaaaggaaaattaacaaattaaaaaatatgagaatcatgtttatgcccctattgtgaagatgactcttcggtagcttaacggggcattgttttttattacataaaaattattttaaaataagttcttatctgacatgtaagacataatttttttctggaattttattttattttgacagataaaaattatatataaagtatacaatgtgatgttttgatatacatatatgttgtaaaatgattactgcaatcaagctaattaacatattctcagctcacatagttacagcttgtgtgtgtggtgagaatacttcaggtctactctcagtaaactttaaatatagaacacagtgttattaattataatcaccatattgtccattaaacctccaaaatttattcgtcctgaaactttgtaccgtttgaccaatagctcctcatttcctccaccatccaaaccctggcaaccaccattctaccttctgttttatgagtttgacttttttggattccacgtgtgtcagatcgtgccatgtttgtctttctgtgcctggcttatttcacttaagatgatgtcctccagcctcatcaatgttgtcacaaattgcaggatttccttctttttaaagactgaatattatttcactgtggtgtgtgtgtgtgtgtgtgtgtgtgtgtgtatcacattttctttatccatgcatccatcaacagatgggcaaaggacatgaacagacaactttcaaaagaagacatacatgtggccaccaagcatatgaaaaaaatgctcaatatcactaaccattagagtaatgcaaatcaaaaccacagtgagataccgtctcacaccagtcagaatggctactataacagacaaaaaataacaggtgctggtgaagttgtggagaaaaggaaatgcttatacactgctggtgagagtataaattacttcaaccattgtggaaagcagtatggaaattcctcaaagaactaactacagaactatcatttgacccaacaatcacattaccgggtatatagccaaaggaatataaatcattctactataaagacatatgtatgcatatgtttactgcagcactattcacaacagcaaaaacatggaatcaacctaaatgcccatcagtggtagactggataaagaaaatgtggcacatatacatcatggaatactatgcagccaaaaaaaacgagatcaagtcctttgcaggaacatggatggtgctagaggccattatccttagctaactaacacaggaacagaaagccaaatactgcatgttctcacttataattagcagccaaaaaatgagaacatgtggacaggaggaggaaaacaatggaaactggggcctactggagggaagaaggttggaggtgggagaggttcaggaaaaaaaaaaaactgtcagatactatgatttgtacccatgtgacaaaataatctgtataccaaaccactgagtcacaagtttacctatattacaaacctgaacatgtacccctgcacctaaaataaaagttacaatattaaaaaaaaatacccagatccttaggttgtttccaaatcttggctgttgtagataacactaccatgaacgtgggagtgcagatgtctcttcaggatactgatttcatttcctttgtgtatatacctggaagcaggattgtgctggattttatgctagttctatttttttttttgagcaaccttcatactgttttccataatggctgcaccagtttccattcccaccaacagtgtacaagggtttgcttttcttcacgcccttgccaacgcttaatcttttgtctttttgatagtagccattctaacaggtgtgaggtcatatttcattgctgttttgatttgcatttctctgattagtgatatcaagtgctttttcatgtatttgttggccatttgttttctttgaagaaatgtctgttcaagtcctttgcccatttctaagtagggttatttggggatattgttactgagttactcagtaaactcaactgaattaagtttcttatatatacggatattaactccttaccagatttatggtttgctaatattttatcccatttcttaggttgtctctttactctgttgactatttcctttgctttgcagaaggttttagtctgatgcaatcccatttaactatttttacttttgttgcctatgttttttaggtcatatcaaaaaatcattgcctaaccaatgtcaaggtttttttttatgttgtcttctagtagttttacagtttcatgtcttacatttaaatcttgaattcacttttagttgaccttgtatgtggagtgaggtaagggtctactttccttcttctgcatataaatatccagtttttctagtgccatttattgaagaaactgtcctttccccattatgtaatttgggcacccttgttgaagaccaactgtccatatatgtatgggtttatttctgggttctctactatgtttcattggtctatatgtctgtttttatgcaagtatcttactgctctcattactgttttatagttctcagtgtgtccagatttttcacctccttgattaaatgtcttcttaggtattttattgattttatgctattgtaaatgggattgttttcttaatttctttttcatatagttcattgttagtgtacagaaacacaactgacttttgtatgttgactttgtatcctgctactttactgaatttgtttatcagattttttgtggagtcgttagggctttctatataaaagatcagatcatctgtgaacagagactatttgacttctcccttttgtgatctgaatcccttttattcctttttcttgcctaattgctctggctaggacctcctgtactatgttgaatttctgatcttagaggaaaagctttcatttcttcgctgtttatgatgttagctatgggcttgtcatatatgcctttagtatattgaggaacatttctttgatacctatctcgttgagaattcttatgaaaggagttaattttgtcaaatgttctttctgcatctatggagatgatcagataatatttatccctcatcctgttaatgtggtatgtcacatttattgatttgcatatgttgaattattcttgcatcacagggagaaatctcacttgatcctgatgtatgatccttttaatatgctatgaatttggtttgctggtattttgttgtgggaaaatataatgttatatgcatagttgcctccaacctaagccagtgcctgataaatgaaaggctttgcactcttaattgaacaaattccttggttccagtactttactgttcattgaaagccaggaagtactgggacaaagaaattattagagttgataataaaagagtaaacagcatactcattattagcagcgtactttctcattttccctccctgataggactttaactctcttctatatatttcagccctaatgtacttatcatatagtctttaggaacaagagaaaagaccaagtagaatatgtacaaaactaaaataaatacagagacatttctttttgttttattaggaaaagttaggaggatgagaaacagtgaaatctaagatattgttcctacaatattttgctatgtgtatggtatggatgaataaagtgaaatatcctttataattatctaaaaagtatgtgaaagtgaatagatgatgctgaaactaaaaaattttattctagatcagtgcttctcaaacattaatgtgcatacgaatcacctgaggagttttccaagcacatttcgattcagcaggtctgggctggagactgagattccacaatcacaaagagctcccagggagtactgatactgctggtctgcatatcacacttggagtagaaaggttctagattacatagaccgtcatcttcatgcaccagacttatttcctagtctgggttcctctggaaatatttccagtgcaccaatcagtttgatggagttggataaagagggagactcaagatttacttcacttgaaaagaatatttattttccatttaaggctaatggactaatggactaaatattacacatctcagcccttgggatatctgtgataatatttttcttttcctaccaatgtgcttttactctatacttctgctctgctgggtggccaatgggaccttgtctgtttaccaagcctagttctcaggtctactttccttcgatatcttttctttcttccaaccttccaatccaaactgaggtggtggtattccccaccaccaagaaaggcatagtttccattttttctctaccagttctagtacatgcaattaaattttctgagcccaaaatttctcatctctgaaataaggagcatgaaactctgtgcgtgggtgcatatgaagctaatgaaatggcacataaagtgtctaacacaaagaaggaaccaaataaatatcagattctatccctatcccacttttattttgtcccattccaatgtggctttgcataattggaaatcattatgtatagacatcaggtaaaatctagcaccagcttatatagtactctaagaccatcaggttttttttttttttacctcgtcttcagttttaatttaaagcaattaaaattaatatattcagatttcaacaaagtgtaagcatccctctgctgaaccactgtatcattacagtgtgcgttaagaatgccaataggcatggaacagatgccagataaccaagatggtacttttactgggtctggcattaaacaaagaaatgtgttcataagtcatctttcttggatctcaaccaaaaattgttattttggattttgtcatctttccatttaaatttctacttaatccttcattagagtatgtgttaacaatcttaatttgtgtgattgccttcatgaaaagttggatatataaaataaatgtcacttttaaggcatctaaggaattgttttctatcttagtcaccaagtatgtcagacacattgcttacaatgtcttctatttcaatctgtggtttgtttctgccatccaaaaatgagtaaactttagtttcacccagccgtgtttctgaatatgaacattcaaatgtggaccatgtgtgatggaaaatcctgccatggctgagaatatggataaacttgagggggactgtttgatggaaagtcattatataatgtatattttctttcattcatttaacaaacatttattctaggccaatggtgagcaaaatattccctcaacaaagtacccatgcacacacacatgaagaaactacacatttatttggaatgtctagtagagttcccccctttcttggctattttacaccagttcccatataactggtttatataataatagttatttatgataaaaatttgactaattctaactgacaagaagatagatatgtttgttttggaaactatttctatttggtaatagattccaaatgtattgaatggtctctaaaagatgtaggaacacaggacatactgctcatgatgtacaacaaaaacaatagtttcaaaattttatgacatattgcagtttatcaagtggttttataaccattatcttgtttaattctcacaacatccttatgagtagtgtgtgtgtgtgaccatgagaatatatgagtgtgagtgtgtgtgtgtgtgtgtgtgtgtccgtgtaggagaggaaatgattaacccatttcatagatgaggtgtaacccatttcatagatgaggtgtaactaacaatgtagcttcaattatactggcaggtcacagaaaagagatttgcaaccagccttatgcctctcctcccacctctctctactgacccacatctttttatgaagtagggattgcagccatcccacagctcatcaatgctgtcatgtctatgcacgaaggcactcttagatagaagagaaaacagaggggggcctgggatccagtccccagcgcaggcactgagtgtgcccctggccccatcagtttaattctgagcgctcaggacagtatgaggagcagcctgtcgttttcggagacaccagctgagggagcctgtggacacaataccagttgaaaagctccccagcccagggtggaaccaagcagcccacgcctgctcttaggagccaagtttcccaaacaatgtcagagttagcttggggaatcttcttagtactcttaagaggccagagctgagatttccacacaatgacatattaaagtattggatccagggtcctttgcattggtagaatgtcaggaaaatagcattagctagataaacttctttccctcaaaccaaatacagtcgtattgtttactattataggtctattaaggttgctgtttaaatgttaccaatgtcctcatattttggtaattttgttcgagttggaaagaaatgtcttgagaaatttttatttagccagagtgtttgagcactttaagatatctttagtatactacatcgcttctccaggtcctcaagagacctaaaaaaaaaaaaaaaaaaaaaaaaaggctttctaagcagtgcctatcaagctactacttccggccccacaaaaaagaaaagctgagactcttcaccccttgattccagtattcccaaactcctggtaaaccattaggaattagatatgccccaaatttatgtagcaactcccttcttaagaatatagagaacgtttttttttacacaccttgttacacctcacaattgagcctcaacttgagattcccttgcccagcaaagtccagaattcaccactgtctacatgctggacccaattcgttttgctgtcgttgatcactaatttgggaattgtgggagggagaggaggagcgaatccctctctttactttagaactggtaaaactgagatagccagagatttctagaactgccaagctaaaacgtaagctgaatcattgtgcaagtatggattagaacccagtactgggtttgaactgtaaacccagtttctgatcatatggctgcccagtgctcctggtggcagagctgattgcttcctgggttcaaatgggtcatgctttccagggcactctggacatccatggaacaagcctaatttaaacattagaggtctttcaaacccttatataccaaatcatcatcagttcagtctctcaattctgcattaattcttttgtggaattaaaaaatattttctcctgaatttccttaaaaaaaaatcgaacgttccctcagggcaaggagacatagctaggggtaccatgcgataagagagtgagtaaaaaggaaaagtctagtatcctagacagtctctttgcagagctgcgcttctgctcagaagacatttgtcaatgcctagagacatttcggttgtcaccactgggagaggggtgtactagagagtagaagccagagaagctgctaaacatcccacagtgccctggacaccccccgacgacaaagaattctccagcccaaaatgcctgcagtgctgatgttgaagaatgcgggtgtgtagatataaacaacaatctgctaagctttcaaatgatagcagctagaaagatcttcaagagtctagggatttggaaaattctggcatcatgatagtcaatccccagtggagacattctttgaagaccacataggcaatcacttgaccaaatgccacctaaaaattgaaatatttttcacgttttgcttggtttgctagaacacaccaatatactttcacccttgaagaaagggaactgtttatgtcattcagtagcaggactccttggctaaagcagcagacagctcaccagatttcactggaaagactgcccaaaccagtctctgccagggactccaaagcgcagggaggcttcagtgctagggagagcggatgtgaaggcggttatgaaggacagctgtgccagcatctcccaacttttccgttttttctcaaacctcagcttgccttgtgcatggctaaggttatccctggccagctgcttttttccctattctacctctcccctgctgtagcaattccctaaccagtgctactaagactaaggatttcaccacctcctcccattttccaccatacagaaatccacaaaactgagttaagagaactctcctgccatccccaatagccaaaaaactgagtcaccacttggcctaacagcactcagatgattcattaaaatacagtggagcgctcttcaggggggtgcaggggagattcaagtgggaaggtaaggctgcaagcaggaggggaagtggacaggagatgagactgcgaggcgtgtcacaagaagggagtctcctggtgcctttctccagggctaaaccccttgaggcagaaactccgttgagtcattctgaagtcaaatctggtgctaactggcgctcttggatctgggtcagtctcgatggggcctgggaatgtctgcggagtgcccattcctctcagcagtttgtgagattgagagccactgctctgcttttcttctcccttgaccccattcccagtttcctaccaggatcactgtgagccctgggaggatggatttgtaaaaaattcctggagccaaacaccctgagctatgaaactggcccattattgtgagaattttcaaatgttgaagaaatgtggggttgggaaagagaggagcaccttaaagaagatttattcacctagtcaccctcagatggttgtctgcagattttgagagagaaatggaaatagtttcagatactttttattttttttttgagacagagtctcactctgtcacccaggctggagtgcagtggcgtgctcacctcacttcatcctccgcctcctgggttcaagcgattctcatgcctcagcctcctgagtacctgggattacaggtgcctgcagccacacccggctaacttttgtatttttatttttagtagagacgagattttgccatgttggccaggctggtctcaaactcctgacctcaagtgatctgcccgcctcagcctcccaaagtgctgggattacaggtgtgacctaccgtgcctggctgagtgtcagatactttttaagcatactctggttatcattcttctcagattacttcactaaattaaaatgttctaaatgtacaaagagcaaaatggtttgtttaaaaaaatagccgtgttcaatctctatcagaaacagcttcaagtaaaattattttcctccagccaatttcttctttcaagtattctcctctatgaaatactcaatttgcaactctagatgaaattactgagtcaatttgtggaaatttcatctgttccttgacagtgagtttttatgtttgggtcaaaatgaacttaaggccaggggtatctgtaaaacactaggtaataggacaacagtccctaaagtcaagcgggctattgtcaagcacaactgtactggttcgtcagagctggctcccttagcagggaaagtttgtgtcgtttctaaagtgctttaccatactgtaatttgtcattcttgattgtaatgtatggtaaattatgcttctagaaagttatcactctgatccacgtctgatctaatgagaacagctgcatccactgcaggccgggtgcttgtcagcttattccctcagggccagacaggtgtggtctaagctccaatttaggtaggagaccttcagggaaagtccaggtgcttcaagaagctccaagatgagatcagaaattggccccaatccctctgagtcagaattctgagtcatctttttttaaggccattttttgtccgtttcctcctgcgactatcagtgcctatactttaaagtgttctataaccgtgaaatctttcctgggataacccagtccactgtacccactcccaccaacccccaccaccaaaaactatagatctactgctgagtcaatttcttcacatttgaaagctcaagaagggggagaacaagttgaaatttctattcagagctgacactccatattaaagataggaaagaaaagtttggggagttgctaagcatgagaggcattgttgataaattatcttgagatccagatattagttgagcctcactcgcaactgaaagaatcaagcctaatggacttttctgcccagtgccagactggaaagatttaaactcttgaaggtctctaaggattcccaactgcttttcctctcatgatcctctctgctcctgttctgtatacctgcgtgctgcctcatttggccccatgtccacctaagtgtaaaacccagctcttcaccagtttttacaaggatgtccatttgcaccaaatgtcacatggtggaagaatttactgaagcctccaggattggcacacttaaaagttcttttctcaggttgactagaagtcttaaccactcaggctgggctcagtggctcacgcctgtaatcccagtactttgggaggccaaggcggggggatcacctgaggtcaggagtttgagaccagcctggccaacatggcgaaaccccgtctctactaagcatacaaagaaaaattagcttgccgtggtggcagtcgcctataatcccagctactcaggaggctgaggcaggagaatcacttgaacccaggaaatggaggttgcagttagccaagattgcgccattgcactccagcctgggcaacaagagcaaaactccgtctcaaaaaacagtcttaacaactacacaaaagtctcaatatccgcttatccccagtgcatatctaagtattttttccaacaaatagcattattcctcagaaaaattctgagaccagttagaaccaccctgttaaaatatcatcagaaattcacaaggaaaatgttggctttctgtataataatggcacaacaagaattcacttctacttgtatcatctattaaataatgaaatatttagtggcttttaagtagcagggcatatggttttgaattttgtttttccagttggagtaagaaacaattcttcatgattatcctaaagaaccaggaagaaaatgagcaagggactggctgggcttctaggagatgtccgtggcacacagtaggatcttggtaataactgacctactctataactaagcaaacctgctcttcagcacagggtagaacaccatggagtgaagaatgggataaaataggtgaagaagagtatgccgtctttactcagaaggggacctagaaagttttttttttttttttttttttttttttttttgagagggagtttcactcttgttgcccaggctagagtgcaatggtgcgatctcggctcactgcaacctcctccccccaggttcaagcaattctcctgcctcatcctcctgagtagctgggattacgggcctgtgccaccatacccagctaattttgcacttttagtagagacagagtttcgccatgttggccaagctggtcttgaactcctgacctcaggtgatccacctgcctcagcctcccaaagtgctgggattacaggcgtgagccaccacacctggctgaaagtatgtattttctatcatatcattctgtaagaccctcttagcttctctccaaaagatttactggaacggttcctcccactcaatggtgttagagagatgtcagtaatactatgagtctgcctgctgaggtgcacaacataggactctatagtcaggcgatgggttcaaatcccagtgggccagataccatttagctctaagtgggtccttatcctccctgagtctgtatttcctgtatttcccagtttacgaagaggagatcataatacatccctatgaaactgatgtgggcattaaagacgtaagtgcatagtataactcacacttagtaaaaagtagtcacaattttactaccatagatgctttctcatcaccggtaaaaacgacctttcatgaaagtctcacctccaaccctgcgtataatctcagaaactcactcaataacatcaactcaaagtttatgtatgactattctatttctatataatattgatgtatctttttaaactgtactttgagaaattccaaaatatgttatgatttttagtgtaaaattcctggcctgagatgtcattatatcttctttcctaaaagaataatttaattacatttccttttatgttaatgactgaatttattattattaatttggcccccaggaaatgttcaatgttatctgtggagaatgaaaaggaaataaaagacgaggctttggagcaataaaaatattatcctaaaaagtcacttgggtatttgagaaataacttccaaaatatggatgagtgaaataaaccagggaaatgctactcttcggctactcttagtactattatggattttttttttttttttgagatggagtcgcgctctgtcacccaggctgcagtgcaatggcacgatctcagctcactgcaccctccacctccgaggttcaagcgattctcctgcctcagcctcctgagtagctgggattacaggtgcgcaccaccacgcacctgtaagatttgatagatatggggttttagcagatagggggtttcaccatgttggtcaggctcgtgtcgaactccagacctcatgatccgcctgcctcagcctcccaaagtgctgggattccaggtgtgagccaccacgcccagcctattatggatttttatgagcttgaaggggtcatgaggaagagtcccaactatatcatagaacatgtctatgagaactcagttaacaggagaaaaacaacagtattgtcataaaaagatgagaaactttacttagaacctaaagtaccttggagtgtttttactttgagacctcaaaaactagttaagtcatgctaaaatgtgcctcaaaatacaattgttagaagatgcatgcaaaatagaataaaatgatctgttcctaaaattcaggaactccactgcatggagatcaccaagttgcagcaaaagatcaagttagatcttatttgacttgaccctaactcttcttctgttatggttatgccttacatatcatatctctcctatagatgtagtcatttgaaatattaaaaaaaaaaaagctcatcttcatctacaatgtgtatcttttctaacttagcctgcttgtctgtctagaagccaaggtagaaagactactgctattatactgtgtggggcaacaagccctacaggaccaaacttgaagaggaatctaggtcattgtcctgacagatctgagctttaaaattttgaagagacctacgtgtctagaaccatcccaaatagtcacatgaattaaggctttgctcctgagatttatagtggaataaaatgcaatgtcatttgcctcttcctttaaaaaaaaaaaagtcaactatgcaaaaattactataagagacttcataaagtataacacacagtgaaattactggttccctaataatcttctatataaattttattttataggctctgctggattgttaaaaatcatgatgatattcttttaaatgtttatggttaatttcatctctttcatcagattttccctctccattcttctaaactctcatctctcctactaagcttttttccaacacagctaaagtttcttggattctttcgaatatcatgggctccagcttctctctgctggatctgttctgattaaggggaggaagagagacctctcagctctaccttttctgctcagcatatatcttgttagccaagaaaagtactttgtttagtaaagacactaccagtcaccaggcaaaaaaaaaagaaaaaaaggaagacgagtccaatcaaaagttcagctttgaaattcagaccaaaagcacatgctctcttctacgtgcaacctcaggctttcccacccacctgtcttggcaagttatcatctagcccagaaactggaggaagatgccaaaaagcaagaggattccagtcaaattggtcatccacagataatcaaaatgcaaatatacatctccactccaacaaatacaggaagtccccaattttaaaacgtagtgaattacagtgtacttgacggtcagatgtttagaaccaatttggaacacttagtgttacaaagcaggcccaccaaaaatcccatgtaagtcccaacaacttggttatgttgggtgttctatgtacatctgtgtttaaaatgaaaaaatagaaaaaataccattgcaattctaatgattaaaaatttttaaagacataaagtgattttgtattgtttttccaaagtgctctgctatggaaagatgtttagctagatgagtttattggaggcttatagaaaaaggaccatctgggtagtttcacagccttggatgttaatggcctcttggttttcggtgtagcattattaactcttgtatttgtcagtcaccattaggaaaattcttgaaataacaaataagaagtagaggttatatataaaggagtggcttgtttatttttaaagaactggacaaactttttaaaagaggaaaaaaatcaaaatgaaatagagagggaaggtaaggagatggttaacgatagtgtaagtagaagtgaaaaggactttgactaagatggaatttgatgatcagttattagtcaaaggctgaataaatagacgtggatacaagcaaggcatgtgaaagcttagaataagctttaccttagtcgcaaggtgataccatcattcctgacagtttagttcctagacagagacagcaggatgatgtttatgaagtagccttaaaaaaaacagacgcgtgaggggaggtagtatcccactaatacttaacaaatcaaatgtttgtaacacagagaatgaatgtcttttcagaaccttgtatagagcttaatgaaaccggtatagtgaaagagcatcatttgtagtcagaccaaagaggacttgaattcttgttcatgtgatattgggtcaaatgatctaacctctctggtgcccaattgggatatattacaaatgagcattcagtaagtcatctcaaagatattatatacagatggtgtcaactacacattcaataactgacagttattaggctcctgaagtctgccagtaatgccttacaggttgtgtcagtgatatccttgtagtgtttgatcctgtaacaaattcagtagctattttacacccatagtatattaaagataataatagatcaagaacaaggttaacataactaactctatgtggaattgtcagagttgctatggaaactttgctaggcttatgactttcaaaaaacagtctcaattaacagaatcttcttacagagtaatctatttcatgtaaatgaattatctgttttgcagctcaaggtcaaatgcatttgaaccagtcattttgggatttgttttcccaaaggaatgataaatgactaatccaaaagactatggattagagaaattgactagatgtcattaaagaccccaaataaatgtttgctgtccttgacctccatgaggataagttgtggtggggcctgtggttatccgctgtcttttattgaatcaataacttggtttctttaacaatacctgtttatgtgcatgcctagaaccaattaaatactgggctattttaagtttcccaatgcagctatattttggcaagtgtgaaagaataaattagacacttttccaaagcacagtgatctactgagatctgtactatgtaataaacatgggatgatgcctaagcctgtggtatggtggggcccaggggtcttctttcttgtactagttcacatcgtttatgataaatgcttaaaagactttgaagtctttgtccaaaacacttattatgtataattatacagatgagcatttattaaagtaagtgtattggccttttagtgccaaaaccatccctctctatagatgttagcagttttcacttaaagtgtgattgtatgagtaaatgtgttaacccatttatagtgaagcaagacagtgtctacaaattgctgtgacaatgtccttggctcttcaaagtgaatatggttatgaattcagtcgtgagagtgcaggacctaagaaacctaaaaataaaaatctggcctacagtgtattatttttgtctgctcaacagaatgccagggtgagggtagaaaaactacctatcaggtactgtcctcactacttgagtgacaaaattatttgtacactaaaccccagcaacatgcaatttacccttgtaaccaacctgcacatgtaatgtaccttgtgaacctgaaataaaaattgaaaaggaaaaaaaaaaaaaaacagaatacccaactttcaattatgaccaaagcaacccataccatgcttgtgttgttataaatgtactactaatagtaattagattttttggtagtttaagtatactatttatactccatttaaatcatgtttatagactttttgtacattccacaaaaatgaaaatgtcttgagtacctattattgccaaaccctttgctgggttctgtggatttcaagatgaatgagacacactcctacctgcaagaagcccatggtctaatagaggagaaagatgcagactatatattatattatacatatcttaagtgctataaagatactgtaaaactactgctatggaaacttcagtaagggtgtgattatttattccttggaatccagaaacatcttaatgaagcagcatttaaagtgggccttaaaggacagaagtagcttgccaggcaggtgagcaggtctgttgtcctggggaggctactgaaagaaccaaatgtgtttctatgtagggaactcttgtcttctgtatgaggttggcatggttcactcatcaaaatgtataatgagctaagagcctggagaaatgacttttggacatttcatcccagagagaataaacagaggcccttcccatggaggcagcagcataggtagcttaggtttgtacttcagggtcacttcttgacaaggaaaatgcaagtcttatagattgggtcctatagatttcctcaccaattccaagtatagactaacttggccttgttaaaaaaaaaaaaaaaaaggaaacaggaagaaatatctagaatccttggtttctaaaaaaaattataatttaccatctctctgacttggagaaagtaagccaaaatatctaggtttttatgtttcttaaactgtgcttatctcatttaaccttaaaggtatttgattgagtcaatccatacttaagccccaataaattcaatatagcacttttacccttttcaaagtgttgtcatcaattggtaaatctaataaaaattgaatattttttaatgggaaaaaaaattacgccataagcaaagtcaaagaatcaacaaataattgagaaaaggatttgaagcatgattgacagacagagagataattgtgttacagtcagaattgtcacagatgaatttttttaaagacaactctggcaaagataatgaaagggatttctatataagataataaaatgctcagcttaatttataattaaatataaatgaaaaccataaaaatataccatatactatttatcagattggcaagtatacaaaattttaacactacctagaattagcaagagtgtggggaaacaggcactctcataaattcagggatggatccacatttgtgcctgaaactcatacagttttggagacttctttaagaaaaagaatacaatattaagcatgctcttgaatttttatttagaatgagaatgattctaataaattataaatttttaaaacatgacatataccacaaacattgcaaaatctagaataataacataatatttattgatgtactgcctggcatagctctctactaacttttccctatatttttgatacattctttctgagtatcatttcatgcaacaatgttataatacattatgtagagagaatagaaatataagtcatttttcctccagcatggttggtcaaaagaaaattttttatttttgatatttgaaaaagtttcttttagtttcacaacttattggaaatatcttataaatttttaggatagctgataaatttgaaaaaaactctaaaacatttatttcatatatgatctgtaatatttcagggaatttcaagttggttgctatgtaaccatatcaatgttaaagaccatttcaattgatggcacttctttgtagttgatgtgcttgtcacagtggtgtgttatgagctttacattattgtccatgccaatatttctgtcaaatcaataagaacttcatcattttcatgtatttatatgatttgctcttctttataaacatgattatcaaataatccaagagcctatttactacccctataagaaaaaatgtatatccttttaataaattactgcttttcagagtgaatttttttaacaatgcacttcttttttaaaaatatgtataatatttatattattgaatagcaataggcaatacaccctgtatctgtaaaactttggaaccactggcttatttgttaaatctagtccatgccagcctccaaacaccagaaaaaaatttagttagcttcattctttgatgcctcaccaaaatattctacaagatctgaaacatcctcctcctcatcattgtcttctgggtttggtgctttgctattcaagacttgccatgggaactgtttggctaacttcctgagacttgttaagctgtcagcaccaagctgacttaatattccaggaaacatttctgtgattggtttggcttctgcatgactggtaactgcaaaggtgttagcagagagagaagaactagagagaggagcagagagaggtaattgcaaagatgttaacagagagggggcagacagaggttagactttgggatcgttgaaatgaaaaactgtcccatcttcaatcatgttcacctctttaataccagctatattattcacagccagtttagttacggaactctgaagctttctgtcatctgctgtaactctctaggttccacctttgttttgcaagctgtacccttgcctcctatctggacctgagcctgaagtttggctaactttcttgattcacactgttggtaaatccaaagcagggagggtcctccaacaccagcatacagcaacagcaaaatcacaattcacttctgtatatcaaaataattccatagatcccaccacacatttttattgccttggtttcatatttcactgacttttaatctgaattttatttctttaataaataattttaaagatgaccaaaaacatattcttcctatatgtcaacatcaagggtctgtaattccttattatattgaaactttctaaaaggtctttataaaattctgttaaaataacatatcccaactcaacttctccaagcctgatccccaaaatagcgaatagccactccaactccatgtggcaagtaaggggtgtaacagtgaagaattcagagttaagagatggtagtcataaccaattgtggttgaaatgtcttacttttgctaattttacaaaaacattagaaatgtctacatattttaagggctcatgcagggccttggaagaagaccatacaagtaagatttgaggttcacaataaattggcttactataaatattcctcagtacacccttaaggtgaaagtcaaaattctaatcatctatttgaaggacaagttggcagcatgtaccaaaatttagaattaaacatccttggatccaacacttccacttctactaattcactgttacagatagactgtcacagacaaacaaaacattttgtacaaaaatattcaatgaagcattgtttgtaacagatgaaaaaatggaaatgccgtaagtgggagaatagtgcaagtaataatggatatcaacaatataatatgctatgtagttattaaaaagagcaagttagccaggcatggtgacacacacctgtagtcctagctactggaggctgaggcaggaggatcatttgaggccatgagttcaaggttgtagtacactgtgactgcatcagtgaatagccattgcactcctgactgggcaacatagccagaacctgtgtctatagaaatttttaaaataaaataaaaagaataagttaaatctttctatgtatgtaaccatgaaatttatccaagttgtatttcaatttgaaaaagtagtttaaaacagtgcatgtgtgtgtatatcacacacacacacatatatatacacatgcactgttttagactttttcaaatatgtgtgtattgtatacacacacatatatacatacatgtgtatacacacacgtatatacatacatgtgtgtacacacacatacatacatgtgtatacacacatatatacatacatgtgtatacacacacatatatacatgcatgtgtatgcacacatatatatacatacatgtgtatacacacatatatacatatacactatataaactgtgtttgtgtgtgtatacatatataaacggtgtgcgtgtgtgtgtattaatagtttggccacaatttagtttacatattatatttatacagatttttcaacagttacatgttctaccattcctagtggctatttttggggattagactaaaaggacagaggacttctacttataaaaatttgtctatttttactctattcctctcccccttttaagcaaaatgttttactttcataataaaaaattatagctgctgctcaaatcaatttctatgacttctcatgcttaaattactttccctctttaaactcatctttttaaagcaataaataaatgaaaatatttgagaacccctgcttgcaaatcatatataccatttttagcttttaggtgaggtcttgttttttattcctctattttaatcacaatctgtgaccagaactttaggaaaaacatgaacccagaatttctcaggatttcttaaataatgccttaacataattaaatataatgatgattgagtaatcagaaccattttagtatattttgttcaaaaatcagaatagttttatattggggggcagcatcatgattaaagagaggatgcaaagaaagtctagactgcaagcagttaccaacagggcacaagagactaaaagacttctagtcatctcaggagagaatgatgggagtactctagaatacttgcaagagtgtcttccttaaaaagaaaaaggtaactcctaaagacggctgtgatatctatggtgcaatgtcaactttgcctggggagagaggggaacgtccaggcttgccagtgagctgtctttagcataatattctaaatgatgcaaggatattaagaaatcaatgatttattgctatttccttgtgtctcagtgttttttcttctgcaagtttggatttgccttaggctcttctttaaaaaaaaaaatcttagctagttgtaacataggtccaaaattcctagctttttaagaaatttgttaattcagtaaaaaaatctatctataggcacattagattgcacatagagggaaagaggcatctctcacatcccgggagactgaatgccttgttttagagaacagcttgtgcacaaatggcccccaggtgaataagactcattatggtcattttggtcacctttggtccagaagacctcaaggcattagctcaatttgtatgtcatcagaaagcaatgattcataaacttcaatgcgtagaatgccatgaatagcctgttagagagaaccaccctccaccactaccaccgtcaccaccagccacacacaatcctgattcaggaccacattgacaaacctgccttaggactttgggcttactctagagaaaattcacatgcacaaagccaaatcaaactccattcctctctctgaatagatccaaccctccgcttcctgatctgtattaaaaaaaagaataaaaataagttgtctgataatctaacatgcccaggttagcttaaataacagaagttgaatgcaaggacacaggagatatcaaagaaagcaaaatctcagcaattgcacagcttgatttggagaaatgggaattcattccttgctggaaaagaatatttcaggggctccaggggccaagggtagctcttcgagatccaaaagcacgagtttattaatgagctcatgacccctcatctctacttttctatcccttcagtatttcctcctacctcttatctaccttccctctatttggtgtttcatggcataacttctgccttctaagggccaacttccagagcctctctactttctaaccactcaatctaaccaagacaggaggggataatggggccgggcaaccaccatccagcatagagcactcttgtgactccggtgagtctgcagatattaatgtttgagtcagacagttggtctggccagtcagggcaagagtgcagggtcacaaggtccaaagcatggcaactaagcgtcaaaaacccttcagggtgagatttggaaatggacagatatctgtcaaaagagagttatgtactcgccaggcaggcactttggagaccacttattcacccagccattccaccatttgttgaatgcctactaagggttaaacactagaaacaaacactgattgagacatagactctgaattccaggacttcgagtacagggatatggttaacaggtaaatcaacaaatatcacccagtgtgacaactgccaaaagagaaatgtgttcagatctagggaacccagagaagcagggaatacaaaagactccatacgtgaactctgagcaaagttccattaattagatgaagccatgcagaaatattgccaggtatgaaggcacagtgggatttgcccgtgttcagcaggctgaactctagctctgttgctcagcgtatgataagtttggctttgctctactcatttccagactccattttagccatttcagatgttataaggaaaactaaaatataaattaccttaaaagtaagggactgttagtatccacagaactgcagaaaaacatggttcctggagggcggctttggaaagaaacataccaacttgaatatatacagagagaaaaagacaaggtctcactctgtcactcaggctggagtgcagtggcatgatcatggctcactgcagcctcgacctcccaggctcaagcaatcctcccacctcagcctcctgagtaggtgggactgcagcaggcaccaccatgcccagctaattaaaaaaaaaaaaattgcagagaaaaggtcttgctttgttgcccagtatggtcttaaacccctgagctcaagcgagcctcccaccttggcctcccaaagtgctgggattataatgtgagccatcatacctggccctgaatgtattaaaactatgcagtgataccccagtcatggattaaccactctaaatataaattgtttctatcaaatacatatttatctctaatttaaggactggcaatggagaattttttaaagatcctaagcaacccattgccatcaaaacttccagtgtttatcaacattttaatagaccacttaaatattcttgatctaagttataattaaaagtatctcaggatttatttttctgagaaaacatacagcagttttttgttcatctaaaaatctttatattgtaaactttatatcataaagtactttaagactgttgatatgctccttagtagacttgcagaagagtaatcaaatgttatacagatgaaaatgtgtccagttaattatgaatgtataattttatcaatgacattttattaccatttaataacttcaggaaagacctatttttcaaaattcagaaaagtacagcttgttctatgttaggcacagctgcttaaatgtgttcattatgttttgttggggatgtttcttgttattttcatagtagccctcaggctacaatgcatttttgcaaggtggtagggataggtgtcattctcttcgttaaaaatgaggcaagtaaggttcaaaaaaattaagcgttgtgcccaatgttacacagctggtaaaatttgaactcgtgtattctttccatatttcccaaaaggttcacaggatgcaaaaaggttccatagtaaaagtggtttggaaaattttggatgaaacaaaaattaaacagttctttttaaaaaattgcagacatctcagtgaatggatatacacaaatgtgcttcatcaatctccaagtagaaagatagtctgcagcatttcccaaacatacttgagtataaatcccttttatatccagaaatatctcatggtattaatcgtgaaacataatctggaaaaaactattctacattattaggcttcttctcgtgtagtaattgaaaataactctgaaaactctcccttaggaaagtaattcatgagagctgcagtgagaaacaagaagggaaagaaaataaacaggcctgacaaattctgtagaagctgagaggttagacagtaacatcagtagtgttatacaaaccaagaaggacaaaaagacacttgaaattcattacaagccaaattttcctctggatcaaggacagctataggggccaagagtaaaccagatatccattatctttatgtttctcagttctgctttaagaaagaaatgtacctaaccaaaggaaatgtctcaatttatctatgaaacacacaacacccagaaaaatctcataaaatctcatacatggaacacgtaacatggccagtttaacaatcggccaaacaatctgcaaaaatgatataacagtgcctgaatttgaacatctctagacataacaaatagagcatagttacattaccagactaacaacgcttgattaaggcatacagagaatttggaagacacaaagagcatatgtctataaagcttaagtttgttatgttgcaatatgaatattaatagtgcatgggatttaatagcaagaaagttacataaagtgcatgtctctgagaattcctgctgtcagtgactggaaaggatcccactggggaaatgctcgctacctaacaatgccactggtggtgactcatccaaaattccgacacagacctaatgagcttctgagagaatgcctggcagactcagtcctattcagtgtgttaaatagagggtaagaaacaaagttctcaactgatagagttttctgtaaagctctattgtttctgcgagttaagatatactattacattggtcaaaggatatttgatcttccagctaccactttggttaactggagaaaggaaaaacgccacaaagcaagtttgcttttttgttttgtgtttgtcgaagtctttgtactctgataccttctttggaatatcaaatataaactgcccctctggtgcagagtgtgatcaagggggtaattaactgagctccaaatgtgatgtttctggtggtcacttcaagtcattctaaccaattaatcaatctcctggtgctctgacttggatcctatgttttcagcccctggagcagtggttctcaagcctggctgcccattaaattcatttgggggattaaaaaaaaaaataccgatgcctagaccccaccctggaccaactagatagaatctctagggatagaacttctgtatttgtgaaaagttttctaggtgattctaaataaagtcaaaagcctccaaaaactgctgttatgttcatgtccagctactgagtatctagtctccaatgagtgatccaaaaatctcaaagaattaagcatgaaaaaaatgcccccaccaatgactgccatacagctggctgtttgggaccagcacataagacattagaagacaggcccatgttgaagcaaggaaatgtgaggactgtgatcaatgttggtcagcaggatccagggaatgactcacagactgggcaggggagcctggactgaacgtgggctctgcagagctgtctggacacactgggcttggtgcatctgcggaccagcggctagcatgtttgttctacccagtctctgtagctgctaccacccatgctatcacctctaccagtagtccccaaaaataaatagacataaaatggttttcttctcacaaaaatttgtaagtagtgtaaaagatattatatattgaaggaattcttgccaccagaagaattcactgcttgtattttggtttgcagacttgggctacgccaatgtcaatatagatttttatccttttttttaagagtttgcccaatttttttttagggcaaatttctagaaatctctttttttcattaaagggcatctatattttaaatttctacaatcattgctaaagtaccttctgtaaggcttgtattaacttatattcctataagtagtcctctttctctgtgtccttgcctgtaaagtgaattagaagttgttttaatctttactagtatgggaggcaaaaacagaaacttatggttgttttagtttgtgtctctttgattatcagggaagttgagcatccttacgtgtgatttttggacactttattgttgttgttgttgttactttcctctttgtgcctgtaatttattttagtgccagtggtggctgctgctttcagaccctcgccacccaggacaacagctcagctatgccctacttgccccgcgtcagctggagttgaagcagtgcccttcacttaagattaagcttcctggccaggcgtggtggctcaggcctgtaatcccagcactttgggaggccgaggagggtggatcacgaggtcaggagatcgagaccatcctggctaacacggtgaaaccccgtctctactaaaaatacaaaaaattagctgggcatggtaacggtcacctgtaatcccagctactcgggaggctgaggcaggagaatggcttgaacctgggaggcggagcttgcagtgagcccactgcactccagcctgggggacagagcgagactccgtctcaaaaaaaaaaaaaaaaaaaaagatcaagctttctcagagtcagtttcctcatataaactacatgttctcgaaaaagacaagagcttggtggctgaacaccccagcagtctagtgtcccctttgaatccctactgccatcatcttcagagcctggggtgggaacacccatgaatacactgagggccagcaaaacccacatggcccctaggccttcctgagatcagaggagccatcttgaggcacaagctgagattttctcttgctcataacattgagttccaaaatttaagatgtaaacaagatgcaagataggccggccatttttctttaagatgagggagaaaggtaaaatcatattttgtatgtgtttcactaacctatgctaagaacctaagatacaaaaggcacgggggctgggagatggggatgggagttgacaggggaacattatatataggtgcttgcaaggaagttgagaaaaggtatgatatgaatggtacaaaggagggagtgaaaggaagaagagacagtgcagatgataagtcatatctgcggaaataaatttagaatgataatgaaagcagattccctccctcatattctttggagcatctgcctgtctcccctttcattcccaccacacttaatgtagtttattaaaaaacaaacaatgacagagggaactgggaagtacaaaacacacagtgaccggaggtgtaactgattgattactgttctgactcatgtaattttgtcgactcatgtaattttggcactcggtgtgagctttttttctgtaagaattgaataatcaactacagcggacccttgtattccaggctttgatagttatatatccataatacttataacagataatatttattgagagccagacactgttctgagtgctttacctgtgttattggcacttttgattatttcaacaaacttgatctccatttaacaattgaggaaagagaaagttgaagtaatttgttggagaccacagaactaaggtaatttgatagccaagtagttgaggctgtcatgctgttattctgttcctctataatgctaattatttgtgagtgttttctggaaaaaaaaaaattggctgcaaggaaaagaaaatccacctgagctagcataagcaaaaataaaagagtattattagggtaagagaaatgaaagacagggttcagaaaccaggcctcagaaacaaatggtaacaaggcactctacactgttgggattctgccctctgcctccctgtctttgctgccaatcttactctgttcctgcagtccaaggggctggaaatatggctaccagctgctcacaagtttgcattttataggtcccaccacttaaagagctggctcttgttcagtaggtcccgtttttacaattccaaagaagagaccttggttggtccacctgtttagttaaacaatcgctgtggctgtagagcagggtcgcattgggagcagcgctggcaacctataaatatgtggtgcagaaagagagatgcttgagcagataaataggagcccattcctgtgagtaactccatgctttataactaaagtggtctgccgtttctcagaggcatgaatctgaagcctgctcatagcaagccctgccaatgagctcatccaatgagccccccatttgcatctcaagacggttttagtctccttttaaatgataaaattttcaggacatattatagtgttggtcttcatgagactgagacttcatgacctacatcagtatgacatcacttcccaaagaaacatgaatccatatccaaaattcttgcaatacataatgtaagcgttcattgaagtttcttgaagcggctagaagaggaattactacatcatgtaacatgtatcaagacctctttagaaagcctcattagatatttctcttcttcctccccacaaactgtcttttctcttaatccatctctgatatccagggctgtttgttgttattgctgctgctgttgttgttgctgctgctattttggtttttcatttgtttggatttttctataccctaacttctatgaatcactctggcattttttagtatctgtcattttttttctactaccactcagatcagtgaaacaggcataggataatagaagatgaggaaggcggaaagctataactattttttttttttttttgccttaccaagttttgtctcactggaatcattgcagttttccacaaagaaggggacatccccctgaggcacccagagtttcttccagttcatgtttcaacacacacacaccccgcttccttcctgtatcctgctgagctgagtagaattatctccaaggccttaagagcattacctctccataaaattgggtgatctggagttgtcctgaatttcagcagcaggactcaaacttcctttattcagacgctgtggctcgggtcaagatacatattagccagaattatgtttacctgtgaataattggcagcccaatttgcagtggcttacattaataggggtctattttttactataacaagaagtctggccttagagagttgctgatgttggtttagcagttccacttgtcaagcactgatcccaggagacaggaatggaggacgaggagataagaaagcaggagtgaaagctgttaccaaaaaaaaaaaaaaaaaaaaaaaagttctccaggtggatgactaggcctgttcctgttgtgatccctccaggacatctgtacattgtccttcagaaatgtccaaccaacagatgaaagaaaggtgcattgatccctcagtccctgaccccacattgggcaagggctgccctgtgggatgtcaccagcacttccagctgtgcatgcttgtttgctgagtagggttctggatgccttcatgcgggggtatcagagtggcctaggggcagagcacaagaggtgctgagggcagcttagtggatgtgggctgtcaagatgtccttgcagggagttgcgatggctggagtaaaaggtgggctcctgtgtggatacgatgtgggacccaagacgcatctcatacagctcagaaccttctgaatctgaggtttctatgtgcttccttaattctgggaagttctctgttactgttccttcaaaaatgtcatcccaagtattctcttcttttcttttgggattccttctatatcaatgcagatattgtcctccacaatgcttagtttccttttacaaataccctctccttatatcccctccagaatcctttagagctagctctgcatcccaatcttcctacttgctaattcattttttgtctatgttcaatctgtcattcgatccatttatgatatttgttccaatgcatatatttttctacttagtatctccaattggttcttcataacttcttattgctgtttcatgtctatcttccctcaactcttttataatatttgatatgcttattttaatcttcctggcccatcaactatgttgcatctcggatagctttccaccaggagtctttctctttattctccttggcagtctcagtgtttttccctcagagctcctgttctcctgagggcattcatctccttgattgattaagtatctctggagtgagggctagaagccagggcctccatcggtccccttcctagagggccatttcaaggctgagatgctcaggtgctactctctgggcttaatcacttcatgtagggcattgccccattccccaaatgggtgaccctgtccctagggacttcgtcgaaggttgtgtgtggaggggtgctggggaaggcaatgcatgcagctggccagacagcttgagcatttccttatcagtctctcatggagcagaagtttctgcctcaccacgtgctctttagcagccattcagtggcaatctggcaatgcacaagaccaaaggggtagaaataaactcgtgctcccaacccagaccctcctctagaggccaacttccattcggggccagcacttttacacaaacatcatgatccaaccaccttctggctctccaagtgttcctcttagtttttccagtaactctggcttcaacatcctccctctcacctccatgcatcttcagaattgacttcaggagtggcagccagcagcctggtcatttctattctgtcagattccctatctgtagagatagggagttcttttctccatgggtacagggtgacctctttgccacaactaataaaagctgcatgtggctccatcttcccaaatcttgtgcagtcacaggtatattatcaaatctgtctcccacctactaatatctagagtctactcctggctggaacagttgaccagtgtgatgaatcctggaagcagatcctggaagctgtccatgattacataccaggaggctctgactggacccttggtcactggggaccaggcccttcctggtttggacctaatatcagcaaacggagttgttttctggttctggggtctactccaagagcctgcgccatactctgccatttgctcaggtttcctgacagctgccacaactgctccttcctctttcttccctctaatgagctccaccaacaatgaaaattcagaccatcccaccagtttgcggtgaagtctaagcttgtttaaaaactccttgctataaatcactctctgctgaactgaatcgattgtctctgatcctgtgagctatgttccatcacatcctgccgggggccagctgccagagctcctaaagcacaaacacaaaggtagcaccttcctctcttcttcttgttaacatacaaggaaacagcaaaacaaaaacacctaaacctacagatcgtatcaactcttcaatttgacatatgtatctgaagactatcagattaatctataagcaaaactgaggtccttgaagacttattctatgaccaaatagtaatgaaaaattctgcaggctacatttcacttctggcatttgtctgttttgaagttttgcctttctggtaccattttaatgctcaactacctggaatctgggctgatactgctcacggatttttcttctttctggtagtacatgtttctcaccagcagtcttaaagcctgcttgattctctgtcctactgaaagagctcagaggatgcagttccattaatgagtcagattcatcagtgtaaagatgtccaacaggccaggcgccatggctcatgcctgtaatcccaacattttgggaggctgaggtgggtggattgcttgagctcaggagttcaagaccagcctgggcaacatggcaaaaccccatctcaacaaaaagtacaaatattagccaggtgtggtggtacatgcctatagtcccagctacttgggaagctgaagtgggaggaccacttgagcccgagaggttgaggctgcagtgagccaggatcgtgccactgcactccagcctgggtgacgaagtgagaccctgtctcaaaaataaaaataaaaatgtccaccacagacctcttctaagtttcctaaaatgcctacttttaagaaattcagtgtccttgaaatctaggtttacaaaaaaaaaaaaaaaaatgctcatcttataatttccaaaatcatctcttcaacccccttgaaatagggaactgatatatcacatccccatgtggttccacccccaacccaggatttctcccatagtgataattctgatcccagagacgtctccacagttttctgattcgtggatgatcactacaagaaccatgaatgcttgtgtcaagttgagccccaactcccttgctccaatctgtccagcagctgaacaatggtgaaagttttccttggctgcattctggggtaataattttatctaaggtacagctgtgcattgttctttaggtcgaaaatctgggacatttgcccccaaacgtaaggtgaattaaaccagactgccttgcaactgcctcaaagtctgtctcaacacagtgactcatccaagagaaacagagatgtgtcaccaaaaatatctataaatttttttcctgttttactagaaactccttagggatagagtcgagggactcatgctgtgcttagagctaaacttcctgaaaatcttctcccagggtcctggaggcaaaaagggcagtgcagaatgctccttagaagggagtgtggaggaaaatgcatgcttatattagagaacccatgtctctgaaaccctggaattcaaagagctttctggactatgccctcactggattcggaactaccaggctttcatcatcaagaatccatcttgccagcatggggctgaagtttctgcttcctgaataccttttcccccatcaacttccttcagtaactagtggagaaaaatgaaaatattctgggaggtggcatgacagaaaaactgagtttctaatgtcaccctttgcaatgcatcacacacatttagatatctcaaatgcctgtgtctaggtgccttgtagagtgaccaaccatcctgatttgcctcggactgaggggtttactgggatgcaggacattcagtgctgaaaccaagaaagtccaggacaaacccaaatgaattgttcaccctagtttcatgctcaagatgaatagagacaccaaaatacaacaaagataaacatcttgactgaggtgtatgtatttctgacagccataccgcatcaaagagcatgcaccgtaattcttttcagaattcccctcacctacagaccatcctcagcctcaatctttacctgtccacatcatcttctcctcatcttttggatatgtgtcagcactctctgcaattaattgtgttgcatcctgtattccagataacaatgccagaaatggatgcagattttggttttggctataagggcttggttgtgaaacatacatatttatattgagaggaaagtagtggggagaagaatcctacctcctttggctggtttgtgcaatgagctcaggactacacatttagatatgaagtaattagaaataatgaacctctgggattaccccaagacttccaggagacagagtgtgccccaagtcatgctggctacaaagactagaactcgttatggataaaaatgggagaattcgattaaactaattcacgggtgtatatccaaagagtatttaaaaacatggtagtggtgccacataaataatacatagatcctacaaagtcatgccaacatcgtgaaaagaaatctgagtcgtagagctccacatcctgctgccctccagacctaatagtgttattcttctggtttgtagctgggaattcatttaaaggctggagaattcggtttcgactgttctttctctgcttaagtcatgtcataagtaatgtccatcagatgtaactctgtggatggcgccttcactttagcagagaatctccagtctcaggaagaaaatgaaaagtgtattttcctcttggctggattcctgcctcctgtcttttttctctatcatattgagcactctactggtcttaatcattttttctaaaaagtcctggattgtattattttttaaaaagacactgtggactctgtcactcatatttttaaaataataatagtaataaattaaaggaaggcctatgtcagtgaccatgctgcgctagggagacccttgtgcccaaaacaacagctcccagctcaagagagggagagagcagccacactggctggcctagtcaatgtttttttgccaaagatttctttgtatctggaaattgctcttatgtgtatcatacatgtttgaaatagctttctccaatttgaaaaaccataaagcagcaataaacaaatgggactctgattaaaaaaaaatactttgtaagtatcatgcatacttttacaagtgtttattagatggtatcattttgcctttgcttttgcatagtggactctcagtgctcatgtaaacttccagatgtagttaggtccctagaccatccactaacttgggtatatttttctctattaactatttaaaaaaaaatcacaggaaaagaacctaatgctgaaaaggcagccaaaagtacaatgaaatgaaatcaatcctaataacaaagacttctcttctttccaaaagcatgcgttcctccccagtcctgcacggtaaaccacatcagtgtgggatggtaacatttcagtaagttatttgaatatcccaagactaagaccatgaataaaaagcaacagcagcaagattgccaataggctgtgggtatttaaaacacaatggcagaagattcctcgaatacaagggatagctagagccaataagccccagtgcatggatattaggaggttcattgattagggttacatgattaaagaaataggctaagggaataaactgctgtatacagggtttagctcatatttcttgcaatgcattttttgagtacttttgccctcgttcctgggaaagatggtaagttaaaaaaaaaaaaaactttataaagcattacattaaaaaattcatacaaaaggtactaagaatagaaatcacattcatgcttcagtttcacacactttctgtcccaaacagcatataaataaatatgatttttgtaacagctacattgtggcatataccacaaagggctcgggtatcaggcaagggaaaaacaatttatcttcattaccatctatccacacatactttggtaatcatgaagacatttctccttacaatttcacaaggaaaataacagaacttgggctctgggtgtcagtatctggcccgagtccatttagtggcaaaaggaattcttaagtactgacattacatttcaacggggcacaaagagacaggatttacattccttcttggattaggttttgttttcatactcattctctttagataatcaaaagcatgtgtccccacaccttgccagttccaccaagggatcctcagcacccatctcagaggggtctgatgtgacatctgaaaggcgatgttgctgcctccccagccaaggggggtgcttgtaatttctcctgcattatctttgaggtatcactcaccaaagcaatgaagggtaaccattccgaatcccaccagtgactccttctgaaaaacctatcagtaggagccttcagttttaaataatccctgccttgtagtcacacaggggaagaataccccagtcaatttatgaggtctttgccttcaagttgtagatgaaaggagtttgttgctagctgggaaagcttatttatgacatgattgttaaggaaggaatggtagtgttcccatttttttctttttccttttttaagccatccttgggttttgatgattgtgacagtattttttgcctatgttttacatactccttttggccttgagtttaaactgggttgtattcaaggagtcaactttaattttgtgaccaaaaaaaaatctgtcatcagagctatcctgccttcattttgagtactccccacgctatcttctctttaactctaacttgttttattttgaatcgcacagagaaggaatttgaatggctgcatgcatctttggagatgcttaaaccttttctcattttgggtcttaaggataagtagatctacatcagaaaaatattaaaggagggatcctatattctaaaaatataaaaaagtaattcagagtagagtagttcatcaaattaaaagactatttgttgacttcatcctctttagtgacaaaggagaatttagttgcacttctttcagtcagggaactccactgtggatactacagaagcaggccagatcatgtatataatttcactaggggagaaacagatggaatttattttcttacctgagttcaccaggttttctcatacctcggcctctctactcctggtttctgattggaatcccatatggtatttctcaagtgggaggcaaatccctaagcatttgcttcaaaatcaatgaaatgagcaggtagggtgcttgagaaaaataaggattcccaagccccatcccaagtctgctaaatcagcatctctaacagtggctccaggaatctgaatttttaacaagcttcccaggcaattcctaagaccctaaagtttggggaatgactactgtgatgtcataagagattctagaatggagactggcaggattgctgttgtttaccccaagaccagctttgccctcatgcctcaagtaatagagcccctaagtcttggccaggcacaactctcttactgctaggtatgtccgttttatggttccaggccaccatggagatgcaagcataagtgctgtgagcagcttaaaagacagttaattgacacacgcacttgcttcctgcttcttctttcttgctggctggaatcggggcatcatggctggcactcaagcatccattttagaaaggaggcaacatactaaaaagcaaaagggaaagaatttgacaacaatgagcctgccataacaggcccaaatagcccaactctccatttcttctatacgatagagaaataaatgtctgcctggtttaattcgtaagtctctcattttggtgttttgttttcagttgtggaatggagtagggtagacggtatgtgcagctaagcctaaactaaatgatatagactccaagaaaaaaaatgtctgctttttcttccataatcctagaacctgcctggtactgataagctgatttcttataagcaagcagtccattgtgggggatgagatatggagatgggtttccatgcttgcagattcacagcctttgcagctcctgggtcaccagaacaagactaggggccggccagtcaagcagtaggaagattatctgcaaccttatgcaatcattagaattaaagagagtataatgaggggatgaagagcaaagactataggcagagtcagactccctgggtctgaatactgggccctcactttttcgtgtgcatttcagtaaattgcccaactccttcgaacttcagtgtccaacattataaaacgaggagacttagaaaaccaaccatacaagacttactatgaggcttaaatgctatacgtaaagtctggcatctcaataacaaattttctcaataaatggcaaatattatgatggttatttttgaaaactgtaagaggaaagaaaatgaaacatcaggaagtgtagttatgaagctccctccaccagctaccccagaacctgattttcttccaccttgagaaataaatactgtaagcagttgagttttggagagagaaagagagatgtttaaataggattttgaagtccctgctcttgctttgcaaagaaatcatcagtaaagttctatatttttcttaggaaagaaaataaagtaacaccaatgagaacagggaagtggaataagaggccactacgaagtgagaggtagcttccagtcctaccacctctgattagtttattggctggatgatctcaaccaagtcgcttatactctaagcctcagtttccttttctgtagaaaggaactcatctgcctcagatgataactgagataagtgaatgaaataacaatgtagttatatgtaataatcatataatttggaatttataaagaactataactttctatggttttattacatattcagactccatgctacattcctggggatagcagaaactctctcatgtaaatcttctctgtgccaattaatctcaacttcagggaggatctgggtagagaagctttgggcacgatcatctccagttgctgactttctagggttgtaagggccatactcgtacaggtaagccaccagaataatatatcgaagcatctaaaaaaattttgttacacacccatcttagtctctatttaacccctttcattgtacaaaaggcaagtgctttgaaaggccagttataatcaagtattaggaggaaatgcagaaatcactttcaagtaggttggctgtgcatagcatggaggctgtacttagtccatcatagtctgaagctcttagatgacatcaggcatcaaaaatgccacctgtcactgctgcccagccacaagaatgagtccttccctccaaggaaaatactgactgctatcaaatatgtatttacttattcacaagcttccctcccgctcagctcctcactggcgtcaccgattaggtccttataaatcccagtacagtacattttttcttccacatggatcctctctgtaacactttcaggcttctagaaggcagtgataatttctatcacactcaacatccatcagatctagatgtttaacatgtaatgtgcagttttaaaggatgtggatgccgagccatgacgaggcctgctggctccatcttttctgagtgtccacactgggccaggtctgtatcaggcactgagctgtgaataggaacatgctcacggaggtcacctttcagcaggagatccactttgtacaaagacacacatatctttgataagccgtaggaaagcagagtctaaggctgaaggaagagtttctgaagcgagataacttggcaacttggaggatggataggaactggtgcaaaggccatgtaagtgtgaaggggctgatatggattaggagctgaatgaaacccagtgggctggaatgtggaagggagctggcaggagctggagaaggaagcagcagccaggtcatttggttggcatttaaatgacttttgcttttaatctaactgaaataggcagccacttagctgttttaaacagggaactgagctaatccaacctgcacatgaagatgatgtcactgctgttgtagggatagccagttaggaggctcttcaggtgcctggtctggaaagagttgtgtgattcaggttgggctgataactgtagttagagaagtttggagatcaactgtttcttatactgtggtgggaaatctttcagtagaaccaactcagatctatggatccttaacagctggaggaagacagtgatgggggagtctgtacttatgacgagctccagggttatcttacatacacaatgttcgaggcttggactgacacttctgtatcttcttattgctagtgaattccttaaaaggactaaattcatgagtctggatccaccccaaacctagtctcctgaaggtttcctaaaacatcagatttaactgtcactagaatggttgtccccagtgaaaagcatagttctcctggccaatggtcagtaaagtctgcactttaagctcttccaatagtagtgatgagtttgtgcaaattggtccacacattttcctgactcacaatgtaaatgtttaagactagtgggcaaacgcacaacctgctgacatggaacagagcaaaatcagctgactccaagccacaaaccaccccagccccatgctaaaaatgtcattaatgggcttgattaatgatacttaattttgtgtttgctttaatggtatttcaataaaaaattatctggctgggcccagtggctcacgcctgtaatcccagcactttgggaggccaaggcaggtggatcacgaggtcaggagttcgagaccagcctgaccaacatggtgaaaccctgtctctactaaaaatacaaaaattacccaggcgtggtggcacgctcctgtaatcgcagctactcaggaggctgaggcaggagaatcgcttgaactcgggaggcagaggttgcagtgagctgagatcgcaccaccgcactgcaacctgggcgacagagtgagatgctgtctaaaaaaacaaaaaaaattacccttcattgggcaaaaaaccagggaactcaaccaaaaagatgtccaaattatagtgctcagtgaaaaaaatacatcacagggtaataaagtataatattatgccacagtcagatttgcatttgatagataactttgtgcactatgtagaggctggcttaaggaacaagccaggggacaaaacacatggcaccctagtctgtgcggccagcctcacacaccctgactttctgtccttttgggaaaagacagcagcatgcttgttaatggaagatcctagacttcagatgcagaccctcaccaaatttctggctaaaccatgggtctatacctcaaaattaagccacacagtatatgcaaaaagtatgagtagtaaaagcaacaaatgttactttcccccacttcttttaaaataaagtaatataatattctaagctagtgattctcaaagtaggctttgaagttcattttcatcaaatagctgagaacacttgtttaaaatacagagagcctgtgctggccctctgaatccaagtggtggggcctggcaatccacacgttgacaagacccatttgatctgatgcacacaacttgaaaactgcaattccagactagcagatgcatatttaattattttccaattgtttcaaatgactataagtttgctttgtgttatttttctcttccctagccattgataaacctctgaaagttcagcctaggcttccaccagacaacctagcagagggaaggctcaataaacaatgaatcaatacttgattgatctatggcatgcaaattatattacgcaaaacttctctcatcactactaaaacttttccagatgtacagtttattcactgttgccattgtcttacaaatccttatctagagtttatttctggagagagggtaaaaatccctagcccgcaaatgaggatctatggaactcccgctggggccgctacgtgacacaaaccagagtgagaaaaaaggtgccctgctcctattttcagctccttactccttccaccaccccagtcttgatagttaatcctagaaatttttctcatttgcttactttaagctttgctgtttatggaaatatgcctttctatctggaatttgtaaagaccatattaccatatttccatatttccttgttttggtatgtaagtccctctctcaaatgtatataaatcccgtaagtgatgaaaggaattttactaaatggcccttttgccatttgccaacctctctcttggcaggtgtgacccaaggggtccatcactttgttaggcggcagataagcaagctgtgaattccagtggcctatgacccacctttgcttctcagaagcttcctcctgaatttatgtagggatatgatgctgtgtaaatctaccgtaaaagtcctttgcacacaaaagacctgattcttcaggtctgcgaacacatgcttcttctgtttgacttatatgggcaccctagggtttgtatttgcgccaaaaagtggaagccaagctttcattgtaaacagatggtgctgctaacaaggaaagtaaaaaattcttccagtcactcctcgcaccagagacctgaagaagattctgctttaaaaacaaatgaacaaaactatcaaatactccctctcccctattccataggctctgggtcaaaacacacatacacacagcccctcacatgcagacaaaatctggtctccattcctcactttccccatcctcctccctatgccaaattctacattcctccagtgtagatactataaatataaaaagaacaaactcaatcccgaatcacgagggtgcttttctttgcatgaccacaacataagcactggtccatcattttgggatttttatgaagccttgaagaatgttcagaattccagtcttgctcaaacaatgtctctcaccagtcggcatgattcagatgttgagtttcaggacaacctggggatttctggttagaagaaaacattctcctgaagtgtctcaatgtgaaagatttccatgtatttcccccttttttctttcagcccagaagaaaagaaatgtggaaacgcgtatgttttctttaacatgagggaatttgaagttgattgcaatctccctgtccctaagcccaaaagagaagtagcattattatgctgtaatcaggtcctttcttaaattcctccattaggtagcatcttattacataaccactttatgcttttaaatctgaatatcgataacaatctcctgacagatcatacttccggtgcctaagttagaaagcgaatgacccagacactctgagatgtcctttgaagcattccagaggaaggggacactggaggttatccagtcacccgtgccttggggcaagaccacactcaagctgttccaaagaaatgaggatcccttttatttttgaagtttccccagagacgcagattccacagcctccctaagtaaaccctcagtgcttcaacagcattaacattttcataggagagttaagcccactatcaaggtacttattattgaattgacactctgtcctttgagccttagaaaatatctacatcaaggcctttctattgtatacatgaaagctaaattgtctatctacttgtataagataccatgagaaaatacacatttttggaaaccttacctcagtctctgccatctgtttattggggatacctgctctgccaaactcacagtactacctgaaggatccaaagagatcacatgtcaggctgcccaaggtactatttgtatcaccacctaaataactattctaaacctgaatctggaagtagttgtttaagctactttattatagaaataacagggattcctgaaataatactttaattataagcctaagttacaaatacaaacatgtggttcatgaaatatcactttaatgctcacataagcaaactatgtgttggcatctcacaaagcaccagggaaaaattattcccctgaagatgcaggacttgctctgaagagcaatggtagaaagctatctccatggtttagcaatcacagatgcagggactgggtaggtgaggatggaggcggcgaactgcctaacagaaggaagccctgtacaagagagacacacatagatcacagtggttcagaaagcctaagtgtgaacgcataaggaaaggcataccgggcaaacggaactgaaaaagcaaggttatgaccttactctcaggtgaagtgtaattcaggccagaaattaatatagtaagaaaaggggcactttgtaatgctaaatagtgaaactcaaaatgaggctacagcaattatgaatacacattcatcaaacaacacagtagccactgtgtaaagcaggaattacagaagaggaaagaagaaatagacagaaatgaaaattcagtccatgataaataagtcaacatatcttaagttcggaaaagacataacataataagatacatgttattcaactctgtatcctgaaaatatctccatattatctaacatcattttttcaagtggtcaggaaacatatatgaaaattaaccataggcaaggcccacaaagtcaacaaattccaaaagatagaaacattacaaataatatttttggtcacaatgcaataaaacaaaaaattgttatcaaaatctcagttatcaatatcgatacagaaaattctaaatgaatactggcaaacagcattcactagcacattaaaaaaagtaattaccatgacgaaatggagcttgttgtaggaatgcaagaataattcatggccaagaaatttattatatcccattaaattaatagctctatggagaaaaaaatatatgatcatttccaaagataccaaaaagagcatttggacaaaagtcaatactcacacctgatccaccccccgcaaaaaagcttctaagaacaaattaatattctcttagcataataaaatagatcattctcatcccaaagcccacatcatgccctgaatcactgggcataggtaatcactgaagccatttccattaaaataaaaaataagacaagaatgcccactcttactactgttatttaacatcatactagacctaatagataatgaaatttgaacagagaaactaaaagtataaaaattggagagcagatggttaatctttatttttagattacattatatagttagaaatacaagagaattgggaaatatttataaacaatatgagtaagatagaatggcacacaaggaatacactgtaattagttgcttatatccagctagaagatgtaatgagagaaaagaccccatttacaatagtaataacaaagataaaatacctatgaataaacttaatacatgtccaagacacatatgaaaaatctgtaaaacattcccaaaggacacaaaataagatttgaacagatagaaagatctacctttttcttagctagaaagacttgataacatgaagaagtcaactttctctatgttaattatttaaatttaattctgatgatacaaacaggaataagagtttctattattgtttactctgaagtttatatggaaaaacaataaggaaaactgggaaactgagaagagcaatgagaaacgatattaaatgtataatagaagtgattagatattagatattaagaaaatattaaaaattaaaagcattgataattaactggtgtggcggtagcacccaaactaaaaaaaaatcaaccaaggaaatataatgtccagaaatagactcagctatacacaggaatttaatagatgatgataatagcatctcaaaacagggtaaaagattattatcatgaagtggtggtgaagcaaagcacaggcaacagaagcaaaaataggcaaatggggctatatcaaacttaaaaacttctgtgtatcaaaggacaaaatcaacagagtgaaaggtcagcctatgttacagaagaaaataattgcaaatcacatatccaataagggattaatatccaggagatatatatatatatatcctataaggggttaatattcaggatatatatatatatctcctacaactcaacaacaaaaataacctgatttttaaatgggcaaaggacttgaacagacattcctccaaagatgaaatttacatggccaacaagcatatggaaagatgctaaacatcattaattactagagaacagaaaatcaaaaccccaatgagatatcacctaacacccattaagatggctgctatgaagaacacaaaaagtaacaagtgttggcaagggtgtggagaaattggaactcatgcgccctgttggtggaaatgtaaaatggtgcagccactatcgaaatcagtctcacttctgggtacatagccaaaagaaatgaaagcaggatctcaaaaagatatttgctcatccatgttcatagcagcattattcacaatagcaaagaggtgtgggcaacccaaacatctactgttgggctaatagataaagaaaaagtggcctgtaatcccagcactttgggaggctgaggcaggcggatcacgaggtcaggagatcgagaccatcctggctaacatggtaaaacctcgtctctactaaaaatacaaaaaaaaattagccgggcgtagtggcgggcacctgtaatcccagcactttgggaggccgaagcaggcggatcacgaggtcaggagatcgagaccatcctggctaacacagtgaaacctcgtctctactaaaaatacaaaagaaattaggcgggcgtggtggtgggctcctgtagtcccagctactcgggaggctgaggcaggagaatggcgtgaaccgggaggtggagcttgcagtgagccgagatcgcaccactgcactccagcctgggcgacagagcgagactccatctcaaaaaaaaaaaaaaaaaaaaaggtggtgactgggcactgtggctcatgcctgtaatcccagcactgtgggaggcagaggcgggtggattgcttcagcccaggagatagagaccatcctgggaaacgtggcgaaacccatgcctctattaaaactacaaaacttagccgggtatggtggcacacgactgtcgtccctgctacttgggaggctgaggtgggaggatcactggagccctggagattgaagctgtggtgagccaagattatgccactgcattccagcctgggtaacagagtgagaacctgcctccaggaaaaaaaaaaaaaaaaaagtaaatgtggtatagacatacaatggaatattattcagccttaaaaagaagaaaatcctgccacatgccacaatatggatgagcccttgaggatattatgccaaatgaaataagtcagtcacaaaaagacaaatactgtatgatttgcggtgattaaagcagtcaaagtcatataaacatggaaaagaacagtggttgccaggggcttggaggaaggagaaatagaaagtcattcaataggtacagcatttccattttgaaagataaaatgttctggagatcttttgtacaacagcatgaacatactcaacactacagaactgtacacttaaaaatgattgagatggtatattttatgtgttttttaacaacaactaacatttaaaaaattattctttttgaaagtggtagtggggcaactggatcattaataataaagcaagatccataccttaataccttatacactaaaccaggataaaatataaatgaacaggccaggcacggtggctcatgcctctaatcctagcactttggaaggctgaggcaggtggatcacctgaggtcaggagttcgagaccagcctggccaacatggcgaaaacccatttctactaaaaatacaaaaattagcctggcatggtggcgtgcacctgtagtcccagatactcgggaggctgatgcaggagaatcacttggacctaggaagaagtggttgcagtgagccaagattgtacaattgcactccagcctgggtgacagagtgagactctgtctccaacatatagatagatagataaatagatagatagaccaaatacctaaatatcaaaaataaaatcagagtatataggataagacaggcctatctatgactcttttaaaaactgataaattcaattaaataaaattagaaacttttttaatgtcatgagatatcaagagccaagtcgaaagacaaacggcaaaatgagaaaacaatctgaaactcctaacgcaaagggataatctccttaacatacgtggagtttcaagaactgaagaacaagaccaagaacccaataaaatatgggaacactatataaacaataaggccacaacaaaggaaatagaattggctcttaaatatataaaaaacttgctcagcctcactcaaaatcagagaaatgcgagtcaaaactatcttgagacatcacttttcacctatcagactggcaaacatccagaagtttgattgcacattttgctggcaaggccgtggggaaacaagcaccatttaacattgctagtggaagtgtaaattggttcagccctttgaaaggcagcttggctgtatttatcaaaattcaaaatgtaaaatccagtaatcccacttgtgggaattaatactatagataaacttgcacaagtgtaaaatgtcatgtgtggacgtttgtaacattgtttaatagcaaaagattggaaacaagtcaaatgtctatcagtgggattctgattgaataaatcgtggtgcatttatccaagggaatgctatgccacattaaacacaggcatggttactctgcactgatatgcatgtaagtctcatcgtgtccgtcctcttctcaagaccctccaatggctgtctgttgctctgagggtaagtcctgaaatacttacactggtttagcgggtcctacaccatctggctgtcctgtctctctgacttcatatgacattctacatctcactttctctgtttcagccacattgtcccctttgctgttcctcaaacgtgctaggcatggtccctccttaaggcctttgcactagcttcttctgcctggatcaccatactctccaaataatcccaaagctcactgactcccttaccatgatcaagtctttgctcacacgtcactgtctcaagaaagctgcccctggccgctccgttttaaattaaaattccccactgacatccccaacccccattatcttgctcagtgtgttcaactgctcttattatgtcctaactcaacacagaattaacttgtttagtatgtttgttttctgcctaatgtgccccttgcccaagatataaatgccaagggacagaaagttttgtcagcttgtcccctgctgtgttaccaacatacacaatagtctgtggcatgaagtaggtcttcaacaggtgtttgtttccaaacaaatgaattaatgaacatacaatgtggaaaggactataaagtgtatatgtatttaagtgaagatgtaagacgaagcccagttattgttctgcctatagtattttttttttttttttgagatggagtttcactcttgtcgcccaggctggagtataatgacgcgatctcagctcactgcaatctctgcctcttgggttcaagcaattctcctgcctcagcctcccaagtagctgggattacaggtgcccgttgccatgcccaactaatttttgttttagtagagatggggtttcaccatgttggccaggctggtctccaactcctgacctcaggtgatccgcccacctcagcctcccaaagtgctgggattacagacgtgagccaccgtgcccggccctgcctatagtatttttaagaaataaagaaaaagtgtaagaatgtatttaggccaaaagaaacctggaagtctacagagaaaactattatcagtggttacctggagggagatgtatggactgggcatatggggaagagtggtagaaaggagactgtggtgcatgtacttttatataaattatgtaaatgtattacttattcaaaacattaaattaacaaaagaaaaataaaagctgatgtcagctcccaaagattgtaattcagtagttctgagcagggctcaggggaatctgcattttcaacaagctcccccaccctcccatcccttcctgggtggggtagatcaccctcaaaaatcactgtcaccactacctctcctgaccccaaaacgccacaaaccgcgtaacgttgggatagttctcatttggagcacaagcaaatgggcaggcacatcacagaaactaatggcagagttttcagtaacatttgacaccactaacagctgccacccaaaaggcagcctccttgtgtggaagaacagcagaaatttcatctacccttcagtttcatccccacaagcaagcaggaccagtaaaaggagtgtcctctctgtctaagacatttatatatgttgggtgtttagactaaatttcagacttctaaacattcacaggtttagcgaaagtagttggaggggcttcttcagatttctgcgctcatggtgatcatatactgaaaccctccaaatttttccttcctctttcgcccaggcattttaattaatacaatgtccttcctaattcacagaggaaagatctttctaagaacccttgctggagatgagaaaggtggtaaggatctgaaatgtgtcttagcaagactcacccaacagggccaccctgcttcattgtgatgcctttcagataaacgaagtattcggctcttgttattcaatgaccctaataaaactttacaactgaagtgtagaggaaaaaaataaataaaaagatctaatgacatacaagaagggactgaacctgtcaaccccagaatattttcagtctgaaaagcaacctcatccttattaactttacattgattcccaaagagcggaaaatttaataaggaagaaaaaattcaatatttcatgactcaccacttcctcgggataataaatacgaactaaagatatatacactgaacgcttttaacattttattttcacttcaaaaaatactgtttgcactatctctactattgacctctcaagatgattctatttccggaacgcattttttgatatggtttctaattcaaaaatctgtcacatctttgatatttcataggctccattaaaattaatagcttcatgggtccctcatgagtttcttccttaaattttcaaacggtttgtggtctgtttctcagactggccaatgacaagcagttctgggactggaagatggaagtagtgaaataatctttaaaaatgtgtaaaaattaagcactgtctgccaggggctttagagttggcaaatagctaggtctttattaaacggttggttttgtttctcctgttgtttcttcctgatatccgtctgtgtggtaactgagtcactatgacataataccgcagagaaagactgcaggacaaccagacgtacacatgttcatccctcaatgagtcgcaaccttgggtctgttccctagacattggtggaaagacttgattaatggcagacttgttcaacataaaaaagaacaaagaccagatttattcttggcattccctttcctaggggcttacttgtaatggggtaattaatttatggctttgcagtaaggcggcatcagaggagcaatttaactcacaagaggtaacgcagatggagagtacaactgaaagataccttgtgtggaagggtacagaaggaacctcaagctggacgttgatttcttttatcagtaatacaaattcactactagctgcttcttggatttccccccttgagagctgcaacgtttcctaaatgaacagaggtctttagggaatgcctcaaaccacagctgaatggggagtggctttagaaatcgccggtggaacttgcctgttaccttcttacaattccccccgcccctgggcaacgcaaaagccgtcctaagtgcgataagagcatggagtgaagggagttatttctggagtttagcagcattcctccccaggacacaccctctccccctccccagcagcccggcactccgacacactccgcgcacacgcgcccctcggcgagacgcggcgcattcgcgcgctggagaccggcggcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactggtaagtggcagcattaaatctatgcagacatggaggaaataaagctttgcagcctttccaggcagtggcatgcaagtactcgtgcgaagagtactgtttggggtgtttagttgtagtggactcagaataccgtgttccgccacggttttcctaatcccttcttcggactcctctttgggggttggcgggggcgggtcctgcttcgcgggacttttctgttgttggagttagggtgggggaggggagaaaggcgtgaggttgaataatctctcctacccacctcacccttttttttttccattaaaaaaaatgatacttttagagaagcttctctttcatgtgtttaacttgcctgctgcgatttgagcccaatgagtttgtattttctctaattactttgtaatcggctccatcctcggttgaaatagaaggaaactttcacaaagcaatcaatttctgacagcctaagagctgctcagttgctgaatgaggtctagctggaaacactttgtttctcacaaggttttggtgatttttcccatgagaaatctgggcgttttcacacctgttgcttttcagttgcctcaaaattgtttgcttgtttgtttgttttcttgggtttcacttgattgcagttctttgtctaaccaaatccaatgctactttcccggttctcctctccctttggacggggtccctgttgttagcattcagttggcggtggttcttagggaacaagtggcaggcagaatacaatagggaagaatgcattcctgatgactcctctaccatggaaagactgaaaaactgacattctccattagtttttatggaaagcattgctgacgcttataaatattcaattttggtgagttcctgaaattatttaatccagaagtaaccagcatgacttttacagagagagttcccctaatctatttgcattacaagcatagagaccctggcacctgaacacccccagaatgctgaagtcacctttcacttcactggcaggtaggctactgacaaggaaaggggtgatggaatgttaggagaggggcagcggggaagaccccctgagaagggggctgtcctccaagggaccagcatgatttcagctttctgatgattaagaaaatcatcaggatattggagtgtaatttaacatcctagtaggttaagttgaattcctgtccacatgatgaaaaagactttctatcagcccttctcacacttccaagtggagctcaatggaatgcttgtttatttctgttgccgataaatccatgggaaatctctgctgaacccagcaattttaaaaaagcaagttccagcttataattgcccgtataatggcaaacaggttattttcagtaacctaagactcttacatttccccccgcggttgttataggggttacatgaagatgttatgagcatgcatttgagcttacccacccccaactgaaatggaaagttatccttgggtgtctgatggaaaagattgttgccagataccttaggaggctataaaataacatgtttctgaaaagatcataactagtagacatgagtgtctatagctactatataatttttcattgttcctttaggaaagagacctactttgatcactacagtgtttacatttgttgtttatttgttgtatggtttttctgagtcttttttcttttctttttgctattgaaaatctcccttcatttaaatgaaatcacagactagaaatagcaatgattgctctctagggctaaaattagaaactacaagagactttttagacacatccctcttgtctcatggaaggttctgccgagttttctttaaaactcccacttaagcaattattgtaagatgatgtttactctgtaaaatagcatttttatttggacaatttttttccatcaagctttaatcatactttgccaatgcatattgaactttgtttctctgaggtgcctaaagggacatccaatacatttaccatcccttcaaagtctgtatacttagctctttgaacagtttcttaaaaaaataataataataaataaacaaaagctccaatggcacttgcaagagacaagactgggtcctgtgatgtgatggcagatggcagttgcatgagctttgtttatgctcagaacaagctcggtgtctcttaaattaatcatgaattgaataattgatttctcacaccttgggctgcatttaatcttcagctgtacatttaaagataggttatgattgaggtcttgttcacttggacgtcctttcaaagcctatcaagtgattttacagttgggtcatttctaatcgtaacacatattataaaatgtaatgacataaacttcgagctttcctggcttttcaatttccaagatgggcttcagtgaccttcccatttgttggtcagccccaaagatggtggggctaatggatacagtggtttttctgtaaatgtaattaaacgtgcctctgccagctgcctgtggtatttgtgaatgttttcgtaagaaaagctgttcttcgactttatctgcccactgtggtttgtggcatgttgtgctattctgcagccttgcagtttttttcctgaatgattgggctatgatgtcatgtgctatctcagcgcagaaccttttcaaagctttgctggggtctgtgtgcctgagcgaggggagtggaggctccctcagagcgcacttggtagcgactccccgtctactccagcacattccatcgcctggagaccaaagccaccaaatgatttgcggtcagagtgatttggggctggttagagatgatttaaaaggaaggttatgggcatatgaagtgtagcgtaaagaaaatatattttactactttattgagaccacatggctccaacttgaactttttttttaaacatggaaattgttggctgaactggctcacagtgttttttccctttttttcatttttattgctctgagcgaagagctgtactccctatttattatatgcttgacctctccattatttctgaaagtttgaaaagctttttatgtttaaagaaaacaggaaaacgtaggatttatctgttgtgctcttcaagggccaaataccattgccagagaagagacccaactctctccaataactgaaagaaggtttctttctcatgtcaagcttgggaagccatcagttatgaaagagacaagggccagtctgtcccagggtacccgagggccacagcatatcagtactgacagtgtatccatgtctcttgttgactgggagagatggttttgctcaacctcctaagggttcaatataccctacgattaataatggggccaaataaagcatggtcgatcttttccaatgccagaatggtgatgctagggctcagagaccaggggctccttctcattagcggtccatgggaacacataacacttgggtgcaacacttcgtttgtgagactaagcagccatctcctgcctctcctatgtgggctaccacaaactggcacagtaaaccacctattacctctgaacaggttcccaaatctctgtccagcatgaacttaaagtatctattatcacttcactctgtggctcaggttcatcctatttcaatcctcaaggcatatgccatagtctaatagtccattacaagctatcagatagccagctccaacttgcaattcggtgttatgacactagctagagaagtgccatggaaagcatgtttgtgagcatgcccagtcccttggcagccatcaacccagggtctgagggccatgactgtgatgtaatggaaggcctgagatcttcccaccaacccttcatggttgctggtctgtgatccatctgagccagcctggattcccgcagtttgagtctgtgtgtgtgtccagggatttaaaggaaaacatgtggagaccaaattagtgtggcacctgatgagaaaatcttatagaattggaaaaatgtcaagaaggcaacattgtatgatggaaatcaaactacattggaattgaggatcctggttttgccactatgtgaccttgaaccagctatttagtaatgtaacattgataaagcactgtattacatttgatcatttccttcccaaatatgacatgtgatcatcagaaccacatttggaagcaggtagggcaggtggcgttatttccattctgcaagtatggaaactggagctctagaggttaatgacttgctcaaggtcacaaagcatgtgagtggtagaatttgacctcaaactcagaacttctgccagacacggtggctcataagcatgagcctgtaatcccaacactttgagaggccaaggcaggaagatcacttgaggccaggagttctgacaccagcctgggcaacatagtgagaccccatccctgcaaaaaataaaattagcccagtgtggtggtgggtacctgtagtcctagctgcctaggaggcagaggcgagaagatcgcttgagctcagaaattcgaggctgcagtgaactactattgtgccactgccctctagcctgactgacagaatgagactctgtcccagaaagtaaacaaaaaaacccagaacttctaacttcaaatctcatgatctgtccaccatagcaagcagccctcacaattctcaacctctatagaactcactctcctcatttgcaaaaatgagacatttggcccagaaaattacaggccattccagcttaaaattctgtgtctgatgaatcactggctggaagggactttaagaaatcacttagtcatattccttgcttccagaaggactctatctaaactattttgaaaagaaaatatcagcccttttcttacagtcccagtgcagaaaagggccccagagagtgtccaagtgcatttgggagtgagaaagaaacgaggagctacagagccagtgctcagcagggtgatccatttcttgggctcagaagcagtgagtcttgcctccctggatgtgaatgttcagccctgagatcaatatctgaagtaggagaggagagtcacaagcatgctttgctggttagaaaggaagtctgtaagagagatcagaaaactggtaactctgtgaagaggaaaagaagagctaagtgactcagtaatgatcttaaagtttattaaggactcctggagagtgcgatgactacaaatcagtggtaatgtttctacttaaagatagaaacggcagaatcctgctcattcagcaggtgtgacaagcagaaagctatgctaatctagccttactttgcttgtatcggaggggttggtggcagaatgggagtgaaaggggcttctccctgaagacggtgcctaggagccccactccagtcttcccttctctctcagcacagttctcagccggctggtgtaccagttagtgtctagtaacctttctaggacaagggactaccagtagacaactaccagcaagcacagcaagttgcaagttcagtctcacattgctcagctaacccggttataattttaaaaactgatttggctccatgttcttcctatgtcactcccatgaaatagatgttactttttatttaaaaaaaaaaaaaagtagtgactgagatcagaagacaagtaattatcacaactctacaacttacagagcttagacaaggcatttcctactctgggtcttgatttctcatctgtgaaatgggctaacaatagccacttcaaagttaaatatttctgaggattagccaggcgcagtggctcacacctgtaatcctagcactttgggaggctaaggcaggtggatcacttgaggtcaggagtttgagaccagcctggccagcatggcgaaaccccatctgtactaaaaatacaaaaattagttgggcatggtggtgagtaccggtaatcccagctacccggttggctgagacaggagaattgcttgaaactgggaggcagaggttgcagtgagccaagattatgcctctgcactccagcctgagcaacagagggagaatacatctcaaaaaaaaaaaaaaaaaaaaaaaaattctgaggatcaaatggggaaacatagatgagcatgctgtgtaacagtttacatcattattaaaaggagtccaatttcaggcttttctgtaaaccacaaggtcacagatgtttctttttattctgccttaattccattcccaagccaaaatcagaatcacagcagtttatcctcacttactatgtgtcaagcacataaccacctttaatcctcacaaaaatattatgaagtagatatattacccctattttattatctggaaactatattctcacaaagataagcatcttgcccaagatcacatggctactaagtaacagagacaaagcggaaaccaaggctgtctcaaggcaaagctgtgctctcagaccttcagggctctgaagaactggggccctgtcctacctgagtacagccccagtcctcttggtttcaagttgcagttgatctcctggcaggccttccagggggtctcctcagctgttctgagtctagatcaggtcctttgcttagtcccttagctaaagcttcatcttaatccatagtttagtccattctggcggctataacgaagtaccataaactggatacattataaacaacagaggtttattgctcacagttctgaaggctgaaaagtccaaggtgaaggtgccggtagattcagtgtttggtgagggcccactttctggttcatagatggtgccttcttgctgtgatctcacgtattggaagaactaactagctcccttgggcctattttataggggcactaaccctattcatgaggctctaccctcataacctaatcacctcccagaaggccccacttcctaaataccatatgaatttgggagggggggcgggccataaacatccagaccatagcaatcagcttaccccgattcacactccaccgtctcctctctttttcctgtccttattcctaggtggcttgctgacccctctcatgttcctctcccactccacacattcctctttggaacatcctacattctcttccccacctttctctcagaagcagatacttccccataaggatcttgtacctctccccagttttcccagcccatgacattagcccatcaagcctagatcaaatgccaatttccccagcatgtttactgtgtttcctttcactggaaataaattttagcatgttaaagacagcctctatattacttatgaatatcacagaatgtgaattttcaaaactgtgaaaaccacagaagtcattgctcagttgcctttattttatagatgaggaaactgaggcccagacaagttaatttactgcccacagttataactgtaggctagagctggagctgattccaaatgcagtcagtattgttgtcaaaatagtttaaactgggcatgttattgtatccgcatcctccagtctggtgtggccccttggtcaaagtttggaaaggagtttcgcccttgccacaacagtctgattggactcagaccatgaatcataagaaatgttttcttttacttaaacctgttcactcctcaataggctacaaagaactattggccattcaactttttttttttttttttgagacggagtcttgctctgtcacccaggctggagtgcagtggtgtgatcttggctcactgcaagctccacctcccaggttcacaccattctcctgcctcagcctcctgagtagctgggactacaggcacccactaccacgcccagctaattttttgtattttttagtagagacggggtttcaccgtgttagccaggatggtctcgatcttctgacctcgtgatccgcccgcctcggccacccaaagtgctgggattataggcgtgagccaccgtgcccggcctgccactcaactttaatttgtggccaggaagagttaagtctccccttagcttgcctgtcttttaggttcaataataccagatctttttgctttttctcacagttcttgttctccaacaatttcatcatctttatttctatctgttgaactatatccaagtgctccatgcatctcaaactgtgaagtccagaagtggacaaagaagtctcatgaaggtatgagaaagtgacgatgacctcacaattccttcaaactgtgcttccgttggtgcggccaactttcatgctcgtgtttcaagcgatagccgggcctcactggctcaagttcagcgtattatcctcatttggctggacactgcttagcctgtgtttgtgataatgattgtttcctccatgtagcatccagaacttttccgattgagcttttttccctttgttcctgactactactccaattcatcaactcatttgggactctaatcctattcttccacctcttaattcttaaccccagctactgtcccaagtagcttagcacattaaaagtccctggaattcacccctgagacttctggcccctcaaagcacttctccctcatggctccaggattggataaagccagtagtccatctcccagtacacacaaggcactcacacaaggttataagttctggataaaataagagatcaccagaaagccttccaagaggcatgtagctaagggtcattacatgggtagattcagagataactgactacacttagacctaacttgggtatgatggtgggagtctccaagattttcctttggctcagaaatgtgataattatgaatatttgcacttataaatcacttatctccattagcgtaagctacacttataatgatatacattaccccagtttacagatgaagaaattaaggctcagtgaggttaaggtcacacagcccagattagtacttatgtttcctgtctttaaattccttgaactttctgtatttcagcaggttttaaaatcttagaattcctaaaaatcccgtgtgtgagttgggtatggtgcttttgaaaaatagagattccaggccgggcacggtggcctacgcctgtaatcccaacactttgggaggtcgaggtgggcggatcatgaggtcaggagatcgagaccatcctggctaacacagtgaaaccccgtctctactaaaaatacaaaaaattagccaggcgtggcggcatgtgcctgtagtcccagctactcgagaggctgaggcaggagaatggcatgaacctgggaggcggagcttgtaatgagccaagattgcaccacggcactccagcctgggcgacagagcgagactccatctcaaaaaaaaaaaaaaagagagagattctagggccctggctctaagacatactgattgcttaagtctgagtggagccctgggatctgcgttttaataagcaccgtagagggttttgagtaagcctttgcatgccatacttgaagaaaccctctcctaaactatgctgtctaggccagaccctttaaatactacagatctacctttgccctgggataaagctggcacataaaaaccagccacagaaacctcctgatccagacagtagctcagagggctctctgatgaccctaagacccaggactgtggtgctcagagcctgccaccaaccctggttccgtcctgtttttgtcctcttcagttttgctgacgcattgaactcctctctttagagcactctgctttgatcccactcaggtcttagatatgctctcacccctgattttgtcggcctcggctgctccagatgagaaagcctatctccctaaggcctttccagatgccgctgtaaaatggatctgaaacctgactcatgagagacaatctgaagactttatctggggaactttctactcccgtgcaccccagctgggcaacatttacaaactgctctgagggaaagcttcacagccagtttccccagagaggcatagtggttcttacagtcctactaaactaagtttacaatctattgttcctgaaaaaccagatactccaggaggcggatagatgactagggaatggacagcgcaatgaatgttgattgggcatgcacagtacacaggcactgcactgatttctttccatgagttgtgtcttcgtctcctttcacccataaggagcacagccaggatggtttcacctggtgcctgctctctactcccagggcacttagggattgtgtgttccttggattacaaacatagccctgctacctacacatccctcgggtctttcaggatcacaaaatgtgcaagtggtctctggctggattctcttatgtgtgttttatcaaggaacaagtagattcctgatgaaaaaaagtttttagactgaaagcagactaacagagtggttgaaaattgacatgggacgcaaccgaactcccagtcttggtagacacattccacttactgcctcttctctattcccttttccaagtgcaggaatcttcttttttatttttatttatgtatttattttattttatatttttgagatggagtttcactgttttgcccaggctggagtgaagtggcgcgatcttagcttactgcaatctctgcctcctgggttcaagcgatcctcctgcctcagcctcccgagtagctgggattataggcgcccgccaccacgcccagctaatttttgtatttttaatagagataaggtttcaccctgttggccaggctggtctcaaactcctgacctcaggcgatccacccgccttggtctcccaaagtgctgggattacagacatgagccaccacgcctggcaggcatcttctgctcaataggcttgagtcttcctgcactttttcagaagcaaatccagcttgtgatagtggggcagcatgcaataacatatgctggcagcaaatcccaacacagtgggaagaaactgcttttcctgtacattcgtctctactgtcttgtgacaatctgaagagaaattcccaaacataagtctcctgagtgattgtcaggtgtataccttgccttattgttagcagacgtgaaagctctttgagaagacagcaaagtatttggagctggaaggaaaggggtgtttggagccttgttagagaccagctgtagagccttagaatgttctctatataggaaagcttacattgtgctgaaagaaacagttgcctattgggttataacttggcgagttatgtaatgatacaaatgttggatgacttgttaaaggatctgagagcattatggcaaaattctataccctatccttaattagatcaagttaaactgaaagggaaaagcagtctggtttgctaaccacagtggaagtattgctttcgggtggaattcatatccggattgcattgtctggcttgaggataatacacaggaagcaatctggagtttttctttcttttggttttgatatttcagttacaaggaacttgaagtctaggaactggctttgcaatgttaacagttatcacagccagctagccaaaatgtccctgtttaagatcttgctgtttatcataacatgaagtgtgctctatgccgtgtatgatttccaatacacatgtgttagtaattactaccaatatgagtatctacccagccattaatcaaggcacccaacacatcctgccaatgtactttgaaactttatctgctgaaaaagcaaaattcccctccgctaatgaacacttttaggaaagcaggctggttaagagtgtctgaagcatttgagtgacagctccagagaactcccatttatgaccgcaggtgacctagcaaaaactgggaaatataagcacagttctacattttagtttctcctaaagatcatcagtttaataataacagttggcctttactgagccctgatcaaaagtctcttgacatgttttttctcctttaataatcccaggacataaggtctgttaatatccctacttcccgattaggaaactgaagctcagagaggctaagtagtttgcaaaaattcattcatggaggaaatgacagagccagggtactaaccctggtgtgctgactccggaactcatgcttcttggattccattcttctttcaaaaccgcttggtgcctccaaagagaaaaatggtttggtaattagtcccatttgcttccagtgatgaagaggaactctttgatgttgatatcttttttttttttttttaatggaatctcactcttgtcatccaggctggagtgcagtggtgcaatcttggctctctgcaacctccacctcccgggttcaagtgattctgttgcctcagcctcccatgtagctgggattacaggcgcctccaccaagaatggctaatttttgtatttttagtagagatggggtttcaacatgttggccaggctggtcttgaactcctgatctcaactgatcctcctgcctccagccacccaatgtgctgggattacaggcgtgagccactgcacgtggccggatgttgatatctttcaaacatttattgagcactgaccttgtcccaaggggttaaacagaccatatcactgaatccacccaataaacaaataaggtaggttgtagcatctctgttttactgtcaagtaaccacctgttccgtcccatcatccagcgttgcccctgtggccctaagggttgaccgactttctgtttgagtggagtatgtaaataggaccaaaaagccatgtggtagttgtaggagagaggacacagcaatggaagcccaaaagtgtggttctcatcctggacaccatcattcgtgataactctcttcatctcctctgtacctgtgttcctttttcgtgcctatagtatttcctttaactaaagtggaagtgttatctgaagtttcatgaaaatagcatatgcatcagaaatagggagatatcagctgggtgcagtggctcacgcctataatcccagcactttggaaggccgaggcaggcggatcactggaggtcaggagttcaagaccagcctggccaatatggaaaccctgtctctactaaaaacacaaaaattagccgggcatggtggtgggcgcctgtaatcccagctactcgggaagctgaggcatgagaattgcttgaacccaggaggaggttgcagtgagctgagatcacaccagtgcactccagcctgggtgacagtgtgcgacacagtctcaaaaaaaaaaaaaaaggaaatagggagaaagatattttttctaattcaggatcttccactaaatatcagtattcaaattatgtagcctttttgaccctcagtatcccaatccgtaaaatgaaggcaatagtacccagctctaaatgttgttgtaaagattaaatgagacaacacctatggtatgtgcagcacagtacctgatatgtatcagtagtagggccctttaaatgtcacttctgtccctcttctcaactccccacctcaccacccgtattagtaagtagtgcttacaatacagataagatggggtgtttgcgaacagcgtcgtgccatccacagtgtcacttatcgggcggcaatatcaagtagtggttaaactctttgaatccctttaagtagactgatgaagttgaaatctctgctccaccatttcctgtgtgactttgagacatttattgaacctccctgggcctcagtttcctctttctttaaaatgggttagtacttctctcatggggtttctgagagggctgaattcattatatactacattcacttagaaaatacctggcccagagtgaacacttattcgatgttagctgccattattattagttatttatttatctctgtgacctcttgtaagcttattaaaggagctgtgcagagtgagaccatgaaacagattttctagtgcaaacggggctgctcacaggaggctcgtggagtctgagttgctgaccttggccccattagcaccgttctctaaccagctcaggcacggggctgtaatgaggattattgaagtaacatatggaaaactcttagagttagctcttgggaaaggaaaaaggcactaaataaatacaaggaattattaaaaaccgggagacgacctcacagggatgctgagccttgtatgttatttgctattctaagaagaaactggggcaagaagccaacttcatcaccaggcgacaaagtggtctcctggctgctgttcaagggatggcagcatgcagcatcacctccaggccatcacagcctcttcctggctgcaggaagctcagctttcccacgaaaaagaagggctgggtcctatgccagatgctatgcctgctgcctcccatatctcgtgcccaaatacccctcctttgaggagagctgggaggtgatattctaagtgagaacctaccaagtagaatattgatggtaaattccctctggtactagtgcagatgacttcggggccaccagcaatctgcttccacagcaggactccagtcccagactgggccaagctcggggcttcgttgccaagccttaacaagtatgtggagagcacacagctctgtaattctggagataacagtccatcagtctctacttacaactttaccacccacccctgtgacattcctctctccagaaccaatcctaaccctcaaatgaaatatacttaaagtggtctccaggtatcacttgtgaaatggtgcacaggaggcatccaagaatgaatcaagatctggcccacagccaccacacagcttggggcctctggtttccccgtggtatcagtggcataagattaatttctatggctccaagcaatgattacagaaacatcctatttctctttgctacaaaatagagaatatcttagccatgatgtcttacactataaaatcttagaagatgaggatagtgtctaagtctcatcactcaagaatatagcacttcatgacatgtacctttatttatacttttctggtaacaatatagttttaaaatactcaaggcctttctaaataatggtataaatatgatatctcaatcctcaaaactaccaacaaatttaaggtatttataacacatacaaccaatacttatgcataaatattataaaaacatggcctacctctcaatgtgcatagcaaaaatagtttggaaaagaaaaaacagaaataaaaattccaccactcaaaataaaaaatagttatctttccttcttcaaccagtttcaaagatgctacattaaccatccactatgaaagggatcaaacatttcagcagccttttaaacctagaagaagtccttaaaaatgtaaagattagacagtagaatattttctctggcatttaagatttttgaagggtctagttaggatctagtaagttcttcagaaaggttaggctgactataaagacaacactgcaaaatttagaagattctctagttcacttactacaatggactgtgttttttcttagagatcaggattaattattaaaatatttaaagaaaaagatgtttctaaggctgctaggaagacaaatcataacagtagatcccaataataagcctatgtgtaaaacagtctcttaaaaaagaggtggcatgtggccgggcgtgtagctcatgcctgtaatcccagcactttgggaggccaaggcaggcacgtcatctgaggtcaggagttcgagaccagcctggccaatatggtgaaaccccgtctctactaaaaatacaaaaattagctgggcatggtagtgcacacctgtaatctcagctactccggaggctgagacagaagaatagcttgaaccctggaggcggaggcagcagtgagcggagattgtgccattgtactccagcctgggtgacagagcccgactctgtctcaaaaaaaaaaaaaaaaaaaaaagaagtggcatgcatatttaaaagtagttacaaagaaagtcttggcagtttttcagagctcccttcatgtaatcactctattacagtgcactcctcaagttgaaaagctcccatttatttaacatttttttaaagaattaaatattttccttatttatccaatttgcaaacgtaaagcaaggctgcatcatctctcctttttccgcatccttctttccgtccactaaggtagttctctgggactgttgacagcttctgaaggtgatttgatgtgaactcccccctgactcctggtttgtctgcttcttataaagagatagtatgctccagagagcaccagaggcagttcttacccagcaatcccggaagcaattttcttctgcttttcttactcaccagagccctcctggaggtttcaagcaaaggagctgagcagtttgcagtagctactagatagaggttcataatggaatagcagcttcaggtttttaatccatcattagaaatagttgttttgcaacttgagagagaaaaagtagaaatctatggcataatgaagggggaaaaatgggtcatgttactgtagagatagatgcaaattctatattatgtcataagtgaaagctttttcggtccatatgggtataaattaataagagagaatgctgtcagcgaagaaagtgtaagtactttgtctggagagtaagagaccggccagttagtcctaataaatccgagggtttggggagcctcttttgagataggtgatgcattgcgcattattagagaatctcttggcatgagtacttttgcaccaagcatctgcttttaaggtctcttcatgaatgttcttcttatgtgctgatatctttatgcttacacaaacttggtggaaggcactattgttgcatcattaaattacctcactgtattctacaactaccctacctaatatgctccaatcactcttactgtattttgttttcttcataacatttccctgtctgaaattattttattcatgtggtatcatttaagtgcttattatctctctcaccctgctcccatcaccactggagtaaaagctgtaagtagacaccttgtcatcttctcctgtatatgcaagtttccattttgtttcataattagcttctctctcctcccagcaaggttttcaagatccaacccaaagactgcttaaggagtggaacttagacttcttttacttcttcaagagtcacttcatggataaaaagcatcctgttcttgggactttgactcagcagagccaagaactttcctataagctattgcttggttgttaaggaagcacaacagaataccagcctgacgtgtcacattctgcatgcgctcatttataatacagtgtggtatttttcacctcctatctgcagcaagatgagataatcgctggctggtgtgagtttttttagtatctctttgcatcaatagatctagttttcagactatatacttaagtttataaaacaattgctaacatttgttttctttaatcagattcaatttgattcttattaagaccatgttttagaaagcccccaatggccctcataatagtgggaagttttagaaacaaaggccaatattatgaacacattaatatataacccaggtgtcatggaagtgctctcaaataggaaacgtggaagacattagttgcctgcatcccaagtcagagacttattttcttaatttgctttctgtgcctccacaatggtctttttccttagctttggaaagaaattataacagccagctaactttattgggtaacatgcatcaagccccatagcagaggttagatatgcattaccttgtttgcataacaaccttatgaggaaggtactaataaaatatgggtataaaagacctccatagttaaggaatgaggaaataataatgcaagtctcttttcctacaacataatggtcctaaaacgtatgtatttctttgcatcttttaaaatgcagcataaatggggtattctaatatcattttgtttttcttcaggtttctcttttgtacattttaataagtttaaaatatataaagtggccaggcatggtggctcacgcctgtaatcccagcactttgggaggctgaggcgggcacctgaggtcaggagttcgagactagcctggccaacatggtgaaaccccatctctactaaaagtacaaaaattaaccaggcatggtggtggatgcttgtaatcccagctactcaggaggctgaggcgggagaattgcttgaacccaggaggcggaggttgcagtgagctgagatcacaccactgcactccagcctaggcgacgagagtgagactccatctgaaagaaaagaaaagaaaaaaaagaaaaagaaaagagaaagatttatatttgcttgcagtgaaaataaatgcagaattttccacagtgaaaagttaaagtttttctctaacttcttccctcagcctctgtccctcctctcaagataagttacaaccctccaaaaatatattgttcagtgaaaccacgatggtatagaatagaagtctacagttagtctacgatgtgttgttgacagctgcgtctaacattctttttaaagattgcatagtatttcattatgcaggataccataatggccgtttcctttttgatggacatttaggccaagttttcctttgtgaaaagtgctgaaatgaacattcttgtctttcctgtgtctttgtgtccttttgtgagtaaattaagcacaacttcttagaaatgaaactgctgggtcaattgtatatgtatcctaaattttgtcaaattctttttttaacagcttacaccaaattatattcccacattggttatagcaattttcaatattatgagttttggcttgtattttaaatatcttcattttccttttagatgttcacatagctcccaactggaaaactgtacccataccctgccaccatctccaccaagaaccctcttgccctatgcatatcatatgtgtataacagtattaccaagtataatagtactttctgaatatccctttctttcctcctttatgtaaaatatgtacaatctgatgatattatttgctaaatacataaatgtatttacagatggctttctaaagactaagtgatataatccaaactttagaaaatcagattttgctcacaaggggtttggaaagtgccttttcaggatcgtaattaaacttagctaattgtaattccaagattgatgcaagaaggcaaaaggttcaagaatgaagtcaatttttcctgaggttaggactaaatctgtaaattctggttatatgaatcgctaaagaattattgcgcagggatcaataaatcacttctaaagcagtgttagaaggctgttccacctcctcagtatactagttattaggctcaagagtgttgggcaaactggttcttttagcttttaacattgcagtaaatggcttggcaacagatttaacattttctttgtaacatccaaggttagctctttttttttccttaagatctggaatgttcccaacacaaagaaatgataaatgtttgaggtgagggacattccagtcactctaactggatcactacctgtcacaaacatgcatcaaagtaacacttacaccctagaagtgtgaacagtcaccatgtatcaattaaacaaacaaaaaagcccagcccgaccttggaccaattaaaacagaatctctgaagatggaactctttttttttcccccccgcaaggttagctctttagtcactggccagaaaacctctaatcccagcagaattttagagctattaagtactttagttcttagccacttagaaatcacaatgacataatgatgctttacaagaagaagaggtaggggaggagggaagaatttctactcctcctcctcagtgacatgagagtaaagaagaaaaatgagaggttataaccatgaatatctgcatgttatgtttacttgaacaaaaatgcaaattttatctcttattgaaaagaattgtttttgaacaaaagtgaatagctaaaaatagtgattctgtacaaccaactgagggactggttttcctttagtttttttgtatttgtttgtttgctttgtttttgttttggcttctcaacactgagcatagctggtggggcagaggcagattcaacactccacaccctctcaggagggtaggctctgagggttaaaatgttgaggggcagatgtcgcttgtgaagcgtcacataccgcgtgaccatggcagagagttccttgagcagtgaaaagcactttcctttcccaacagatagtcttatgtgtgcaccaatcccaagcagaaatcatgattttctttactctataggtgataagcatgagattcttccccaagaagaatgctgaaaaatcagaaaggatataaaaatggaggaaggggtgggatattcaggaaactaccaaaatatgtacatgtgaaaataaatttcatgaaactgattctttggttaaatagcgttttaaaaatctcttcaaagctctcaaatgggcctttgaaaaattaaattacaccacattggatctgaatttagcatgtaattttctaacacatttttatttttttattttttatatgtttttaattatactttaagttctagggtacatgtgcacaacgtgcaggttaacacaaacattttaaagttagaggttctacgtcaatgaaataaggctaaaacatgaaccttgggaagaaacattggaaactttagtacaaaggaagttacgaatgaatatgattaagtttagaaagctttcctaggagaggaaatgtgagatgttgattcaggttttcgttcaaagaatgaaagcattatttaaaatatattttgtgatgcaaacagggaaacatcatagtatttttgtgtgtgtgtgctgaatctaagctccattttacagctagtgtgtccccaataaaccatcctaattagaaagcccctggaaatctccagcattatcttaattaaattagcctaatctaataaatgcatcataattaagaggactgtgccattctttagtgttcagcacaccaggcattagatgatttgtcccactttcagccgtcagttgtcatgcttgctaaaagaaaagaaaaatgatagcaccagtcatcgtagtccctcaaggaatcatccatctagttcttgaattttctttacaacacctctgtcaattatttcttcctcttcagagcatctagtgacagggaactcactaagccattttgatctatttcatctttgaacatatggaataattttagccataagaaacctcagggaattttttttaattccttcaacatagacctaacatagtacccagacaactatttttacgtccaatttcaaacaacctggaaaaacagcggatcagtggaacactaaaggctatagggagactatgatcattcttgcccaaaggaattgcaaaaaggcaggtgtgtaaatagtatttacatataggatggacctctccacctttttctagtacagattaatttttaattttcccaacatctataaattgccagaatggtaaggtagtggggaaacactttctcacaatgtacacagacttgaaagctgttgacctgtcctccttatgacagacagttcttggcaaccccaaggagagatatggctgaggcagaaatcacattatctagctcttcggctatacacatattgggctctgataattagaacattgatccacaagacaacctttgagtatgctgttcttttccttcacagcaaacacgtatagtcattatcgtttgcttgtttgtttgtttgtttctttctttctttcttttttgagacagagtctcatctggagactcccaggctggagtgcagctcactgcaacctctgcctcccgggttcacgccattctcctgcctcagccttctgagtagctgggactacaggcacccgccaccatgcccagctaatttttcgtatttttagtagagacagggtttcaccatgttagccaggatggtctcgatctcctgacctcatgatccgcccacctcgacctcccaaagtgctgagattacaggcatgagatcagttattttttttttaagacacagagtctcactgtgttgcccaggctggcttcaaactcctgggctcaagcaatccttcaacctcagccttctaagtagctgggactacacatggctcatcagtgataattttaaacacaaaaatacacatttttatttgcttatgcaaacaaaggaacgattataatttcctgcaactagtaaatatcatatgctaaatcctttttttctaattccacctcttccccaccacaccatgtaatagctttagagttgttttttttggggaggagggaaggggtgttatgtgtatttttttgtcttttgccaagtctctaagtgcctctgaagccaatttttaaaagttgtgcattgtgagatcacagttgctttagggcatacaggatataagcacaaaatgatggactgtagccaggtagtgaggctctaattgtgtcagaaagaagaacattttcatcatgacataacgaaaactgtatttttcaaagaaaaagatctaaatctgtatcaagtgataacattagttttcctacttttaaaaacaaaatctagtctattattaatagaatgaaatgtcagccttaggcaatttgctgtgaaaaaccaactgaaatgaaacatggcattttattcgttattcaaatggccaaataaaacaaggtgtaattagtcctgacttcctgttcttgctcacacacctgaggcccctccccgctctgctgcagctctgcataaccaggctctcaggggaagcagtggaggcagccttcttggacaacagctcacttgtctacacagtcaaaagtatgtatttgatcaaaatggttgggaggaggacaggtgttacttagagaattacctgtgtaactagaacaagaaaaggaggcagcatttgcagaatgtttgcaaatctttcaggaacttgattcaaggagtgtgtcagatgttaaatccaggcatatatgtatatggctacttgtgtgtgtgtgtgtgtgtgtaatagtgtaatttcacttttttaaaaaatgaagacattcacaattttagccagaatagttggtgcaaggtccataagtgctacctgctaagaatataattccttctacctctaatgtttcattatcaaattaaaagagttctctcctcagtggatacttcatttatcatagctctccttggaaagctgacctctaaacatgaacttctagaaggaacacagaataagaacaagggaaaagcattcgggaaggagggtggctttgaaaggagttagctgggaaaacccttgaaaaagaaagtgaatccatttctgtacatacaattattgactgacggggcagtttacagttttaagttcgtgtgcactcatgccctgtttgagatgcctgttttgtggttcctcagagaccacactagccacatttgaacaccattagattagactagagccaggactctgcaaagggaggctcttcctcagcctctgacagaatcaccaccaaatctggctgtcctccttgccctgagcaattgaacttggctctgtggagggagcctcaaccaactgaagcatcatttggagaacagatgaaaaataaagaagcgaagccttttgaattctaaagttttagctttttccaaaagtaaggcattttcctctcattctcaatctcttcttccattcagttttctcctcccatattcttagtcgtgattacatagattaaggcaaggaactgggggtttcactaatgaactcggggaaattttgagggacatctcctgtcctttgactttggggaaagttcttccattgctaaggaaaaaagttgtattggatgtaattgtttgttaaatgcaaagaactaactgctgggcattctaggagtccgtacatgaactgttttacgtgggtttctgcaattccatagagtcgaagacaccaataggagctgtggcccctttgcctagtttgactttagtcctttggagtttcataattctgaggggatcattgtatttcagtggacaggttccaaatgcacagaagactgacagcattgtctgataaagcatctcccattttatcccatttggaatgtaatccaagttacaacaatagctaataattacctgctgtaattgtagcaacagaatagctgaatgtgcacctctagctgatttatgtatgcaatttctcattctcagctctctataatccattctccacccccccaccccccacccccaacgctttggagccttgaaagcattcaatacaaattttcacaatgtaggtaactttgaagtgtggcttgtcaggtcatgctgacttatttttgtacttgcatagggaattggtgaggatgaatctatttttttagctaacaagtgtaacttgagaatttgtgaatgagtgacagatggggtgggaacctttttttccttcacgtattgtgaaatgtactcctgtctactcatgggaatgagtcacatttgcaaaaagccataatattcattagtgccaaaacgacattttttagttgctcttgcaatgagctgtaagtaggacaactgcccatcctagtttacccgaaacagttattatttattcctataattatcaatggttacctatttatttcatcctcagaaatgtcccggcttgggcaatatatgtttaccctgcatatccagattgtggggggaaatccagtattttcatgtgccatgcccaaatggcagcttatttaaaaaaacagaaaattcttggaattaacggtcaaggatacgtgagagattagaaatcaacatttcacattaattcctgtgtaagaaaattatacgtaaacatagactgttaaaacaggcatagcaaatatgtttcaactcaggggccaacactaattggttggtagtggctgcccctagcatcactggagaaggactctgaaaccgagttggggatcaatgggatatagggcttgccgtattactgatgtctgccataagctctggaaaagctagttgtaaaatgtatgctaggtattaaatgtcaccaccatagagccagatgaggttttagtgataatccaacccagtgttttcaaaatgtgttcccagaacactgatccttcaacatgattcacagaacacatgttccatggtccagtaagattgagaatgatgcctgccatatttctctctcagaaattcagtgtatattggcacagagctctaaaaagttctgtttaactttctgacagatgtttaactttgtttaacccagtgcttggtaaacctatttggccacagaaaccttttcaatgttatctgtcaacttgctacagaactagtttcttggtacacatttgaggaaactctagtcttagcccattccttgcatttcacgaataaggaaactataaccccaaatgagagactgactggaccacagtcaacttagttgatctatggaccaggcaaaactggaactcagtgatataagagttaagaagaaattatttaggcagatagtgagggtataggagtccttggtaaggttttccttttaatgaaaagcagccccaaaattatactaacgagcagcctgtaaaattgagctgcagacacagacaagcaagcgggaagcttgcatgggtgaatgccagcagttgtgccaataggaacaggcacctgagactaggcatgttcaaaatggcagctccaccttcccttttctttgccagccacatgtacagtaaggagcagatgacatgggctagccaagtggaaagcccatttgcataataagattagggtggggtggccagccttcccaaaacgtcacacctggtccaaccaatctgtgggccctacgtaaatcggacaccaccacctcaaacctgcctataaaatccagtgcactcccattcgggagcccctctgtctcaaaaaaagagagagagctgttctcctttatctttctttcgcctattaaacctttgcttctaaacccactccttgtgtgtgtccatgtccttcatctttttggtgcaaaacaacgacgaaccccaggtatttaccccagacaatgaggctgcttcatcagaactgctgactccaagtcctaggtcctttccactgcatcaacaatgaggaaaatattagaagcaatctaagattttaatagcttctggcagcacagatatttagtagatttcacttatctatttttataggttttggttttttgttggtggtgggtttttatttggtttttttttttttttttgtgatgagatcttgctttgtcactcaggctagagtgcagtggcacaatcatagctcactgctgcctcgaattcctgggctcaagtgatcctcccacctcagcctcctgagtacctgggactactgacacgtgccaccatgcccagttagttttcaaattttttttgtagagacagggtcttgtcatcttgcccagactggtctctaactcctgggctgaagtgatccttccaccttggcctcctaaagtgctgggattataggcgtgagccaccatgcccagcctgtatttgtttttaaaagatggtaaataaatatctgtatattcctagtgtcagacactaagctacctctcatggtcaaaaagaaaaaaaaaaggcaagataaaatcatttttgtagttgagttttatctgggctggtccatccttctattttatcctttttccttaggagataaagtggttatttgaggaaagacttgctagacatgaatctggttttggttcaaattctattttattatttcctgggctttgaatttcaaaaagccaatctatttattggtctctttggggccataaggttaaagtacatctgttgtccacacaaatttagctattggccttcgagctaagcagtcatgaaattatagccatagtaaatttagacaacgattaatttcacttcggtctgcctataagtccacatgacagaataaacatagtgtgtcatgtggttaatgtgaacacatgtaaaaaattaagaaatctttggtgaccagacaaaaaatactccataaaaattaattagtgtttcattgtggatgtatgaaatgcaatacttatagatggcctgacttggagcttaggcagcaacaaaacttatcttgggcatcactttcaaatttcgttttggtggttctccagttcgtggcagaccactgccattcctttgaggaaaaggaacacctggaaaatataaccattgctgaagcacttatctctctggggttttttcctaccctttattttcattattataccattacagaaactggttgcttcagttttcttcaagtatggacttcatgaagccatgtggttgcatgtgctttgggaggaggaggcagctgggggctaaatttgccatcctgaaatcacccgtgacatccctttgaagatacattttgtcaggaagcacaaatcagtgaagttgtgaggaagaaatggagagacatctttcaacataaccttgtttccccttgagcataaaggaattgatttaaaggagaaaataaagactcaacagtttttaaaggcttttatttaataagcacctgattgtttccattaactggcttttaacatttaccattttgcttagcaaagttggagaacattagccaagattcactgatgaaactttataagcgttataagtcagatttgtttcattttaaaagccacatgtttaaaatacagtgcacagagaattttcatgatacgtagttgtggttcaataaaataaagatagccaaaagaaactgtcactcataaaatctatatttcctgctaagtgttagtattaaaatagatactgctagtcaacttgtaagccaagcaatgccatatgtgattttttaacataagctatttgtagtctatactagaaagtgtatcttagactttgcagtgatttgttggttcctttcattaatcatgaatttattatcataaaaatcaacacccatgaccctatcttggagaatcggagtgttctgagcattcccagatgtgtactgcagctccagtatacagttcagagccccactgccagttgccaggatcacaagagaaagatattagtagaccacgtcagggaggtgaatttttaaatgttcttacaccacccaagaatggaagtgactggtggttttcaaggacagccatttggtctgaagcagctgcagccccttgattttaattatcctcctgaccctttgatccctaaccaaaaaggccctaggactgtggacagatgcagccactctcctttaacaactggactcagaccaagtcagcagtcacatttaacctcaccttgaaatgtagaaagtgaacaattacatattgaacattttcatgtaaaacatcttcttgaatttcaatccagccacatcctgctagtgcgataatgtgatccttgaatttttggcaccatctaatttttaagctggaatgtttggaaaatccttacggggagggaggaatcattatgcaacaacaacaatacacacacacacacacatatgtatgtgtacgtatacatatttataaaaaacaatttcaaaatcccagcacagaatagtataaagaaatatgccatcttacagaactataatgttacaatcctttttccttttatgtactataatcctttatgaacaaggaaaattcaatactggagaatattatctcctctccaacaaattgacttcaacttgagtattatatccaaagaaacttaatctgtaagtatgaagctatacccaactttgaaagatttttgaagcagtacaagtttctttcttcttcctcttttttttttttccttttttttgagacagagtctcgctctgtcacccaggctggagtgcagtggcacgatcttgactcactgcaaccttcacctcccgggttcacgccattctcctgcctcagcctcctgagtagctgggactacaggcatgcaccaccatgcccggctaatttttgtatttttagtagagacggggtttcaccatgctggccaggctggtcttgcttgaactcctgaccttgtgatctgcccgcctcggcctcccaaagtgctgggattacaggcttgagccaccatgcctggtgcaatacaggtttctatgtgatggaaaaatctaagctcattaggtaaaatatagtcattgtatttccttatgtctacaattggattttcttctccgttagcccctgctactagtctcatgaactaagaaacctggcttagctgacatctatgcttccagtcgattcctgcattgcggttgaagtgaaaaaagccccttgatgaatgaatgaataattgattgatgaatgaatgaatgaatgagtatgactagatcttctaatccttttacattttatttccaattagtacaaggtaattttcatacgctgtttatggtcttgaaatctgacagccagtcccaactggtttattcttatattagcaacttaattcttttgaaggggcatgtaccatgcccactaattttgcaaggtttggctctccagtttccctcagctccttgtttgtgtggcaattacatagctatttaacagctgcactagaaattaaagaggaagaatcagtaggctttgttaaaacatgtgtctatccatagatacatgttttgatgaaagatgaaagccaaaagcattaaggaaaatgaaattttggagactacgtggtttttattgtttgtgttcttatttttaattgctatagataaatgagagttgctgtatctaaaaatataatgacaactacttcacaaggtacttgtgaaaataaaataaggtcatatttgcatataatatgcattcaataaatattctctttcccttaatttgaatttttataagtccttaagaattgtcattgttcccaaatattgtatgatctttccatcctaattatgagatcataattacatatttttatgattttatggcagaaaataaaaaatgtgattgaagttgaaatttatcagaagttcagaatgggaatgtagataataagattttaattttttgatatgctacccagatactattcactagataaaaggcttccaggtattcaaaatggaatgaataaatgtccgagggggttctcaagtcaaattttacttgagtggattctctcttagccacattccacccacactcctctctcaatcaaaacccctctccactcttagcccatagcaattaaacagggctttcaggatctggaggaaagtgagaatgtatcccctagaaagagatcaaattgaggatggcaaatgtgtttcatttcagccttcaactttagttgctttgtagccttaaacagctgtgctgaggattctcagacattctgtctcactagcaaagaacattctgatgagtgagtgatgtctgccacaggaagaagggggatagtgtccttgcctgtgccatgcatttaccaaacctatacttcatcctattttgtatgtttcactgtttagcttgtcaccctagtatctctttccctaaatgataccagcaacaagaatttaatgtgagagaaatttcaagaggtcaaaatttaaccaacagatctcctcccatttacctctttagagaatagtaaatgttttgagttctttgccaggaagctggtggaattatgacctttgagaaactgaactaaacaaacatgactgtagcacacccatctcgtccaatgtgtggtgccaaacttcaaaactctaagattctgttagtttagacaagaaggtgatgcatctttaatcagctacatgaagagtggatgaggcagatttccttttctcatatatgcactaactagattattttcagtttaattttatgctttttaaatgcacttcagtttgagttggtgaaagtctataagcctctctccatatatattttaaagcacaaactgtggccgatattaaactatttgttcagtcctttcttcatctgtaagcatattcttctttgataagctcaatggcaatgtgccctgtttgaaaatgtaggtttgactgctattcggatgtggtgaggtcaacagattaggagatgactgtcattggaaagatactaaatagtttgttattcatagttcccaagaggagggggcatgccacaccacaggggactgcaggggacgtgccagggtcagtcagaaggccaaggagcaagggggaaatgtggacaggtgcctttgcctaggaacccacaggaaagggataggtgaggcaaggtacgcagggttagaactgcctgttttgagtaattccagtgggttctcaagcacaggggctgtttctggttgtctggtatctggccctgggttgatgtggggagggaagttgtggccctgagtatgagagcccaatagagggggtgcagagtgtgtgggctctggactggttagtttgcatatggagggcatgctcccaggagggtctttaacacctctaggaactggctaaccctgggatgggcagtccctgcagggtcagcaatgtcctagatgcaaaattgaatgcatgcaaaattatgttctttttgtatgtttctctctgtactcaaaaataattaacctcattcatttgataattgatcatttgtccctttctgatatcgtctgtattgtttcctcatgccattatttgatatcaaatgtatttatgccaatttccccaactagaaatcaactacttcttgattgtttaaaaaaaatgcaatttttaacttttaaaattgatccatagagtattgaacatagttgatgctttaaaatatttattatcagccccacattactttagaacatgcatccgatgaaataacaaatagtgaagaaatctgtgctctaatagatttgtaaaatgctacatacatattacatctccctccttgatgtttgcaattcacatttccttatttaaggccctgggaaggcctgcagcaaagaaatttgtttaacgttgtctcaatccagccatttactaaacttatttgaccatgaaattttttctcattgagtacctgctaacaacccgtgaatatgttgcagaatgcttttctgtactgtttcttccatggaatttgtactttaaaaaaataaattaagactgattataaactgagtgatgatgagtttaaggctaaagaaaataatcagtaagtgctataaagtgcttgaaatataccttaatactggcagaaaagttaagacaatgaatgcattttctgcctcagtctaactcatctatttagtcatctgaaatggctcattatgtaataaaactcttcagcaaccgcatatggcaaaatgattggtgcttgtaaaccactaggctgacctgtttttgctttttaaatatgcatgttttttgttctccacctcagtgaataaaattgaaacagcatctcagattgtaatacataggagaaataatgcagagaaaagaataaatttgcccagtaaggtataagtaaaataattagcatgagccatgcatattgctttcagggaaagcaactgacagccagggaaagtcagttattgacgtaagtgcctgtcaagtcaccagttctatgttgttaaaatgtggtaagttagggtgtgacccaagaggaggaggaaaaaaaaaaaaaaaaaaccctgcaaatattttgatggcaggctctccctaaaaacaaaaagggcagcatagtttctggccagtatttagatcagtgtgtgtttgatctatgattggaatcatttgctcaatggaactagcaatggcagagcaaagaggctcaactgtgactttaggaaagtcattgagccttccagttcaggttcctcatctgtatgaagagacaaaatgtcaagggttttttgttaaatggaagagtgtatttttaatgattgtgttaaaaaatatttcacaaaatgatgtagaaaattctttgatgaagggtgcaagtaattaatggcttagcttacttggaatatactaggatacaatcatgtttctgagatcacaggcccacactggacctttaaatgtattgatggatttggcaccttgtctttatcacaaccatggtacttaactttccatgttatactgaaattagctcttgatgggcctttctatcctattggaatgtaagtttttccagggtagaggcctggtcttatattaacttactctctaggttctagcacaatgtttggcatatgaatgtattaagcatgccttttaattttcagtgtctctgctgctttggcatgcgagggaccagaggtacaatatacatttttaaaaaatggttgcttgggaggttgaggcaggagaatggcatgaacccgggaggcggagcttgcagtgagctgagatcgcgccactgcactccagcctgggcgagacagcgagactccatctcaaaaacaaacaaaaaaaatggttgctatgtgaaacaagtgagcaacctggatggaaagccaagactctgtgaggcgggtcattctggtccagaacttatcagaccaacacttcttaaagtgcacatgatcacctaggggatctgaactgattcagtagatttggggtgagggtcaagatactgcacttctaacaagcttccaggtgatgctgatgctgctggcctcaggaccacactttgaggagcaaaaagcaggagtggggaatcattttctataaagatccagatactacataattggggctttgagggccatataatatgttgcaactactacttgactctgactataatgcaaaagcagacatagacaacatgtaaatgaatgagcatggttatgttccccgccccccaccaaaaaaaaaaaaccttatttaaggactccgaaatgtgaactttatgtcacaaaatactcttcttcttttgatttttttcaaacccttaaaagtataaaaaccattcttagctcaaggaccttataaaaacaggcagtaggcttgcaggctataagttcactgagttagaggacaacatactagtcacttaggtagttggcaaatgtttccctgtggagtacatctaaccaaaagaaacgaatccttctctctatggaacctctgttgcatttttttatgcttcattttcccccagtaggtggtttatatcttttttatggaatgtagaaacactctaattcacagacagactcaactagtttcagagtttagcaggcgttattttttctattacctgtagtaggtaatgcagttcctcacacatagaagaagctctgttagtgtatattcagtttattttagtctgttgaagatgcctttagcttggtcttaaggaagaatagttcctagatgggattaatgaacagggtaaggagataattccaaggagaagaaaatgtgggcacagaaaagtaggcaggtaatatttgagggctatgtaaggagcagtaagtccatgcaaatattcgacagaaacagaggattagtataagaaaacgatagggccaagttatatgaaaacccacagtgacagatctgaagtttagagaatgatgtatgtagggaaaaacctcaagggcattaatctgatgacagaatatagaaagaatttatagtctgctggtgatggagagaccaattaaaacactaaagccacagttaatactgatgggtgaggatctggactgtggctttggaaagataacagaaaaaaaagaaagagactggaggatgactctgggctggaaagttcttcaagactttatgacaacaaagaaaaccatacagtgccccagaatcaagaaatactgtcctgctccgttgcccccaaaataatatggtttgcattgcatagaatgctcagttggctgattattgtatgttctttaattccccaggtcttatctcttctttggtgggaatcacatatttactgttgagcatggtttctggggttgatactcagagtattagcaaactcatttgctttattaactttattttcaaattaaattagacaaaaacctgtattattctactctaaatacagaaaaaacatgtcttccgtgtcatatttcacaaaaggatgtgaaatccaagtaattttataggaaactggacttagagaaaatctctaagtgctcattaagagctaaatggacaatattttcccagagaattcaatccttttagttctaagtggcagatttctacatatttctttaaaaataaatcccatttggggtttttttagggcagctttgggctttgttttgttttgtttgtatgtttgtttcttggtaaaatgtaaaggccaccaaatgctactgagaatttgaggtgctgggggaagagaggagagagagtgagagaacctgtgttcaaacagtctggcagcctgaaatttcccacacgaaggacctgattgtttgggaaaggaaaagtgctgacgagcaagaatgaattacagcacaactgctatatctctccacatcttggaggccaaggcggtctgctagaaagttttgtaaatatcagaaatgtggaaggcattaaatctgttactgctcagctgatcagaagtcttaaggtcaacaaaaatattgctgcctgtgattttttaacatgatgataagtttcttttcatatattaaatattttgagcataatgtttatattttctatttttctttagataagactaatagataaaattgtaataaatggaggaggtatttgttataaagcattttataagacactgagtttctgttccttttataactgaaatggtctttctgagtttgatagcatcacttgggttgataaaatgtacaagatgctttacaaagaaaacctgtgggaattgtctagtcattaatttcacagtctaaattgtagagtttccattagtaacactgacattgttttttttttaatcaaacaaacatcattttgcatagcaaccagccttcacttctgctttattgttttaaacatcaccatttcctttctttccctcctatcctttgacctccatttggcctgcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtaaggaggggtgcctggtaatgggggataaaggggtgtcaatggtctaatgactccagtatcttgggcatgcaaatgtgcctttccaatgcaaatggcacaatggtgttctaattcaaacttcatttccctgaaaacctttataaattgaactgttccgacatttaggcacccatcaactatctctgatgtcaacatttgttccttttaatgtagaatgtttccactccattaacttgaattatttaaaatgtaaggtatccaaattatttttgtctttctctagtaaatgaagcatagaaacacaattgaaataccatatcaagcaaagttaaacgataaatgactcaggaaatcattcatgagaattttaagtgattgaatactttttaatgttctcatttttactaaattctagaattttgtctcttttgttaagaccccattattccttctaaatgtattataaacttgcaatcactaggtgagaatattcaagaatcaatgttgtattaaagaggggtacgcagagaatgggctatttctgttgttctgttcatttttgacaggattcagtctccagggagttgaaaaacttgatatcaaagtattatattttacatttttattgtgttttgatcaataccaataatttagaatagttggaagtgttttaagcactgtagtgtatatactattcctaaatccataaattgatgagtgctctgttaattggttgctttcaaaataatggttaaaatatagaaagaatattaaaatccttgaggtctgtacttttttaaactatttaatagcaccaatatctccattatgtggaggtgaagaaggcaagatgtgagccaccatttatagctccttcaagaactggcccacaataattagctttaaaagtagggccaggtgaggtagctcatgcctgtaatcccagcactttgggagcccgaggcaggaggatcgctcgaggccaggagtttgagaccagactgggcaacatactgagaccctgtctcaaaaaacaaaacaaaacaaaacaaaaaaacacttttttaaagttagcctggcctggtggcgtgtacttgtactcccagctattcaggaggctgaggaggtaaggagggaggattgcttgagcccatgaggtcaaggttacattgagttatgatgataccactgccctccagcctggaagacaaagcaagaccccatctcttaaaaaaagagaaaaatttaaaaataaaaagtaacgattactgatgactaaaagtatgtacctttactttcagtgaaaggatcctccacattacctttggtagaaaacatcttggagtgcctcaagggaccttgtcctattaataaaaacaaacattctatatgtagtaacaactaatacttacatgacacttacaaaatgcacacacacacacacacacacacaatcatttatactttgccgtagcctacgaggtattattagtgttccttttttataactgaggcctggagaggtagaagaaacttgttcaaagtcacacaataatttgaaccaagacagtcttgctccagggcccatattaaccaccctatcatactgataggtatttcaaaatgctgcatgaatgaaaaatgaatgataaaaagatgtttaaaatttcactaatgagttagcagtattattcaggggtgggttatgtagcaaacttcttaagccatcttagaatacagtgaaggaaacaaacttccataaaaatcctgtctgctaatgatgatcagatgtgtctccaagttcagatagagcacttttaaatgaaattctttatttgcttgcaagattgctagaaatatgataaattttgggttgtgctgctttcatactacaaatattaaatgaaatcatattagatttaagtaaaagcctgtcaacttaatttaaccaacatttattaagatcctactaagtgccacacagtgcaggtataaatgtggttaagagacaattcctgatatcaaggagttctcaatctaacagcagataaacacatttttttaaaaaaagccgggcgcgggccgggcgcggtggctcacgcctgtaatcccagcactttgggaggccgaggcgggtggatcatgaggtcaggagatcgagaccatcctggctgacaaggtgaaaccccgtctctactaaaaatacaaaaaattagccgggcgcggtggcgggcgcctgtagtcccagctactcgggaggctgaggcaggagaattgcgtgaacccgggaagcggagcttgcagtgagccgagattgcgccactgcagtccgcagtctggcctgggcgacagagcgagactccgtctcaaaaaaacaaaaaaaacaaaaaaaacaaaaaaaaacaaaaaaaaaaaaacaaaaaaaacaaaaaagctgggtgcaatggctcacacctgtaatcccagcactttgggaggccaaggaggagatcaagatcagcctggccaacatggtaaaaccccatctctactaaaaatacaaaaattagccaggcatgatggcaggcagctgtagtcccagctacccaggagactgagatcatgccactgcactccagcctgggcaacagagcgaggctcagtctcaaaaaaaagaaaaaaaaaatgtaaaatgataaagtaatattataataagtggtataagagaaatcgaaagcattttaagaacttataaaagttaaatgcatgatatataagatatatataaaatcatatatatactataaaatgagatatttcactgcctcttgaaaccagctgcagaatccaactgggatagacccaaactctcaccatactgatctttaacttttaatgtggttcttctgtgtaaaagcctctgaactgccagtcctcttttgccagtcctttcaaatcatctgcctcaggtactgaatatgagaaaagtatccctctagttctatatggtacgtatctttcatgttcgggacttcaacagagatagtggatttcttccagtgcccagctttccatgtgacactgctgaacttactgagacatccgacacctttgggtacctctgactatagatagatcgtatgtgactttagataaattgaagggagagtaaggaaactggacatagcaagaatgaagaggtgtgaagattcagtctgctaagcctaacataaagtgctttagaaaactggctccttggccttgtgaaatatgaataattttttaaaaaacaaaagattttagtgttttaatccctaagaacagttatgtgaagtgggagagaacctcagataaattcttagcctcaacttatgactcaaagtaagaaatttttatattttacttattctagcactaaattagactcacccatattcctattgaattgcttcctgaagcatgttattactacatcagctgtcgttggcagcctatctatcagagggtagaaaggtttctttttgaaattaaaatctcagcaaagccatctctaaaagtttaacaacctacaaattagaaactttctaaattccactgtcccatgcgtcaagttttagaatgatacaaaagaaattacagcttaagaacagtggctagcattcatttagtgtcacctaggagccaagcactgttcttcatttttacagagatcacctcatttcatcctcacaaatatcacaccatttaaaattttcttatttttttaaattgacaaataataattgtacacattcgtggggtatgtggttatgctttgatacatattacgtatagtgatcagatcagggtaattagcatatccatcatctcaaacatttatcatttgtttgtgttgagaacactcaatatcctccttctagctacttaagaccatataaggtattattgttaactatagtcatcctgtagtggtatggaacattagaacgtattcctcttacacttttagctgtaattttgtatcctttgacagtctcttcccattccccccttctccttcccctttccagcccctattagcccctgttctgcttttttacttctgagattaactttttttttttttgagacggagtctcgctctgtcacccaggctggagtgcagtggcgcgatcttggctcactgcaagctctgccttccgggttcacgccattctcctgcctcagcctcccgagtagctgggactacaggcgcctgccaccacgcccgtctaattttttgtatttttagtagagatggggtttcgccgtgttagccaggatggtcttgatctcctgacctcgtcatccacccgcctcggcctcccaaagtgctgggattacaggcgtgagccacctcgcccggccaagatgaacttttttaacagcaagttaagcaccgcatgttctcactcatatgtgaaaactaaaaatcaccctattttatagttgaagaaactgaagttttaaaaggctaagtaatgaccaagatcacacatatacacacagcacacacacatgcctgggagtcaaggattcaaacctaggcagtgtgactcctgaatctgccctctaccctacagcataaaatccaaataaactcatcatcactggggcagctacagttccttgccttcatcaggcaacaggattttggatctgagcacagcatttttcagggcatataattgagcacttttcggtcattctcaagaatacagtgagtgactactgtaagggaggccgtggttcaccctcgagacacacagcagcgaacaagcaggcctctgccatcactgcacgaacactccagaaggggggcagagtaacccagtaaactcataaggcattccagcagcagcaagtgctgtgaaagaaatgaaggtggctgatgggatgcggtgatcaggaagcctgctccaaagagatgacatttggtctccgataggagcctgagaaggagccagtagggaaggctggggaaagagtgctccggaccaagggaacaaatgccctggtgaggacagccagatgtgcctaagttgcaggaagaagtccagggtaactggaacatcaggtggaagagttagctcagaggcttgggccgcagccggggtatgccggacacagggcctatagtcaccgttagtttggctaaataaaattgaaaatcatggagggtttaaactgattcatattttctaactgactctctggttggtagaagcctattgcagcaggacagaggagagatgcgggtgcctcaggaggatatggcggagatgagggagtgagtcagattcgagttgggttcagaggcaggtccaaaaccctgcagtggttccatgtggaggcgaggggaggaaaggaatcagggatgactctgtggattcagctataccgtttgtgaggacaacggtgccaatctctgaaatgaggaagacggaaaaggaataggattggagacagaaggaattaagtgctgtcttttgaacgtgctgtgtgtgtgtgtgtgtgtgtgtgtgtgtctgtgtgtgtatttggagatggagtctcgctctgtcactcaggctggagtgtaatgccgcgatctcggctcactgcaacctccacctcctgggttcaagtgattcttttgcctcagcctcccaaatagctgggactacagtcacgagccaccatgcccggctaatttttgtatttttagtaaagatggggttttgccatggtggccaggctggtctcaaactcctgacctcaagtgatccgcccaccttggcctcccaaagtgctagaattacaggcatgagccactgcgtccagcctgaacatgctgtgtttgaaatctctatttagctagccatgtggatgtgtcaggccggtagttgcaaatataaacatagatgtctagagcacagggtgagaatgctgtatttggggagcatcaggatatagatggtaactaaagctgtgggactggatacacctccagacagatcagctagggaggaagagggaatggggacgaggaagggatctgaatctgagcctgggatactcctgcctgttgaaagaggagttgccagcaaacaagataagaaagaaaagcccccagggtgtgagagaaaccaggcagaatgctgtaagggaaggcaagagaaagagtttccagaagacagggctgcaagatgtgtctgctgctgctgagagctccaatcagatgcgggccaggagaaaaccactggggtcagcaacagtggatgttgtcagcgattttagcaagaggagcttgaggaatctgaacagggttaaagatcaaatggtactggttgagaaaagtttgtgaaatatggaaagagaagcagcaaataacatacttgttggagaagtttggcttaactgccaactaagagataggagctggtatctggaatggagcatggggtcaaaaagatggtttttacaatgtgtgtgttttcaggcaggatttactagaatataggctgaagaagatagtgcaagagagaaaaatagatcatgcaggagggaggagagtaagatggggaaaggaaatggaatctgtactagatggcgagagggtaccctcaagaactagctggcagagagagcttctcaagaatttcctatgtaaataggaaagatccatgtaaacatgtaaaataaatacagacatctcaagttcccaccactgcctccccctgtgattgtaaaatgaattacacagactgtcaaatgaatagctttatgagctccgaagagggcaagatggtggccctgaaatgtgggatgaaggaagctggattaaaccggaccttgtggataaagaggattggggtcaggaggagaggagggcagggcagcgttaaaaaggtagggaagagaaccagcgtgacacagattggcaggtcctgttagacacaggttctcagtgctacgaataatcagataaaatgtgtgcccctttgaagtgacattgtgaagcgtgctgtgatgtgaaatgtggaattgttcctggtaatcacatagggtaaagcccttggtgctgggaccactgccgtgcctctctaggcagagattccattcactgggttttgaaaacttttggagaaaagctaaaccagtttaactttggccattcttcgtgttatctattttaaaataacctttcatggtattttatgatggctctatgctttggtttcttcatctggagaaaatcagattgttgtaagggttgagtgggttaatccactggggtggtgcctagcacacagtgtaggccattattatttttaaataccatatttttatttttaaaaagctaaaatgtacggataaaaagaagatataaaaatcatgtctaggccaggcatggtggctcatgcctataatcccagcactttgggaggctgaggcagaaaaatcacttagtccagaagttcaagaccagctggagcaacatagtgagacccccatctctataaaaaataaaaaaaatagccaggcatggtggtgcacacctgtagtcccagctacttggaaggctgaggtgggagggtcacttgagcccagcaggtcaaggcagaagtagctgggatggcaccaccgcactccagcttgggtgacagagtgagaccctgtctcaaaaaataaaaataaaaaagcatgtctaatcctagtgccttatgacagtcactcttaatatttttatctttccaattttttcctacatgtgagtacttaaattttgctgtatctactcttttgaacttttttttttaatttaacctattctgtcacagacatctacccatgtcattaaacgttctttaaaaccattctaattcctttgtagttgttcaacatttataaagttatgtgtcactgacattgcttcggttactctgatctgtaaatgattcttgctgtattggtaattatagcaactgatttaaaagagaggaaaagaagtaaataatagaaatgagagaaaggatgtatttattcctcaaatcttgaaaggcaaaatatgtataaaaggataaactccatgactcagttcagtaaagtcagttagagatttaaaacatatctatataatatatattatgtttattttatttttatatgtttatatattttacttatatgtattaattatatatatttaaaaaaaaattttttttttgaaaagtctcgctctgtcgctctgttgcccaggatggagtgtggtggcgtgatctcggctcactgcaagctccacctcctgggttcacaccattctcctgcctcagcctcccaagtagctgggactaccatgcccatctaatttttttttttttgtagttttagtagagatggggtttcaccgtgttagccaggatggtctcgatctcctgaccttgtgatccgcccacctcggcctcccaaagtgctgggattacaggtgtgagccaccgcgcccagccagtaggtttttaaaatgaaaagggagcaccttttaaagtcaaggcaggagactcatttttgtgacatttccactggccaaagcctggagcaggatcgtcggcgtgtgattccttcactctgcgtgggaggcagaataggaaaagttaaggtttaggcaggtaactgttaggtgaacagatgatagtaactacaagggctagaacatgtaactctttcagactggagcctacatccaaaactgaaagtgacggttaataaatatggagaaagacgttaacctgagactccgtagtgttgtttttttttttttctcctgaccagcaggtgcaaagcagatgactgaagtgggaacagagtgggagagggcgggagaatcgccctgaggggaaggcagggaactggctggcacagagagggagatttgatctgcccccgtctccaagagctgctctgacacctgagatgtaaggtgactttcagatttcacaagggttggacaggtgtgcaaaagctagcaaatgtgtgtttattcagggggccccagcctttttggcccctttttcctttgaaaatcagctggaaaaaagtagcaagaatggctttctaaagagaggtcatcagaaggaattttttgttttttaatgattgaaacattttgaatcaggtgaaaagtaactgttttctctccccaatttttcgctaccttgagagtgtgtgtgataacttccatatggtttttgccacccctccccttctcctaaatgcttttatgattccagtaaaatggtctcccgggtcacccccgaccttctgatcgccttcactggcttttcctcagggtttctcagctccctgcatctcctcatcacagagaaaacttctcctggcccataacttgtttttgatggtttgttgtttgccccgtttgtgtccctactccgccagttaatcctgcacactgacttttccagcccccactctcggtgcctacacgaccaggttcaaacaagtcagccccagcgtcccagtcctgcctgtgtttcgagatttgcctcccgttactgcccccagcctgctgctcctctctccttgcacgatctgcgcctcgtccccagacaagctttaccacttcccagttctctttcttcattccagcagaagcctggaaggtgtgtatgaggaaggcatgaagctaggccctctgaggaactcacacgcgcgcacctcatgaaggccacctggaggtcacgtggtgtgggggcaaggtcacagaccacgaggctcaacaacaacagtgctttgcctgtcaccactgctttctagttatgtgaccttcaattacttcacctcttggttccttggtgtccttgtctataaattggacataattcacttcttagtgaggttcattatgatgatgattaaatgaggtaaagtgcccagcagacgccgggcacataggacatatgcaaaaattggtagttccctttctaacccagcgtccatcctcagggaactcatcattttctagcaggcatgatattctaggtgacgtgagtgctgtaaacaagaacgctgggagttcagagaaagagcacagaatagtgcctgggctgaccgtggaagatagcgtatcaagaaaagatggataggagtttcctaaggagtgaaaactatgactaaggtacaggcatggaaaacaagcagggagagagagtccccactttctctgtgtcctaggggaggcttccttgccaccatccttaaaattgcagccccccgggaagtcccatcacagcccgtgcccctcccctgcttgatgactttcctgcttcactcaccaccgtatcatgtacttatttctcttctgtgtcctcacaagatcagaggggtatgtgtgtgtgtgtgtgtggtgtacgtagtggatgtgggtatggtgtgtgggggggtatggtgtgcgtgtgtggtgtgtgtggtgtgtcgtgtgggtgtggcgtgtgtgtggtggtgtggtgaggtgtgtatgtgtggtgtgtgtatgtgcagtgggtgtggcagggtgtgtgtggtgtgtgtgtgggtgtgatgtgtgtggtgtgggtacggtgtgtgcgtggtgtgggtatgtgtagcatgggtatagtgtgtggtgtgtgtgtgtggtgtgggtgtgtgtaggtgcgtgtgtggtggggtgagtatggatgtgtttggggtgtttatggtgggtgtgtgtgtgtgtgtggtggggtgagtatggatgtggtgtgtggggggtgtgtgtgcatggtgtgtggtggggtgtgtgtgtggtggggtgagtatggatgtgtgtggggtgtgtgtgtgtggtgtgtgtggggtgtgtgtgtggtgtgtggtggggtgtgtgtggtggggtgagtatggatgtgtgtggggggtgtgtgtgtggtgtgcggtggggggtatatgtgtgtggtgggtgtgtggtggggtgagtatggatgtgtgtgggtgtgtgtgtgtgtgtggtgtgctgtggggtgtgtgcgtgtggtagggtatggatgtgtggggtgtgtgtgtggtggggtgagtatggacgtgtgtgggggggtgtggtgtgtggtggggtgtgtgtgtttgtgtgtggtggggtatgtatggatatggtgtgtggggagtgtgtggtggggtgtgtgtgtgtgtcctcttcactgcgtatcccccttacttatggagtgcacaccattagatgtgcaggtgaactcagctctctgacttaaggttacatgacttggaagtccaagaagttctggcagatagaggtagaaaatgaagttggaaatcatgagggccattaaatgacaaatttggggttttttattttactgagtagagattctaatcatctcatttttaacagggaaagtgtgctctaggaaaatctagccgacacagggagggcaacgatgaatttgagaaggaggagatgggaagacaagaatggattgtggtagtccaggccccaggcaaagaaagcctacactggatggtagacacagaaataaataggaagggacagcaaacattccagcagagttacctaaacatgactgttttcaatgtcaataaaagactggaaaacatatcacagtagagtcactggaaggaataccaggcagctatccaagagaatgcagtgaacgtatgtattctaaatctactgataggcaaaagtagccaaatgccaagtgaacatgccatgtgaatccatttgtataaatatgtacataaatgtaaatatgttgatatgctgtattaaacttatccaggccatgtgcggtggctcacgcctgtaatcccagcactttgggaggccgaggtgggcagatcacttgaggtcaggagttcgagaccagcctggccaacatggtgaaaccccatctctgctaaaaaaaaaaaaaaatacaaaaattagcagggcgaggtggcacatgcctgtaatcccagccactcagaaggcaggagaatcacttgaacccaggaggcagaggttgcagtgagccaagattgcgccactgcactccagcctgggtgacagagcaagattccgtctcaaaaaaaaaaaaaaaaaaaaaaaaaaaaacacttatctggaacaatacacatcagacttaatgtggtatttgggaatggcatttaggaaggtacccactgatctttactattaggctgcacaattctgtgctatatggttattttcctataagcatgtattattatataaaagaatataagtgacccaagttaaatgtatcttggaaacattaagaatatactttgaaccattgcaattttttaagtctgtcacctaaaatctcttgacatgaaatatgtaaacatcaaaatctgactgcagtttaccttttgactaaaaatctggtaagttgaccctttatttaagaacagtaataatgcaagtgaatttgggaaggcatgatccaaaatcaaaggccctcttattcaagaacagaaccactgtcatactcagttttacccaggagccagaaagcatcagtccttaccctgcaatctctggagaaggttacagtttaaaagcgtgggtattcttcacacaaacacacacacatctttatttcatagtttatagccatttaaaagtacggttgtgatgaccacagtgataaaaatgaaattaataataaatctgtcattaaaagtatattgctttgaagaaagctatttatagtagtactttttaaaaatgagtttctgaagaaacagtacaaataaaaaattgtctgagcctgaatcactctattttattgtgtgtttcggtcaaaaagactttgtatgttattttatttaagggaaatataattctttgcaattattatagataacactgatatcttaactttaccattatctttaatactttcccaggtgccagttcaacagattctgacagtgaaagtttagctttcaaatcaagagctggagctatgccacagtaagtgcctacaattccatcgattatgtggaaacaaagaatggcaacagaatggttggggtatgaaaccatgtttgctgtgctttgaagaaaaaagtcaactgatgttaatcagagatcaaatactgaggttggaacacaatttttttttttttttttttttttgagacagggtctcactctgtcacccaggttgaagtacggtggtgcgacatggctcactgaagccttgacctcccaggctcaagtggtcctcctactttagcctcccaagtagctgggattataggcatacaccaccacacctggctaatctttttttattttttggtagagatggggtctcactgtgttgtccaggctcatctggaactcttggactcaagcgatcctcctgcctcagcttcccaaattgttgggagggattataggcatgagccaacatgtccagcccgaacacaatttttaacttgtaaatttgaactttgaagtctgcatttcatcattgatatgccagaattttaccatatgcaatgttagtttcaaagacagccatctaatttattataaatgtatggaaagagaagtcacattaagagaaaatcaattaaatcattactaaaatgtgaggaccaatttatttatgcaagttggaaaatatctaattaggccagaagtaggttctcctttggatacgatctatatttatttagatcttgtacccgaaattcacaaaacttagttattcctacaaagacataccaattattaaaatgttaatatcttaattatttggcaaaaataaaatctaccagaaattcctattatggaaaagtccataaatattgagtctgttctaataaatttcttttatctgctagtatgtacataaaaattatatccattcagcatcaaataatcagtgatgcttaaaggatcttctaaggttattttaccacccctggtttttataaggagctcaagtttagtgaagttacatggcttgcttcagatttcacagccagctacttgacaaagctgggcctagaaatcaactcttcttaatcttctctaaatatctcactaacttatatgcactaagaaaacacaaaaattccaagataccgacaacaaaattagaaaccagaaaaaagaacagctgttagacttaaaatagacaaccaaaactttgagttaaatataggaccctaaccctaaacatttcaaatctctgcttatcaataaagattggattttttccaaatattttctcttaggattttcaagtttaatacgttagcatcttcaacagcgtctcagttacatctagctacttttcttttactcatgttttgattttgcttaatgtctataaggtacattctataaggtacatgtatatactgaccacagctattctagctgtaggttatgcattcccattgtggaagcaattacagttgaagcggattgcgtatacaaaaagaaacccagcttttctgttgaaacgtttcaaggaattatttctgctaaaaaaaaaaaacaaaaaaacgaaaacaaaaaatattctgactaaacactcaccttcctattttccagagctcaaaagaaaacaacttctgtttccttgacaataggatcatcatctccaaagacaggggtgaccacagctgtgattcaaccactgtctgtccctgtgcaacaggtaagtatgctttgagccagagcccataaggggtcgaactcatcagcaaacttgtggattttaagaatatgactttgattctaactagtatactcccttgaaatattttctaagtggacacaaaattcagagcaaagaaaattgtaggtaatgtttctcctttcagttcactaaaaacaacctttaaccaaaaccacactgccaattagtcaacatttgcatttccattgggaacttctttctctaacagctaataatctgataaactggtgtctgttttagctgtaactatttgattattccctcacatgtgtatgctctttcatatagccaaatttattagctcattacaaattaaaagacaagtctgcataccaacaaaaagctttcccactcctaaaagctaaacaaataagaaaaaacaactcaaattccttgacttcaccatgctttttgatcttgcttttattttattgtaagactgctatagccatgaaagaacaataatataaactactggaaagtagttgtaatgaatttactttgcaaacacaaacaatatgaacttcttttaaaaaaaaaagtagaaaaccattacatctggatgtctctaaatcatggtttaatgaatatgttcaaagacaacactcacagaaaggttttcccccacagtctggaaatgtaaactcattcctaagtaatgagtatgtcttataagtatcaccatgtcctccctcagcctttattacctattgaatgctcaggggtgtttcagccactatagaggccaataggtgctatcgatatgtggaaaatacaaacagtagagagaagacatttgggtccataaacttgaatcaacaagtatcagttactcagagatggcatatatagtacatatttcctttaaaccccttaatcagagtggaatttatagaaatatttgattaaatcagtgggcattttttggtatttgatgtttaaatattgataaatatttattgagtgcttagtacggtgctaggcatttcatgacaggaaaaaatgtcacccaccccattcccaaatggggtgaatgtgacagaatgtatttagatgtaagacagaagcctaggaaatagagagatacacacacatctagatatgtaaataccataataatgtaaagagtgaatttttaaatggattaaattctacaaagacatggaatggaaggtaatttaccccatgtttatagttgggagaatgaagcacccagagaaactccatcgctttattattgcaggcaatgtgacatcaagtaatgctctggaaccagactccctgggtttgaatcccagttctatcacttcctaacggagggaccttaagcaaataaaatgtaacccttcaagccgagtttcttcatctgtaaaatgaagatgataacactatgtatctcataagtttgtcctgaagatccagtgagttaatcttcatatgacacttggaacagtccctggcatagagtaaatattaatactataagagtgttcacatattcttgggacataaaaagacagtgaaaagtgaaacccagacctcttgaatcacaggccagtaaagtcttccagggttaatgaataaactccattagcatcctagcatctctaccgctctgccacaattcttcatgatgtcctgtggcatatttagacacacgataccagatcaccatcatcttgggttaagaagctaacaaccacttacataagtgaataaatccagatcatttaaaaataagtgatagtacacaaagaaatattttccattcactactctgaaatccttatatttctccagagatgaatgtcattgaataggtattttagcacgtttcttttttgcacgtcaataaaaaaaaattcttttctctcctttcccataatccctatatcaaaaaagagtacaagttaaataagataggtagatgtttgataatttaccctccagtgccaatagccaatggcttttatgcattgaatccaaactgtatttaaaaataaaatacattgtctacgagaactttaaaaaagacgcatgtggaagtcccacacacagaaatccatttggtaatagcatttaaaagctcgtggatccccaaggacccagggaacttttaccttgaatatccttttgaacagagaagagtaacagatgtgaaatgaggaagtggaacaatgtctgtactgtaagagcagacgagcaaaatgatgtatggtggtactttcattcactcatttccttcaagtgggtgatccccataatgaaaggtttcttcagcccatcttttaggcaatttatatatttagaatttgatccatatgtctctgcttttgcaggttcacagtccaacttcatatctctgccgacctgatggaaccactactgcctactttcctcctgtttttacaaaggtctgacatctggaagtctcattctctgtgtttgctttggtccttaaatttcatttacatgtggcttcgtgtagcaatctttaaaaattaaaaggaacagattagtaggctgattaccatggttacctttgggactaaatagatatttgttgaacgactgccgtgtgactgtaatcttgtgatgggttctgagagatgtgagcaggaacttgatagagcctaaaatctagtgggaaagccaagacagatagaaaaaaaaaaaaaaaaaaaaaaaaacctgctgtgtaggaaattgcttaggagatctagcaagttttatagaaattcagaaaaactgactaattttccatttgtcctgagtccggaatttgcattgccaggctgaatgacatccatttcattggtcagcctctcaagtcagaaatgcttccatatagcatttcttctctttctttttcctttttccttccttttttttagagaaaattataaaactttattaaaagacattttaaaaggcccaaataaatggagacatatgacatgcttgcagactaatagaccgtataaagccatgactccctgattaatctgtatttaatgtaatctggctaaaattctagcagcttcctgggtttttttgttttggtttggtttgttttttttactttaaattctgggatacacgtgcagaatgtgctggtttgttatgtaggtatacacgtgccatggtggtttgctgcacctatcaacccgtcatctaggttttaagccctgcatgcattaggtatttgtcctaatgctatccctccccttgtcccccacctcccgacaggccccaggtgtgtgatgttcccctcccggtgtccatgtgttctcattgttcaactcccacttataagtaagaacattcagtgtttggttttctgttcctgtgttagtttgctgagaatgatggtttccagcttcatccatgtccctgcaaaggacatgaattcattcttttttatgcctgcatagtattccatagtgtatatgagccacatttaaaaatatggaacgcttcacgaatttgcatgtcatccttgtgcagaggtcatgctaatcttctctgtatcatctcgatcttagtatatatgagctgccaaagcaagcacaggttcctggtttttaattgtttgtttgatatggaatttagcaacctgattcaaaaagttgtgtggaggaaaaaagtggctaagaatagccaggatacacctgaggaaggaaaataaggtagtgttaggaaggagtgggatttgtcctataagatagcaagacgttttaaaggtatagtaattaggacagtatggtactggtacaaggctagagaaattgatgtgtaatcggagtagagcccacaaagtttctgaatacctacagaaacttgcaaattgctggagaaagaatgaattcttcagcagaggtgaaaaagtatccagttggactcctacctcatacttttcacgacaaacaattcctagtaaactaaagacaaatgtgaaagcaaatctataaaacttttgtgaggcagtaaagaaaagcatttttgtaatctccatagaaggagtgattttttttcccttcagctggttgaatccaagctttataaaatatcttttcataagcagttatagtatttccagttgggcacaggcaacaaatgataacaggtggtaacaacttggaaactaccctcctagctagactactaaaaaagaagttatgtaaaaccctgcctaaaaccatgtcaatctgataaccaatgaagtcttcctttgatgtttagaacagaaaatgtttacagaggggtggacactccacatttaggatgtagtttaagagttttgcacaagcagcttcccaaggtcatcaccagaaagggtgtgttgtccaatgtattggtatccaagacacagttgatttgggggtgccagggcccaacacgcctcttggtttaaacaaataaagtccatgctggtggcacaagggaaggaaaagaggaagcaaagatttgctttctttcactaccgggctttcctgcatgggtctggcatgtgtagatattatggaattcctcctgggcaccaagaggaactctcaaatactaagtacaaaatcctgtttcctcccttgcaatccagctcccgcaacatagactttctattagtggtctttcccccttccccaaaagataaccatgaagcattctttgtgctaacagcacagctttaaagagaagtaaaccaaaactctgttctttatataggttgatttttaagaactctcaaactgtcaattcactggaagctcagagccactgaaagctcagagccactagaagctcagagccactggaagctcagagccacttctccagccttccactttctgtgtctggaccatggaacatctctcttctgcagggctgttcccttccttgatgcatctgcttttccctttctcactttaggcagcttctgtctctgatttgcagggtccttcttaggcctggtctctggttttggaggggtaggtttagaaaataatcctgctgatctcctctgtaactcaaactagcctttactttgtcactcatagcaccttcactgggctttctcttaggcatgatgatgacagtgaatggcaggtgggctggctttcatagtccaagggttacctccatctgttttctcatgctactctggaagagattcctaggtctcacagctggtcagaggcagagccagtgctcctgcctgcaggccacctggcagactggtggaccacaggactgtgggtagcatggacgtacatgtgacatttcttcccaaatagacccctccaaagaatcacaatgtcaggtggacttgatggtatggccagaggggtccttgtaaggatcctgaaacccccagggcccccagatcctacacaaagtagatgatccaggttgccaggtgcatcctgtaaaggttgactttcagtctcctttggggctccttgttatgttcccgaaggttctcctaatggcttactatgtttagccatggcttttgccaagataaaaatgttagctccaggaggatccaaatggcaatcctggaataactgtggagctttgactgattaagttacttggcatctacccatttcctacatctttgactttccgacactgaaaaaaaaaaatgcataatcttaggaataaatcaaagtctcttttggtgcctcaaagctgaagcatgaaaaatattttggtgccatttgtagtctatcctgaacagcttcctggacaagcctagagacatttaataggttaatccgtagaagctggaccccataagtgacacttaccctgttttgatctaataaattagctattctatggacccagtcacaaaggaagaaaaatatgatttaaaaccagagattttctccatttaaaaatacggaagaagaaagaacgcaatcagaaatagttgatcatctaaaccttgtcacttaaagacattctagttaactaccaaaatgtctatcaaatgtcttctcagacttcacattagacttttatagttcttctgccaatgtcataggttttagaattccctcagggttttagcacacttactgcaggacattggttacagaattggttttttccaggacatcatttattgtcccatcagataatttaaacacacatgcatacaaacaaacaaaacaattcacacttcctaatgaatgtgaatttgtttgcttttggtgtatatatggataaattatgtttgagttattttgagagtcctacaccttacattcgatccaatattctttttttttttttttttttttttttttttttttgagatggagtcttgctctgtcacccaggctgaagtgcaatggtgtgatcttggctcactgcaacctctgcctcctgagttcaagtgattttcctgttccagcctcctcggtagctgggattacaggtgtctgccaccacgaccggctaatttttgtatttttagtagagacaggatttcgccatgttggtcaggctggtctcgaactgctgaccctaggcgacccacccaccttggcctcccaaagagctggaattacagatgtgagccaccacacctggcctagatccaatattctatagtcagaagtttaaatagtaagaaagtttaaaaggccctattgctagttaattctggagaaggagggtagagagaagatatatgtgagggaaatattaatgtcctgatatttaagaacaagtataaaagctttacttctttgtatctataaaaccaaattaatttctgatctgttggattgtaaagatttattggtctggagttggagtgcggtgagggacaacaaaggcaggagcaaagaaggaggaaatgaaggtcaataaggaagaagtacagcatgtttcattactttactcagaatctcaaaatgagaaaatgtagaaaccccttagcttaataaacttgacataggaaactagtcaggcagaggtggtacatgaaaaggctgaggcatgtgaaaacaaatgcatgtcttttttctcttcttgtctggttttcataagaatctacttttatttagagtgtggtcgtttcaagaaattcacattccacctgcttccttttaaatgtagataaagaaagttaacattggttaccatcaaattccataaatgcagagcagtcagtgcaaatttgcagacaggccagaaagctctacaggacttatggtacactttactcattttatgacttggagagggtgaaaagctgataatcggtgggtccaaaggtgtttatccttacctgagtcagtgctaattatttgatgatgcaagttttgcattttgtgtttgtatctgttttgtctgaggtttggaatttttattctgtgttgtgaaattgcttaaaaatgcaccaaagtctgatggggttttccttgaatttccttgaatttcaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaagtaaggagaagtgcccatgtccccaaatctgaccattttattctctccagcttcaagaaaaccaagaagggctaagtcattaagatgaattgatctctatgttcaaagagtggcaggatcagataatctacagtgtgttgaaatccagtaaatggaaactatgacccccttgacactctaatgaaagtcatatattctttcgtcttaaaaaatgcatatatacatttgtactcaaatttgcatgaataattttaggaggtttaccaggctcctagagcccatctatgaactgcagttggaaaaatttcttagtgtaagttgatacaggaatttgagtttttatatttatagaaatataaaccgatctatcactttatatcttttgtatgatggagtttgactgtaacatttcttcagacatgtcctagacaaggtaatggaaaggaacaagtaggttttttttaattaaatggaaccccattctaatactttgttctaatttatttttttcatgtggcaaacagaacctagatctacagctgaacctggtaagaatatttttagggtttttttttttggtggtgggggagcagataatgtatcttttgggtctcaatagttctttctttctaccttaaagccgtaagcagaacaatgtttttgtggctccctggaaatgtgaaacccccttaaaaacaatatcttctttatcatggagtctgtacactgcattttacatcaacgtctttattagcaaaacattaagttccattcagacaagaaggtcaagctcagtgacttcatgctttttaaaatacagtcttttaggctcagaaagcaaactaagctgatgatgaaaaaacatcctcctaaaattccagtagagaaggacaatctactgcctatttgtactgatcagaacccactaacaaccccagcttagaaatgtgtctcaaatgagagcagctcaaagaggtaagcaaaatggacccccaggtgtttctcatttgtgtgccctgagccataaacttttactattctgcaagcatgaagaaagtcatcttgcccccagatcactcttaattatcaggtcgtttgaccagatcacagtgctatgtgatccaggagcctcgggcctagctgttccctgcctcagacatattgcgtatttatggttcctcgtggagtgaaatagtgtttgtaaaggaaacaaatttttgtctaggtacttcatcgtatgtcctcctcaagactattttcttttgtatttttcccatcagcagggtcacaatttcacttatttctgaacaaagggtagaaaaacaagtcattttcctgtttctcctgtttgttcctctgcttcagtgtcaagcagatcttgccacatgtgtcttaggagccatgaccttgctctgactcttcttgggggaactggaaagtcctctgtgggccactgcaggtcagattactgcagtcagtccctgaacttctcacatctgtgtactggatctttaaaagcagagtttgaccctattaggatccaacgtttaagggaggctgagtagcatccttagggaacaactggaattgatctgctgccctcctgtcatgaattataagcagagcaagtccccccacttaatgtgtcagtcatcacatcaaatactgtagtcactttccagactgtggaaatatacaactgcatattttgtctgtgaaatgtcattgaataaaattgcataatgctacttttctaatacatggattttctgagattaaatctgctgcatgagctaatatgggaatcctgtagggagttagggcacatcttgtgcatttgctattttaaacaactttagataggtagatataaaagtaggaaccaaatatcttttatctacaagaaatagctttttatgtgaaacaaacctataaagcaatttatgtcttttaatgctttgtgtataaataaggctaaaattttgagccaaaaattgtaaaaatgttactgctagcatgaaataaggcagcttttgacattgcgttttggattcggagtgaactcctgcaactctcttttcatcgtgttgttatacgttgtcatcatgcacataggtgatgatgatttatcaaatgtaggttggaaaatcacaaacagtcatctgcaaagtcaaaacattagttagaaactgcacagcttagttttcagtatgtgtatatttgaaaagggaaaacactcagaatatgctagctaaggaagaataaatttggatgaggagggaggaaggaaacatctcccccgcaccctgcgtcttcatcacttatcctacatacgctccttctgtttcagatctcccccgcgccctgcatcttcatcacttaccctacatacactccttctgtttcacatctaccctgcgccctgcgtcttcatcacttatcctacatacactccttctgtttcagatctcccctgcgccctgcatcttcatcacttaccctacatacactccttctgtttcacatctaccctgcgccctgtgtccttatcacttaccctatatacactccttctgtttcagttagtttgttgctttgcttctaaactatagttttgattgtgaattatttaataaaattagtcctaaacagcttcatggaatcacctgacctctagaacgtacttaaatgccatttgctttaatgtagcaaaatcatgcagaaaagagcaagatatggaaggccttccttttaaatcccttgtcctagcaatgcagaaaaatgtttcctctttgtgttcactgaattttcttatttacatagttagatctgaaagcgtttaagaaaacagattccttcattccaactacaataatagcattttctgaaaaatttctcctggcagagaaatatttctagcaaatctgtcaatacaccaaaaaatattatatagtcaggagctattaaaaactaacacaatgagttttcctgacctacgatgatttctccacaattgtttttaccatgacacgacgagactttcttctttcccttttacagcgttaaaatgctgtgcttcaggaaatcagccgttggcatgcagcattaaataaaatccatgatcatgttttttaaacaaaaaaaacccttaaacacatgaatgaccacgcaagtgactaattatatgagttgttgtgagtaagaacttcagaacaagcaaatgttacagtgtatttgtgcttaaacaatgttttgtcatgcctgtcaaaactaggtatgattcttttactagttgccaagtgttttccttacattgaccttgaagttgctatgtcagaggaaaaaacaaaaaataaatatgactgtttaccttctttaaatgacctgattgactgttatatctaatggacctctgagctattaaactatatagaagtatgtaggaaccggcttccctaaaaactgttttcttagccattgttaagtggaaggaagaaaaacagacgtgactacaatacatctgaggcaagagataaattttataggactaggtcagtgatattttccaaatgctaaaacataaatagcctttgaaattcaggaaaacatttaagcattctgtttttattactgtctcttcctaccctcttcctttcctctgagagagtcactcttgctcgctctctccccctcctctctgtctctttctctcccctcacctccttcattccctgcctctcttcctctttctccatctcactccctcattctttttatttattttttctttactcttctctttactctcttctctttactctcttccttattcatgggcaagatgttttaaagctccagaaataaagttgaaattccctagtacctagatatagccccattaggaattagatatttagataaagaaggaaatagcaggttgtctccaaatggatctgtgcaactgaaacaggtttttcttgtcactgctgcgtcgtatctgtctgatgtgttttacactcccctctctgtctagacagaagtcagcttgcatcacaaatcttttcagactgttttgtgaattaatagctagtcagcttacttaagaccaacatccgtttgtcatagtaccttctctggccttctttgaaattctgactttgtactgatagactccttcaaagactagtctgggggtgggggacacagaagactcatttgacagctgttaatactcagtctcttactcactcagctgtctggaaacagccacaaactgtgttgagttacttctatagcactgtctaatagcgtgcaaaattaaaaacacaaaaacgcgtcttactggttgtggaattatacatataaaagtatattgcctcctgctttcaattttaatttctgctcaccagtgtgacccatgctagatcttgtacggtagagtctaggctttgattctctgattcaaaatataaagtaagttacacttagttaaatgtactaaggtgctgttgtaggagggcaatgatagggatgtttcttgagatcccagtagattgtatgcagtaaaaacttaatgcatgttctaggttaggacggtgggttgaacaaaagtaggccatatgaaacttatagttcaccaagagtgtgacaggatgccctggggtgccacaccacgctgacagggatgctgtaatatatttgaaatttttttatgcaaacacattcaaacttgacatttgacagatatgacacaatgactggcttgaactagttcagaatttcaacattagatcaccctccattcttttctatgacataatctctttgtgaaactgagtttttgatgagtgtgtgataaaaagtaagtacctcatgaaaatccatgtaaaacatgaaatgaggctggctcatccaatctgattccaagagaggtggtacagtgcccagcagatgcacacagccattagtaagaaatagtggttatttaagaataaaataatagtatttttctttcaatttatatgtatttttaaacactaaattgtttaggcataaacacttattaagttctttggaaataactacataacaaacataactattagttatgtcttttggcttaggagcaccatttaaaaagtattgagaaacttagagtcccatgaaccaagaaagtttgttttactctctagaggaggagtgtccaatcttttgaattccctgggccacactggaagaagaattacctggggtcacatataaaatacactaacactaatcatagcttttgagcttaaaaaaaaaatctcataatgttttaggaaagtttatgaatttatgttgggccacattcaaagctgtcctgggccacatgtggctcagaggccacgggttggacaagcttgctctagagggagagggggaagactcaagacacatttgagtacacagcaaaaagaaaattgagtgggttttgaaattcttaatgccaaatgtgcctatttccagtcctcttccaggactcacattccagcctgctggcctatgaactttacctctctcagcagagactgaaggactcttctctgggcaatttaaacatcccgagagaaaaaataaatccaaagataatgatttgggagtttctcttataaagatgccacttagattgtgctatagggaaggccaaagtggataagttcctctcttatactcagagcttaataaactcccatccctgtcagacaagcagagagaaaaggcatctggagaaaacctctagcatgaatgatatagaaaaaaacaagtgaccttcctaaaagggaactttgagaaaatgggtttgcaaagagaggaaaatgtaaaacaaaaacaaacaaacaaaatctctcttaaaggatccaaggaaatcattccacccaagaaataaaaatgaaaagctagaaaaaaaaaagagaggggaggacacttgtaaaacagagttcttgaaatgaaaagttcatagcagaaataaaacgagcagatgtcccacaaagtacagcaaaatgacgaagaagggatgtaagagagaaaaggcaacaaagttagagatgcatagctgaataactgggattccagaaggagagaagaaagaagcggcgagagacaggattatcaatgaaataatttttttaaagttccccaaactgaaagttatcaattgccagatggaaaaatccactgattgcacaacatatggaataaacccagacccaggcacgtcatcatgaaattcagaatttccaggacaaggagatcatgttataagtgtcctgggagaaaacatcaggttatatatacaaactagcaagatgcaaatagcttaggccttctcagcagtcacactagacacaacgagacaatgaagcaagaacttcaaaattgtgaaaaaagttacctacaacttggaattctgcccctaggcaaaacttcacatggaaatctagcaaagatattttcagacttgtaagatcccccaaattttcctctggaacccgacagtgtgctccaccacagcaagagaattaatccagaaaggacaagatgtagaggtggggtacaggaagcaggagatcacatagaagcaagaggcaaagggcatccccaggagggtgacagctgtgcatcaggaatgaagggcaagttcagattgaagcctcgtgtctcgagggacaaatgcaatgaggctttcatcattaggaggttcattgcctctggtccagcccgtcttttatttggatgacagaatggcagggcggtaagcctgacccagaaatctcatgtctacttgggctgtcctgctctcccctccatggactgtcacctggatcagctgggaacactcatcttacccccacagaagcgttctgctttggtcagtcctgacatctagaagtcggccatgttgagtttaattaacccatctatgcctgaggttgcaattttttgaatttttgcaatcagaccttgacgatgaccttgagcagtaggatataagtaactcccaaatgcttagcattccaataatggaacactaggcataaatgggtaaaaagcagaaaataccagcaatctcattgctggatatatacccaaaagaaaggaagtcagtatatcaaatagatatctgcactcccatgtttgttgcagcactattcacaatagttaagatttggaagcaacctaagtatccatcaacagatgcatggctaaaggaaatgtggtacatatactcgatggagtactattcagccataagaaggaatgagatcctatcatttgcaacaacatggatggaactggagctcattatgttaagtgaaataaggcagacacagaaagacaaacatcacatgttcttacttatttgtgtgatctaaaaatcgaaacagtagaaggatggctaccagaggctgggaggggtattgagaggctgtggggggagatgcagatggttaattggtacaaaaatatagttagaaagaaagaataagacctagtatttgatagcacaacagggtgactgtagtcaataagaaattaattgtacattttaaaataactataagagtgtaattggattgtttaattggagtataattggattgaataactaaaagaataaatattataggggacagataccctgttctccatgatgtgattatttcacactgcatgcccttatcaaaacatgtcatgtacccagtaaatatatatacttcctatgtaaccacaattttttttaatttaaagaaacaaaatatggagataccatctccagcaacaactatattcctgctggatgcccacatgaggccccaccagactgctccaccgagtgagccttatatttcccagattcactcaagaccttacccactgagtgccccgtggggcttttggaaactttcaaggacgttgaatctagttgatggcccaagatggttcttgggatctttttcctaacagtgacaaggttactttttctttagtcagccaagatttgtgctcactacttaatttttttaaactaaagaatgcattttttaaggatacatacatatatggtaaacacataaagaaaatcgaaggaattattatctcaaaggagaaggaaaattaaattggggagagcctatgaggtatttctaaagcactgggaatgttttatttcatagacttgaggatagatacacaggggttcatttcactgttattcgttaaatggtacattttaaatatccttctttatatatgatattaaatacaattgacaatttaaaaaaatcctttgcaatttttttcttttctgagacagagtcttgatctgttgcccaggctgcagtgcagtggcatgatcttggttcactgcaacctctgccttccaggttcaagtgattctcctgccttagcctcccaagtagctggaattacaggcatccaccaccacgcccagctaatctttgtatttttagtagagatgggattttgccatgttggccaggctggtctcgagctgctgacctcaggtgatccaccagcctcagcctcccaaagtgctaggattacaggcgtgagttactgcacccagcctcctgtgcaaatattgatacaagcattacatttacccacactggatttcatcttgttgattttagctcagagttcttttttaccaactgtgttagccaaaccatgtggtgtgaaaggtaaaagctggatttcttttttagggacttgggacaaaaaaaaaaaaaacagttgcaaaggaagccatttatgaaaatgtccccttattacccagggaacccagtaatcttatccttgctgcctcatcattttatgagtttccacaaacaaaatggtttttatttgtatttaaccaagtgttaagtaggtccaggaacttgaatgcaattcaaggttgccttctgggagatattgctgtgattttgtaatttttaggtaactataaagaacagaatttatcaccagtaaaaacagtttctgatttagtaatttattaaatgccctcaaatcaaaaccttaggaaatccaaacatgggaaaattagattaaaatgcatcataattaaggttattaataactttaaatttttccatttatactggagacagtttctttagtacagataagtaagtctctaaatccctttatgtgacataagcagtcattttctgatttccattccttaccaaaatttattttacagatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgcaccagctttatttgattttgtgattgtcttctactgtctgttaaaatctcccactagaggcctgggcaacagagcaagaccctacctttatgagtcaatagatagatagatattatttaattacagttgtgatgatattatttgtgatagatattatttcattacagttgtgatgtctccaaaaaagtttaccatcctaaaattgctttaaggtggtcaaactgattaagtttaataaaaaaagggattctctgagaaagtaatgtttgtggggaaacataagactgagtaggagagtgccaagtactccaggaggagccagggcttagaaacttaccagagcgtggcttcacaaggagctgccccagagcccatgtgcccagtgctcagaaggcaatgatgtgcgaggcacagaaggagcctgacaagaagcagggacctaattatgcagggcttcagagaccatgttaaaattttttattttatcctcaaagtcatggaaggatgggaggatgataaaatttcgttcttattaagagagccctctgatttagaaggggcaactgtatattcatcctcaggttttctgaaaaatggcatgactaaaagaaccacaaagtcgtagaagcatcagaaggaattctttacaagtcatcaagatcatcgatctaaaaccactttatattatccctactgaataaaattgtatcctgtttttaaatgtaggtttcaaggcacagaattatgtctatgtttatagttgaagcatcctcaggcattgaactggcaaggacatttctctcagtgttcccagaacctctgtctttccaggtgtagatgattcaaggttgagagaagtgcttcccagagagcactaagccctgggaagatagtccagggacgtaagccctggttgtctaggcaggaagtgcccaggtgttactgaaagctgagaagccttcaccactcacagcagcatctgcgaagggagaaggaaagtgacttagcactgcctgaagcccactactccaaacctcgtaagaaggggctgttaagcatgtccacattacaagcttatatcctgttccaatgtgtcttatacctcagaggacatattgccctccccttgtgcagatgaataattctcatgaatcatttggataatgagaataattagttttttcagcatcgggaaactccatttcctgacttaaatctttcattaccttactttatgtaagatttcttgtgtcctgaactaggaaaaatgcagaactagagaggctagaaaaaaagaacatcagctctagaaaaaaagaacatcagctctagaaaaaaagaacatgtgctctagaaaaacagaccatcagctgggtgtagtggctcactcctgtaatcccagcactttgggaggctgaggcgggtggatcacctgaggtcaggagttcgagaccagcctgaccaacatggtgaaaccctgtctctactaaaaatacaaaaaaagttagctgggcatggtggtgtgcacctgtaattccagctacttgggaggctgaggcaggagaatcacttgaatctggaaggcggaggttgcagtgagccaagatagcaccattgcactccagcctgggcgacaagtgaaactccatctcaaaaagaaagaaaaaaagaacatgcgtgtcggagatgggacgccaaccttcagcattttggctctagcattaattagccaggaccctgagagaatcactttgaacacccaggattcattgatattgagcctgaagaaatgagggatttgacctaatcaatctcttacagtactgatcttgtatgtccccttctatggctaaccacacttttaactcattctgtaaccatatgcattcaatttaaaatttcccaatcccttgtaactttccagagacatctcactttccaaatgattaatcttttttttaactttgtttttattttatttatttatttattttatttatttatttatttattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtaatctcattgttcagttcccacctatgagtgagaatatgcggtgtttggttttttgttcttgcgatagtttactgagaatgatgatttccaatttcatccatgtccctacaaaggacatgaactcatcattgtttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgatatttccagttctagatccctgaggaatcgccacactgacttccgcaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaacattttctcccattctgtaggttgcctgttcactctgatggtagtttcttttgccgtgcagaagctctttagtttaattagatcccatgtgtcaattttggcttttgttgccattgcttttggtgttttaagacatgaagtccttgcccatgcaggctacagtaaccaaaacagcatggtattggtaccaaaacagatatatggatcaatggaacagaacagagccctcagaaataacgccacatatctacaactatctgatctttgacaaacctgagaaaaacaggcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcatgacataggcatggacaatttttaattatttaaaagatagagaaccatatacctgtttgtaccttaaaaaatttgtatgttgactggacgcggtggctcacgcctgtaatcccagcactttgggaggctgaggcgggtggatcacgaggtgaggagatccagaccatcctggctaacacagtgaaaccccgtctctactaaaaatacaaaaaaattagccgggcgggcgcctgtagtcccagctactgggcaggctgaggcaggagaatggcatgaacccgggaggcggagcttgcagtgagccgagattgcgccactgcacctccagcctgggcgacagcacgagactctgtctcaaaaaaaaaaaaaaaaaaaaaatgtgtatgttgtatttgtattacctattcaaaaaaataaaaatttttaaatggtagagataaatcttaagaataaagaaaaagaagacaattcaggaaactacatttggttctgtttttacagactcaataggaggggttgcaaagctatcaagacaagtgggagaaaaagaccaaaaagatcctgtctttgtgattataggatcattatagtagatcaaatatttggtcaattttttaaaatactgcataatgaactagaattttaatttcagaagtttgaaataaacttttaatttttaattgcctaaaaattttaattctatattatatttcctacttacatcttatatttcaaaaaatttttgccaaagaaagtttctggcaaacatttttgcttgcaggtgacttaactgcgtttttaagacagcacaattttgaaggaaagagagaaggagggcttaaaaaactataccattgtcatgtgggcattaagagtgtaagcttttggagttggaatagacctgatgattttctcattcaagtttaattcatgtaaaagatgtgtctcaaccccttgataagattacaggaaactcaaaggcaggaaccattaattatctccatatctgcagctataaaatattaagacagtgtactcttaaaaatgcttaacaagtgggtagatgactataaaagcttctaggagctgttcatggatggagattccagactttatctcaaaaaattttctcgacatcttaaaacctttccttaacaagtctttccattcatttaacccaccttctgctctcttgctgcaattaggaaccgtttgttcttattgttcttcaagaaagatgtagaatgtttgagcaacttcttcctgattttaatgtctttgcatttatgatacccatcacagtgttttacttaaattagcatttttggctttctttttttcttttgagacagagtttcacttttgttgcccaggctggagtgcagtggcccgatcttggctcactgcaacctctgcctcccgggttcaagcaattctcctgcctcagcctctcaagtagctgggattacaggcacctgccaccatgcctggctaatttttttgtgtgtgtttttaggagagatggggtttcaccatgttgcccaggttggtcttgaactcctgacctcaagtgatccgcctgcctcggcctcccaaagtgctgggattacaggcatgagccactgcgcctggccttaaattaccataaatggatgaatacttaatatagatttcattgccctttactttttttattatggttaaagaaacatataacatgaaatctaccttcttaaatttttaagtatacactacagtattgttaactgtatgcttaatgttgtgcagcagatgtctagaacgttttcatcttgcatgagtgaaactatgcccactgaacagcaactgccattcctccttgcccccaatgcttggcagccagcattcgaccttctgcttctaagagtatgactagtttagatacctcttaagtggaattttgcagtatttctcctactgtcattgccctttacttttacctcaactaaataatttagattcaatgtagaacacaaaattaataatagaacataaagaataaactaagtttttcacaccccattcaaacatcaaattgaataatatgctgaaagaataaggtgtgtgtttttacaactcttgcaattttaaacctgtattaatatatcttagaaatgagttgaccttgagctacactacaatgctaaactctcagaagcttataatcaccgtagtcctcagatctttcctaaggaacgtaacattttgacacagaagaatccttgcattttagcttttaacaaaatctcaagcagtctgttaaccagattaccatcagcatcatcagaaatggggaaaaggaaaggctttggtgggtggggcagggggttgataaaacctaagaatggagtgagaaatcgagtaaaactcaatgatgcctataggccatattacttggtaatacaaaaaaatagatatatatatttgacccaataacacgacatcaaaaactatatagtttgataatacttggacaaattttgaaatgatagatacatgaatttttttctagaatcaaatacaacaaactctgcatttgcctttgaagagtgagattattaaggggtattaggtatataaagggaattcgattataaagagaaacatttacactttattttatacttagtgtttaatttatttacttttgcacttattaatttgatgtataggtaaaaaattaaaatatttaaagctctcttcaatagacaaaaatgttttttttaaacatatcacttttacctacagttagtacttcttttgtttcagggtttaaaacataaaatgttttgaaacagatttgctgattttcattattgatggtctgaaacgtttgctcttagaaggatgttagtgaaggaggtttatcttatcaaattctatgagttagctactgcaatacagtagagcaccccaaaatttagttgcttaaagcagcaaccataattcggtgggtgaactatttggcttgacctcagctgggtggtttttgtggtctgtgccaggctaggctgaccacagctgggctgtctcagtgcggccatggtcagctgccaggatgacgaggaacgagtcagttagtctaggatggtctcttttggaagggcttatgtctgctccatatggtctcttcctcctacaggttagcacagccttgttcacctaagggttcatcagggttccaagagatggagcagaaacaggccaggcctctcaaggatttggctcagaattggccaacaacatcactttcaccacattctaggctaaagcaactcacagggccagcccaggttcaacggatggggaaatagactctgccactttatgaaggtgttgcagaggcacattaaaaagaggcatgtctacaaaggaaggaataattgcagccattattactaagaaatgtacaatacacggtcttatgctacccccaaaatttgtgaataaccaatagaatcactttgtgggaacccgaaatatatcacttttcttaacgtttgcccacataattatctttatactggtacaatataagcaattattcaactagtaaaactaattaatactctagatatagcttccttttaatgttaacagctaacactggctatgaagcatttgctctgtgccaggcaatgtcctaagcacagtatgtcatatcacaaaagtaggtggtggttagggtttggagtctggaccccagcttgctttgaatccctatgttagtatttattagctgtgtgaccttgggcaagtgaattaaccttattgtgcttccattttctacctataaaatgggctaataataaacttacataactcataagattgacatgatgattagatttaatctatgttaagtgctggtaacaatacctagtgtatagtaagggttatatagctgtcagctcttgttatcgtcatcatcatcatcatcatccccctcacaataaccgtgtggtggttaattttgtgtgtcatgcatgactaatacaaactctgtgaggtagcttctattattgtctccattttacggagaagaacactgaagttcagggagactgaccaaagtcacaaaggcaagatgtggcaggaccctcattcaagccctggcagctgtttcgagtctgggcttttcatgccctacaacactgccatgccacttaacagtaccttccagaatagttgtctacaggtcaaacatatacaggtcatgttcttttttcccccgtggttaacatttcagaagagctttattttccccactgcttggtttgcagctgagcagatataagaggtagctgtatgtacagaaagaactctgacatgcaatcagcttaactcctacatgcaaaatacagagctgcacacttgcagacatctcgttttatcttcacagataacccattgggtatgtattatccccattttatagatgaggacaccgagactgctcttgtccaacatcacaaagaatgggtctacctccaaagctttttctgctaggcagaattgctaaattaaatgtaaagagattctattgtaaacacttttgtaaagtgaatctgtaataatcataacctaatttgtttgttgtggaaaggtggagggtctcacttcttaaaagtgacttcatggttcaactctgatgaatgattctgttctcttcacttccagaggagatttgcaccctagttatcgctgagactttccctgaagatgcagggatctttacatgttcagcaagaaatgattatggatcagcaaccagcactgcccagctggttgtcacctcaggtatgtgaggagtaaaaaaaatgactgggttctgttccccagcaccagtgtggatggccacagcagaaaggcaccgtcctggccaggtgcagtggctcacacctgtaatcccagcactttgggaggccgaggcaggcagatcacttgaggtgaagagttcgagaccagcctggttaacatggtgaaaccctgtctctaccaaaaatacaaaaattagctgagtgtggtggtgcgtgcctgtaatcccagctactctggaggctgaggcaggagaatcacttgaacccagaaggtggatgtggccgtgagccaagatcatcccactgcactccagcctgggtgacagagtcagactccatcaaggaaggaaggaaggaaggaaggaaggaaggaaggaaggaaggaaggaaggaaggaaggaaggaaggaaggaaggaaggaagggagggagggagggagggagggaaggaaggaaggaaggaaggaaggaaggaaggaaggaagggacaaagcgactgtcccaggaagagagctcagctcagccttcaggaatctggccactccaggagtcaccctaacaatctaagttcatcgtgaaacaaaggctttaggggaggggagaagaaggagtgaagtggagatgacaaacaaaaagataatgatcgtgtagcaactgaacacacagggggctttctttaaaatcgtgcagtcttggtcttggaaacgatggagctggtttcctaacatcctcccgctaacctagaatcatattcacattggaaagccacctctgcatcagaggtgcagtcactttctcagcagtgccaacacatgagatctggagatacttgtacaaataagccattgtctgatccactgttgaaacttctgaaaaggtaatacaagataagccttcttgtataaaatgtaatacaagataaaactcagagaagctgtaaaggccttcaaactcaaatttcactgatagtctgtatcaatgatagtatataactaatatgaaaaagaaagcaatgtattgtattattgaagtcaattttcaaaaatatatggatattttctaaactcaaaaacttaccactagggaaggcaatatgaaacagctttttttctttttcttttcttttcttttctttttatttgtctgttttctagttactaatgagcattagcttactttaattgcctcatctctgccattcatcttaaagatatttttaaaatatgtttttgaccaagcctggaacataatgtacatagtagggaatcaataaatgggtcatttgttaaatgatacggacttggagagaacaactgaattgtacttggattccttcagaagagcaagaacttggtgctaggtggcagcagagacacaaccaaaacttatttagggaccttagagtggcaactgtaaatgctttttcatcttcattaagaaaagaaatgggagggtcatcttaagtgggaaatggtttctgtgaatgactactgtaagtgctgaaagaaacctaagtgtcaggatcagagttacagagcaaagaggaccccagcgttttgattccgagttggcttcaacactgtcccatcaaatggccatagcaggagtgcagtgtttaaacaatatggccaaaaccctgggctctataagtctgagtggcaaaaatttgtgtgtaatattttccatttgtttctgcagtaaatctgctataggtcaaacataatcaacaaatattttatttctgagctttttgtttacctcaataagcatttttgagtgcatgccaggagctctgctgggctgtgtgggcaaggtgcagaatctaaaaaagacgtgatctcaagatgctttcagcctattgagggcaacaaataaaaatctctttcgtactgagttatagttggagcaatcacctaatatggaaaaaaatatttttatgagattatgaaattttacttggactccaaggtttaccttccctagctttagatgaatatccacataaaacctttacagcttgagccaatttgagtagtgacagctaggatgttcagtcggacccatggaccaaaacgtgagaggacaaagcattgttggttgatactgtttgtgttgtcactttttttgccaagttctatctttagctcttgtttggaatttttatgattcggtagctgggttccccaaatgtgagctcagtcaggaaatgaaacggtagcactcgttcaaaacaagcttgaaagaaccaggccctccagctggcagtgcttctgcgtcagatgagagcagcacaatcacctcttctttaacaacttcacacaacacagggattctcagaagactctgacagtgtgaaatcacttgttgaactagtggcatcttcttatgtttttcctctctttccccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaaggatgtagccactccctggaggccatggaaaagggggatctactttcagccctttattaaaagcatttcaaaaagtgagtataagtactttgcatttgttactttaaatattaagtatcagtaagaagatctgatatagacaagcggggaaagactaaaaactgaggctggaaattcagggtgcagatcctggcagggcaatgaaactggagggaagcaggcttgtgggcaagaagagcgcccttcacaacacaggctacttggcttggaattccatggagctgcatatttccatgaataccatcttcacagttgatgtccattattttcttaggatgataaaccttgcatgagctgtttccattggcaccgcacagcagagagttgttatgaatggagccattacaatgtcagagagaggcagaaataaattagctcaaagggttctaccatagcgcaagagaccctgaattactgccctgccagaggttagtggaaatgtaagagtcatagtgaatgtgtatgtattctatgaggtcacattcccatgagaatgtatttgccagaacctaggaaagccccttctatttacccatatctgatgtttttgatttggggcaggaagggcttctttaggggttattctttatttccctagcattgactagcctactcttttctctctgtgatcagttcatttgttagaaatgttagaatttaaaagatatttgaattagaataacaccttacctttgtacatcactttattgtttactgagtgatttcatgaacaacattagactaatcaaataacaaaagcagtcaaaagaataccttaagttaagaaatgggctaacaattatataaaaccagacttctggacaatcttgggttgcagtttcaaaaatcgatatattgctaccctctacttaattttgcattgtgttctggctctcttttaagacagtagggctactcactaagcttgtacacaatagtgtgaaaggtgctggtgaacatttaatacctatgcgccatctccattcagaggctgaacaggtataatgagctaaaaaatggtgtccttaaaagagatttatgctcttgtagcagcaacccataaaattaattgccactgctgacttctttcatctttgcattttgaatatgtatttgcagtgcttttaatgaaacaagggacctgctctccagggagagaaagggcaaatgtgttgaatgactaggacttgactgtggtcttgattaagtaaagtctatctactctaatgggtatcataaattggatgtaaatcacaggagagcaaatacgaggagctgttaagaggcatctacagcccgtcttatctcaggagtttcaacagctctgcagcttttagctctgctttgcagccaggttaatgtatatggcaagggggtaatatctacagaatgtagacaaaacaacttcgcgttcattaagaggatgacagcttaagcacaagtttaaagaacatcaggatttgcttgtgagtgagataaaatatgaatatatataaatatataaatataaatataagataaaatataaaataagatgcagaaaaaatggacttaaatgtatgaggcccaaataaataggttactctcccttcatgaggaaatttaagggaaaaagcagaacacctaaccacaaaacccaacagcttagaaacaacatttacttgtactaggttttcccattgttttttttttttttttttttttttttcaaatcttcgtatgtttaaacatattcttagggaatcacttgatttttgttttttcgtgttgcatatttacctgccatttaactaggtagaaaataatatgtgatgatactttttaaatatatatttttaaattttcttatgatttagaatatgttattggattttgttttattacaaaatcagtggatgcttgatgtgacaattcaaacaacacagaggctattaaagtttatactctctgcttcccttcttccaacccagccctctgaaagttgtggtatggtgtattatcagagccttttctaaaaaaggtttttgcagtgttttcaaagttttctttcagtgtttgttcagttttcaaagtgctctttgcttccccatttccacccctctcaaaggtgtgatattctgtattatcacaaccttttctaaaaaatggtttgttcagtgttctcaaagttgtattattgatagagaaatactattgaatgacatctacaaataatgtagaacagcatctgagttattgataatgaatgactataggtaactgccaagtgaaattcttacacattcatttttttcttttcatacattgtgggaaaatatgagattttatttgcctcgtgtggtcagcaatgaaaaactatggtttgctcaaatcttcttttcatcggtttatgatttgattttctttcacaaaaggaaaggcttatatttggtggcgttatggcagtttgtgcatctccatcatttgtaaacaaactaataggaaacaattcggagggcgcaagtaataggaactaaaatatttactctcacaatgaattaatctgaaaatggtgtctgatgtgtcagatgtctgggggaaagaagatcattttcaaaaaaaaaaagaaaactgcattttttttctctcttgaatagctccaatactgattgcgggaaaagaaaaaaaaaattcaagaatgaaacaaaaacctggaagggccatgagctcttttctctaactaggcccagcccccaccctgtactgtccaacagaagtcgtcacctatagactcacagccatcccagacctccagccgagtctgtggtaccgctcataaagtaggggttcctggtccagtctatgatacctctcataaagtaggggttcctggctcagtctgtggtacctctcataaagtgagggttcctggcccagtctgtggtacctctcataaagtgggggttcctggcttagtatcgtggacgcatccacttcagctcctacatctccctttgtttctaacactctccctcaagtgtaagcagaagatagttaaatgtaggccatttggtgagtcccagatgacctgcacacaggatttgtgcaacgccttaccacccgctgtgggactgcgaagtgtgcttaaacgctgcacaagaaaaaattaatagcattatttctgcaactcagtggctgacactcacaatcttcaatcacatcatgaaagaagcaacacaatgcttaagtcataatcttaacaggaggaaaaaggagggaatgagcgtaaacctaacttatacactattcttttccttggttccttgctgccctctcattacaaatgatatttgaagatcaaaataaaggtagggctcactgtgaaaaatctctgcttctctttattcctaccaaaaaaacggtccttcagccagggcgcggtggctcacccctgtaatcccagtactttggaaggccaaggtgggcggatcacgaggtcaggagatcgagaccatcctggctaacacagtgaaaccccatctcttctaaagatacaaaaaattagccgggcgtggtggcaggtgcctgtagtcccagctactcgggaggctgaggcaggagaatggcgtgaacccggagggcggagcctgcagtgagccgagatagcgccactgccctccaccctgggtgacagagcgacactccatctcaaaaaaaaaaaagtcaaaaccatagacatgcatggaatccccctaggaataagctctgaagggaaacctgtgaatggcaaaatgtggtaggcgatttgccaagcatatagaaaggcatggtcatgtttttccactgagctcacctcctacggcagatccaacaatatataaataacaatatgctgttttcaaatcccctttgttacttccttttttatcttcttcctttgtcttgtgggagaaaggtaggactctaagcctgtagacgagcaaaatgagaactccaaagggaggttactgaagggtgatgcgatgggcaagttcttaccctgggacagatcagcagataaaatgatgcttatttgttactctagtgccaaaaatatgtgcattaccgtgaaagtctgtgtccttttgcctgggaaaataataatgaaatgattgttaagtgtttacatgctaaatcaacagctccccttgctcctactcttactacttgctcttaccccagtctctaaagaagaaacagtattatgattttctatcttaaaagagtaaaacgatttcaggctgaatcaaccttttcaaaattactgcattttacaacctttgcttttctcttcctttctctcactcccaccctttgataccctattgttctgcaaatcctgtctccagagaaagacatagcctataaaatcattcatattgagctgttagggattgttagcatcacctcagtccagttctaggctaacaaagtaaagtacatcttaataagcaataataagcactgcacaaaatcaggaaaatatcatttcatgagatgatgtgtttgagagatagaagagaaggaaatagcagcctttatcattctctttattagtgaggttttccatatttggaaattcctgatgggtttcctccacactcctagacacaaattgaagtacaagttgttcccttgcctggaatgttccactccccagaatgttctgcctcttatggctggctcttacttgtctttcaaatctcagcttaatgtcaccacttccctgaccacccagtctaaagcagccacccagccatgttccaataactcatcctcattaattatcgcataccacataattatttccgacagttacttgctttttgttttttttaattgctccctgcctccaatattataatgtagcttcctgagaatgggaaccctgactgtcttatttcattgctctttcactaggaccctagaacagggcctgacaaatagtagatgctcaacgatgttttttgaatgaatgaagcaaaagcagaacaaaaaagaggaaaagaaagatctcccacctttagagcaacccccatttgatctgcctaacgttctttttttgtttttttgtttttttttgagatgaagttttgctttgtcacctaggctggagagcaatggagcaatgatgtgatcttggctcactgcaacctccacatcctgggtgcaagtcattctcctgcctcagcctcccgagtagctgggattacaggcacgtgccaccacccctggctaatttttgtacttttagtagagaccgggtttcaccatattggccaggctggtctcgaactcctgacctcaggtgatgcacccacctcggcctcccaaagtgctgggatatcaggtgtgagccaccatgcctggctgatctgcctttcacctagatataccataggacttctattttcaaaccccatcaactccagagttttcccacattacagtacttttccaactgacatcatttatcttgtaaaccaaatgagtatgaagaattaaataagaatctcatgggatagaattacattagaaaagtttgtccaagttacttaatttgggaacactttcaactccttcctcatttcttctgtgttctcatttgattagcatcttaatttaaaacattatgaaaaatgagacattcggaaggactaggaggacattttcactctctagtacatacttgcaatgtcagttggccacagtgcaatcacactgctatttcaaggtgtgtgtacttgacatgttaacaccccatcagatgccagacttgtggtgaagggccaagagcttctgtgctactcccttcctgtcctgtttatgttggactgcagcttcaactccaacgtgtggctttggcaatagaacttacaaagttgaacattatcccgtccttcaacctctactagttagggttcaagatctcactatattactgtttgacattagtatacaaatggtttcttaggttctgttcttgtataaaccttacctggttgattgaaaagcaaagcaaaataaaaacaaaaaggacaaagacaaggtaagcaaaaacaagttgggacaaaataactaacaaagggtcaaggaaatgtaatcattgaatgtacataaaagtattttaaaatctagcacacttttttttcttaaccaatatttctaattttttacatgtctgcaacctgtagacttaaatcatccgtaatttccatggaatttcatgtatgttcagttagctagccattactttcatttcttttcaacttaaatttgttttttctaggtaatacaatcacacagttaaaagtataaagaaatatatgcactgaaaagtctgcctctcggactcagtaaccagttgtcactgtcttgtgtatcctgccagagattgtttacatgcctatcaagcaaatatatacgtatatataaaatgtgtattttttcttttatttttagacaagtgcctacccaccacatatactgttctgcaccatgccttttctatttagcagtagattttagagatgtttcatgtgagtaattaaaaagtcttatttttaagtgattgtatatatttattgtagaaatgattgataattcctttctctattgttgccaatctaatttttttttttttttttgagacggagtctcgctctgttgcccaggctggagtgcagtggcatgacctcagttctctgcaacctccgcctcctgggttcaagtaattctcctgcctcagcctcctgagtagctggaattatggacgtgtaccacaacacctggctaatttttgtatttttagtagagacggggtttcaccatgttggtcaggctggtctcaaactcccgacctcgtgacccacccgtcttgtcctcccaaagtgctgggattacaggcgtgagccactgctcccagccaccagtctaagtttcaatgacctaagtaattatcaaaagtaatcttctttttttttttttttttttttttgagaaaaattctcgctctgtcacccaggctggagtgcaatgacacaatctcggctcactgcaacctccgcctcctgggttcaagtgattctcctgcctcagcctcccaagtagctggaattacaggcacccgccaccttgcctggctaatttttttgtacttttagtagagacgaggtttcaccatgttggccaggctggtcttgaactcctcacctcaggtgatctgcccgccttggcctcctcaagtgctaggattacaggtgtgagccaccatgcccagccaaaagtattatttaaaaaagtttttcttacttgtattttaggttcggggatacatgtgtacgttagttatatatttgcctgtcacaggggtttggtgtacagataattttgtcacctgggcaataagcatagtacccaatagataatttttctgatcctctccctcctcccgctctccaccctcaagcaggccttggtgtctgctgttcccctcctagtttccatgtgttcttgttgttaagctgtcacttctgagtaagaatatgtggtatttgtttttctgttcctgtgttagtttgcttaggatcatggcctccaactttgtccatgttgctgggaaagacatgatcttgttcctttatatggctgcatagtattccattgtgtatatgtaccacattttctttatccagtctaccattgatgggcattaggttgattccatgtctgtgctgttctgaatagtagaacaccattcatcccctcactgttagttgaacatctgcaaaatgctgggtaatgtggggtgctgaaaacacaaagatgaaagagacaagagcagtacctttgaataatctataacctggttatctctacgatgattttggcaagaacgtgcagatgcatacacatatacacaaaatgctgcacatctttcagcatcatacaaattttgtagaagaatggccaatccctaaattagattcagtgcaacccaaatgccttctcttcccactttaatgtttgaaagatacatcattcagtttttgattctgaagatttaatatgcaccagcttttgtttctggttaagtgattttcattatcctcgaaggctagtcaaataacaaagcaatttagtaatggcaaaagcataaagtgtggaccagaggggtcttcaaaatattagggaagatagagcagaaaaccatttttttcagtttgttgttataaaattatacacacactctgagtcaccaaacacattggaggttgataaggaacataggagtagtcacgggtcctaattctgcagtacgtggctatgcgggtatgaactcttcataaatacaatgtgatgatgactttgcatttgcatttctcttcctcctttctctcactcccagtcttagatacccgattgttccataaatcttgtcttaagagaaaggcatatcctataaactcattcatgtgaaggtatttgcattagcagtgttggtcttggatcactttgcaaacaacccttccctgaaaatgagaagtccaatcaaggagcttcctgaagtataaaacttttttaactaagtaataacatttaggtgcattcatcctcatgattttttaatgtaaatactggctctgacacagtgccacattcttagatattaggctaattgtgctttgctgtgccagtctcttggtgaatgtaatgtttaattacatttccagaagaaagctgagttctatttttatgattaggagttttatttgatgtctgaaatataattggaaatacttgcagataccctatctgtgtttgaagtggcactcaatcatccataagaaataccatatgtccatttcaaatattaggtgttttacatgaaggaatacatgatgataacaatatttcttcaacatatcttcattttacctaagtgcgtaggagagctcttttagtaattacaaagtaaggtgaaaatagtcatccctactgggtagagaccttttattttaaaagggggagtggctaagctcagagataagatggagccacatatgaacaatatgctcatagataaagctatgaatttgatggaaaatatgaacaatatagtgttaagtgaaaatagacaaaatgatatatgtaacttaatgtcaattttatgaaaaaataaaaaataatacactttaaccaactaaaatgtatattatatattagaagaaaatacaccaaagtgtaaccagtggttctttgagtgctggaaatttgggcagattatatcttctcattaactattcctgattttccaactttttgacataatgcttttataattacaaagtattattttaaaataaataggtacttttgatcctttctcttccatcctccttcctccattaaacttcagttcatttgactgttcatcatggatgcttcttgttaaataatagttgcttgctaagtaagcttaattttgagcacattcagaagtggaatgctctggcactgaatgttctcacctcccgtgtgggatctccttctagaaaccaatgaccttcaggattccatctggatttttagaactcttcctaggaatccttccccagaaaatgtcctatattccaaaataactttactcctccacaaacactgttttccaacaacacctgcccccaccaaacaaaactcttatccctttaattgtacatctcaggtgtttaaatgaatatgatatgaataagctatttatgtatatatgtatgtatgtattttcaagccagggtctcactctgccacccaggctggagtgcagtggtctgtcacagctcattgcaaccttgacctccctgggctcaggtgatcctcctgcctcagcctcccaagtagctgggactacaagtgcacaacaccacacccagctattttttttattttttgtagagatggagttttgccattgttgcccagccaggtctcaagcaatctgcctgccttggcctctcaaagtgttgagattatgagacgtgagccaccacacctggccaattttaaagttaaaagtaaaccaaatactttaaagaccaacatttacagtataatccatacaaggccttccacagaaagtaggatgaaaactttaccctcagagacaatggtgaaggagaaaagatgcaatgaaggcaagactaagattccaattcaaataacaataatgtcaggaaagtatgcgatgaaggcatctgctgaaagaggaaagacagttgtggtaactgtgggtaatattacaaagcacgaaaagggtggagaactaagagagagaaagaataccaaaaaaggaatgtgtatatttcctggcaatcaagagaacccatttgaatttcaagagtgtaaacccacattcaattcagtgagcatggtttcatgactttatttcagcaataatgagcactgtgaaggtagaaacaggacatatgtctttggcagtactggcacagtgggatgttatggtatttaattagatgatccttgagaaacattactgagattatcagccaagccgtgtgtaggttcagaaaaggaaacagattcaacaagattaaggcttgaggggaaaagagaaaggaatcaagaaaatggaagttataccaagaatgaaaatggggagtgtcagatgagaaaatatggagagggagcagtggttgtgatcaaagagaggattctgaaagtttaaaaaacttaaactctttccaagtgataaaagaatgtaagatgcatctgttcgagtggatagtttaagtggaagttaaggtcgcaggagcagaggaagtggtcagggaaccatgaagccaggatgttagaaggaacattaacatggatggtggccaacagtgatggcagaaaaccaaatgctaaatagtaaagtcactgagaaaagtgaggaaatgaccaaggttgttggtgacaagcagggaagacagaatgactgtaggtggagtgcaccaacttcaaaagaggaacagatatttcgtagtgatggcaaaactcttctgagagttgccttgggaaacaaggaccctgcagaaccctccttgctcagaaggatactgaggaggctggagacatcatcagggacagccagacttcagttaagacaaagcatttctaaggaaaaggtttgaggaagcagagtttggttagaaacagccaaggaatcccataggcaatagaagagatctagaaaagggattcaagggagaattggagaaggaagatgaggaggaagaaagctatagtgcagagttttgcactacgaacctctggatgctagagcagatacagaaattctgtgtcagcattcctactgtgttgtgctagagcacactactctgtaccatctgatgctgagaagcaaaagcatcgtcctgaggatcacttgctgctatttcatgaagagtgactaagattacttgcagttggaaggaaatagagccatttccaatataattactacttactttttagcctcctatttattttagttacgtggtagcaccatgatccattttgtggttactaacctctaagtacgactttgagttgggcttttttttttttttttttttctggtggagtctcactctgttgccaggctggagtgcagtggtgtgatgtcagctcactgcaacctctgcctgcgaggttcaagcaattctcctgcctcagcctcccgaatagctgggattacaggcacgtgccaccgtgcccagctaatttttttgtatttctagtagagacagggtttcaccacgttgaccaggatggtcttgatctcttgacctcgtgttgaattgggtttttattgaacaagcccaattcctcatttgtgtattttaaaatgattgttctcaactaatgactctctaattcatatttgcttaatttcattttatgtttacaacttttactactagagaatttatttttgtctactacaggctgaaatacattaggttgacaatttttttaccattgatttattttttctgcaaatgtgtgagtttttcattcatactaatacatcacctaatagtgagaacattagttacagggaggtttattttaattggtttctattacaagtatgaaaccagagagttcattttctcaacaaatctgagagtgattgtttccttacctgactaaagtgatgattacacaaaccttgtggatgacagtggagtcaatgtggtttttaaaaaaccttttccatatgtgacaaggaattagatagtatgtcatttgattttaagaatgatgaacatattaaattgattctgtcaaatgtagatttttctaaaataagttggctggataaatcacgtcaatttgaacacacacatctttgcttcattattcaaagagaaaccataattacgatcagaacctcagattttgctctaggagcataccaggttcatgccttccaacctctgtatgtgaaggtttcctggtaggatgatactggctcctcttgcccaaggctgtcatgaggatgcacactcactgcaagggttttttatggtgctgagaggaaaggccttcataaatatgtacatttacttaatttctgtatctacattcccactgtgttttcctagagctcactactgtacaccatctcgactctgaagccctgggaatgtctgctctatgctctgctccatttcacaatgttctttaggtctgttttgttatttaaatgtaatgatgtatgtatccacaataggtagcatttgagagactccagctgtgagcctctggatgtgaagctagtgaaacaattgaatgactaacagttgaatgcctagccaaatattttcacttcactttatatgtcagcaatggaaaagagtaggtgtagccatcgactcttcttttcgctcagagaagtttataaataggtcaaaaatgggtaattatatgcctcagctacaatttcaaacttctgctttcctagtaattgccattaaatgagtaagttgtaaaagatttctggaaagaccacaaatattttcttttccttgtttctttgttaaaatagttcatataccatctggtttcggggatgtatcattatgctcaatgtttgaaacaaaaaaaccctaaaagacataaaaggtggcttgagtacaatgcagtgaaaaagaacaatatattttattctctttaatttcttttttttttttttttttttttgagatggagtcttgctctgttgcccaggctggagtgcagtggtgcgatctctgctcactgcaagctccgcctcccgggttcacgccattctcctgcctcagcctcccgagtagctgggactacaggcacctgccaccacgcccggctaattttttgtatttttagtacagacggggtttcaccatgttggccaggatggtctcgatttcctgacctcatgatccgcccgcctcggcctcccaaagtgctgggattacaggcgtgagccaccacacccagcctgttctctttaatttctaaaataaagttttagaaaaaactaaaactctaaaaagagtagcttagtcttccaaacagtgctagttacaggggcaaattcttgctccaggtgactgtttttatgtgccttcccttccctcatagccactgctttcttcaaagggcatcctctaactcaaatgtgaaatattcatgtgtatttttattctatcacaaaacaattttacacagataggattactcatgatgaagcattctagaacaacagcaagagtttcacttcatgtttgttgtaattattctatctttgaaaagcagaaatatatgtggttattatcataattaagacttcctgatactgaacagctgccttactggagagaaatgttaggaattttttatttttactaaaaactgtcagaagtttctaaaaggaattagatgaatcctgaaggtcctgtaacttgaaaagttgatttacgctgaggaccccattttcatcaaggtatcaactagagagaaacttgtatttttcttattttgcattacaataatgcatcttgcttttcttttttatgaagtgttcactttatttttattactccaggtacccaggatcattcatgctctcttctttaaggtgttgtacaccttgtgttcagtagacatttttaatttttttcttctctgagacaaggtctcactctgttgtccatgcctggctaatttttttcttttttgtagagacagggtcttgctttgttgcccaggctggtttcaaactcctggcttcaagcgatcctctagccttagccttccaaagtgttgagattataggcatgagccaccacactcagcccagggttcagcagacactttgagaggtcagatagagttcatccttcaggcagatgagatgctgtccctttaaaaaaaaaaaatcaacttctattttagatataggggatacatgtgcaggtttgctacatgggtatattatacccatgtagtgaatgtagtatccaataggtagtttttcaacccacagcctcctccctttcttctccttctggtagttagcagtgtctgtcatttctacgtttatgtccatgtgtgctcaatgtttagctctcacttgtgagaacatgcagtatttggttttccatccctgcattaatttgcttaggattatggcctccagctccatccacattactgcaaagtacatgatttcattcttttatatggctgcatagtattacatgatgtatatgtaccacattgtctttatccagttgaccactgatgggcacctaggttgactctatgtctttgctactatgaatagtgctacagtgaacatactagtgcatgtgtcttcttggtataatgatctattttcctttgggtatatacccagtagtgggattgctgggttgaatggtagctctattttaagttctttgagaaatctccaagctgcttttcacaggggctgaactaatttacattcctaccaacagtatgtaagcattcccttttttccatagcctgaccagcatctgttgttttttgactttttaatagtagctgatgtgacatggtatctcatcatggttttgatttgcatttctctgatgattagtgataagcattttttcatatgtttgttggctgcttgtatgttttctttggagaagtgtctgttcatgtcctttgctcattttttaaatgggattcttttttatctgttgatttaagttccttataggttctggacatgagacctttgtttggtacatagtttgctaatattttctcccattctgtaggttgtctgtttacactgttgatagtttcttttgctgtacagaagttctttagtttaattagatcccacttgtcaatttttggttttgttgcaattgcttttggaaacttcaccaaaaatgatttgccaaagctgaggtcaagaaggttatttcctaggttttcttctaggattgttatagtttgaggtcttatatttaaatctttaatctatcttgagctaatttttgtatatggtgaaaggtaagggtctagttttattcttttgcatagggctagccagctatcccagcaccatttattgaatagggagtccttttccccattgcttgtttttgtcagccttgtcaaagatcaaatggttgtttgtggctttatttctgagctttctattgtgttccattggtttatgtatttgtttttgtaccagtaccatgctgttttggttactgtagcctagcagtatagcttgaagtcaagtaatgtgatacctccaactttgttctttttgtttgggattgctttggctatttgggttcttttttggttccatatgaattttagaatagttttttctaattctgtgaagaatgacattggtactttgacaggaatagcattgaatctgtaagttgctttgggtggtatgggtattttaacaatattgatctttccaatccattagcatggatgttttttcatttattcatgttgtctctgatttctttcagtagggttttatagttcttgtagagacctttcacctccttggttagctgtattcctaggtattttattttctttgtgaatattgtaaattggattgtgttcttgatttgactttcagtgtggacattactggtgtatagaaatgctgctgatttttgtacattgattttgtatcctgaaacctttctaaaattgtttatcaattctagtagccttttggtggagtctttaggaattttctagatatcgaatcatattatcagtgaaaagagataatttgaattccttttttccttttggatgccttttatttcgttttaattgtttttttattttcccataagttattgtggtacaggtggtatctaattacatgagtaagctctttagtggtaattcgtgagatcttggtgcacccatcacctgagcagtatacactacaccatatttgtagtattttatccctcgccctcctcccactcttccccccaaggccccaaggtccactgtatcattcttatgcctttgtggatgccttttatttctttctcttgcctgattgctctggctaggacatctgtgtcttgcctttctaagatgaagttctgttttaactcttggtgatagtagtaaatgacctaaataaattaggtccaactaatttagtaagcgacctaaataaattgtgttccaactaaaatgggaagtgaaatggataaaaagaaggtacacgttttaaattttgtccaatttcttggtctttttagtcagaacaaaggaggaagacaccagctgaattcagttctagggttttgctaggtactacatcatgggcaactactgtgcttttgctttggatctcaacctcaaactcctgggctcaagggatcctccaacctcagcctcctgagtagctgggactataggcatgcaccaccatacctggctaattttttttttttttagagacggggtcttgctatgttgcccaggctggtcttgaactcctgggctcaagcagtcttcctgccttggcatcccaaggtgctaggattacagatgtaagccactgtgcctggcctgggcatcttcttaaacattgtttttctcatgacattttcctgctccaaaagtagtgcctcttaaaggcaggaaaactccctcccggaattccccatcattcattccacccttgactactgctccctaggatcaatgcacagttgttctcctaggacttcccttcaacatcattctcgtgtacttttaccctcttcttctcctggctcccttggttcctaagtgccatatatttcactttttattttatcgtctcatttaccagaagcacattctccagtagcttccaaagaaagggtacagaccacattaagcttctagaccctgcttgtctgaaaagtgtctttattctagcctcacactaaactgactgtttggctaggtttaagagtatgggtttttcctaagaacgttgaaggaattgcttcatattctagttcctagagttactgtagcaaaattcagtgccaatctggtttctaatcctgtatatgactgactttcattgtaaaactatctcttcacccctagtactttgaaatgttgtgatgatatgtaatatttttcagaaattatagaaaatagtgggccctttcaatctgaaaacactcatgtatatacattctgaaaattttcttatttttaaatttcttctccattttccctgttctctctttgtgaaacttgtattattacattaataaaactcctaattgatgttctcacttttttcttttgttgcctatttttattgtactttctttagacctcttcacctttgtcttccagaccttctgctgaatctgttatttctgctattgtatttttaatttccaagagttctttctcattctctatattctttcatggcattctgttctgtctcatggatgcaatcgtgtcctttgcctcatattaatcattggattttggaggagggaatcctattgttattgtcattttgttttgttttgtttttcccctgttccctgcattgtctctatttcttaaaattccttttttttgttgttgtttttctgtgtgtgcatttggactaaatttcatgttcgaggctttccataaacatggaaagcgtgatctttggcaccagcaagttgattggaaactatatgcttagctagaatgtgtcaatgggcaggctttaccctaggattgggcaagacccccaagtgccaatatcttcaggtcttgggttaatcagtttctctagaaagacagatattcagccaccttccttgggatggtgggggtggttgtgggggcaggtaacatgcttggcagacagcatttggagcctgagtaagggaagggggttggcttttatcatttagtagacatatgcatccatctaattccttacccccatttttcaccctcttctcttacctgttcattctgctgtgccagatgtttccgagtttgaaacccttttggctctccatctccataaagtgagctttctgtattctagagtagtagaggaggaatggttgactacctacaagaaatgggggaagggattcagctgccttcctacaaactttcagccagtcttcttgtactaagctccattcctcttccccaccttcagaggaatctagtgatcaaggtttctgctgctcacgttagcatccctcatgtttgattcactctctgtaggcacttgggttttcctctcctgataagtcagtgacaactcatccttttacttttaattccagtgaacttacagtttcacaatccgttgctctcagttttttcacgatgaagcaaggaacaaaaataaacacatccattcaatctgccatctttaagtggatgtcaatttatgagacttcacagcttgtttttgaagatgattctttccagctaaagaaagcagtataggacagacagaatctcccctattcccaagctagatgaccttagataagctactcagtgccccatttcagttccctcttcattaagagggaatcgtgacagtacctacttcacaggagtgtggtcacgtgaaataatgtgctagcacagggcatgccaaagggcagatagtccaattgatattatctgtctttgtttttgttattattaagacaatgttcacaatgaatcctttgttatttgacgcacatatagaaagtttcagaaataagcaatttgcaaaacttgcaaaaaactgtaagtgaattattcctctgctatgctgagttttcttcctccaccttcaagaagtggcaaggaaaaaaagatagaaaaatcactgaccaattagaagtttttgtttcaattcagaccaccctaaagttcctggaaattgcatatatgaactctagtaagctgaataccaaaaatgagagggaagtagctgataccaggctacagattgtgggctacaaaagattgataaacaagtggttcttttgtgcaaatttagatatgaaatcatgcagaaaacacttaacagaccactagacagaggattttatgagacatgttacacatggatggtgaaaggctgaaaattaatacttaacttgtcatgctttctgctttgaaatgctggagccctccaggaattttgttttaacaaccaatggagatatcattagggagatacttctgaattcgctgcatctcattctgtgacaaagtgctgcacaaagtaaaatgtacctaccactttcatccgagtttgtagcgttggacaaatccctattccacaatatcatgtgtacaaagagtttccgaagaacttgtggcatatttcttgtcagttctcttgaagttctcatttccccttttcctctcctacgggcaggtgattgattgacttagagtcagtgctgagtagtaaataacttaaaaaacaaatctagagatgatctggagaaggctcgaagaaatgtgatatgtattatctgggataggcctagaataacctgaatttacaatgaaggagcccagtagccttttctagaaagccgcttgctcttccactcttgtttcctcttaggcaagagaatatcactagaagctcagaaaattcaggattgattggaaatgtttaaaaagtgaaaataaacacaaatatctataaggctaggaacataaccagaaaactcagaaaaacataggggcttaaggatgttccaaaggtaaaaatgacctcaaagtgaatttctttcttttctaatctcgacgtaattcagttcttattcaagctgagactacccaaagacaaaaatgttgcactgatttaaaatatgactcatcagaacattaaaatacttatgatacagatttttatacaatccgatagtctattcctcacaactcattatttgctccctttaaaatatttcacaaagaaagtcttaaccagaacatgatcatgtaactaagagctccacattcagtagtaggataggtcagaagacttacagggatgttcctcatgcttacaaaaagaaatttgatattgtgtgataatacacgtaagctagaaacttgtggttaaaagaaatgtttaggactcatgtaagcataggttcttggtatctttttttaactgatatatcatagttgtcattttggggggtacatgtgatattttaatacatatataatgtgtaactattaagtcagggtaattgagatatctgtcacctcaaacatttatcttatgttgggaacattaaaattctcttcttttagctattttgaataatttattgttaactataatttccttactcttctatcaaatcctagaactttgtatttttgtacccattaaccaacttcttaatttaacctttaaataaaaatattttcattcctaaccctgaaattctacaaatttactgcttagggatgactcctgcatgttttctcttccttttaagtagacaagttctaaatcttagctgactttcattagccatttgactaatcccattttttaaaagtgtttgagatgggttgaaaaatatgaccaatgtgatgagtacaacttgatcataattgtaaaatattagtgtgctttaggtgttagcaattaagaaaatgtgaaatgttttatttcttttctttccttcccttttttttgaggggcgggggtgggtgggtagagacagggttttgctttgttgcccaggctggttttgaacttctggcttcaagcgatcctcccaccttagcctcctgaagggctgggattacagaaatgttttttgttgttgttgttggttttgttttatttttttgagacggagtctcgctcttttgccctggccggactgcagtgggtgctatcttggctcactgcaagctccgcctcccaggttcatgccattctcctgcctcagcctcctgagtagctgggactacaggcgcccgccaccgcacctggctaatttttttgtatttttagtagagacggggtttcaccatgttagccaggatggtctcgatctcctgacctcgtgatctgcccgccttggcctcccaaagtgctgggattacaggcgttgagccaccacgcccggccacagaaatgttttaagtagtaacatgattgttaaaatctcaaatcctgagtatctgagatatcggtttgatacttagaaaatcatgagctctggaatcatttttcaaatgcctatctaggatttgaattggcatcttaattagtaacatcagtgttaactatggcaactcatttgtttcccaaaaaaatttactattttaaggttaaatataaaataacggtataagtcctgggtttgatttttttttttttaagtgtaaaaagttatctgtgttcagtaggtggagaagccagctacatcctgctgacacaaagctaatcagtggcttgacaactctagtcaaacatccacatagaatgtcttggccataatctatgtgtctcctgtattgtttttgttttaaaagatttgagaggaggggatgtggtggaggaatggtgcagctcgaaattgcacgtagttgccaattttcttttttctagtttgaacatatttctgctttgagcttctttcagctcaagtgagccattttcacctattatttcatctgtcttgctctgtcttcaatcttcattagccgttactatggataagctgctgtaaacgtttttaaaaatcaccctcaaggagtacaatattctattaaaaaatgacctttccaggaaactaactaatagcattagaaaattaacactattcctttaagcactaaaactgaaaaggagagaaggaggaggaggagccaggcatggtggcacacgcctgtagtcccagctacttgagaggctgagacaggaagatcacttgagcccaggagttcaaggttgcagtgagctatgatggcaccactgcactctagcatgggccacagagcaagaccccatctcttagagagagagagagagagaggagaaagaggagggagagggtgatgctagtagtagtagtgtagtaaggatggcaatgttctgaaatgtctacttttctatgtaataactgaaatttttcttggaggctgagtcattctcatgaatatcaaagattgagcctgttattcattgaagagctcttgcaatataatatttgattctgtttgccccctaaacaatgtcttactcctatacaatcagcacggccactgagttcaaaagttatgtgctgtccccattggcagacaggcatccgcaccacagactagactgcctgtcccctgccctcactgctctcgccccactggccttttctcgaggtcccggccctcacttcatcagttccattcagtatatcccccaaacagcatttccactcagcctgccaaggagaaggaaagagagtatttagaatacgtccttcactttcctgagagaacagctttaagaaaagaaaacgtcactcctactcatgttaaccacctattgccatataatagaacacattcttatgctctctgagcctgtctcttttcttcgtctcactgtttcttgacggttatgttgcaacctgaggcagagtgtcagaaagagatgagagggatggcaaaaacccattcatactttgagactccttttctctaatttttaaagctttttctctccttccattagatactgttgtttctgcgtgcttctagtatacatagtcaacaatcatgttggtgaaaactccctcagggcctttttttcttttttcttgttctttctcttttcttcctggctgggggcagtatttcagctttgggttttcgtctttgatgattgctgaaagtctgtcttctgaacaagcgaggattagttgtatccgttttgactctgactttctctttccctgttcctctacctcccacatttgcaaattactttcattgccactctgtgaaaagcagaattactcctattaatagctgggcacttgactaacattccacaggttaacccaagctttgccaaaaggaaacagcatagaaagacccagaaactctccagtgatgtggtatcagtggaataagctctgccactggagctcattcagtggctcaatgagtggcagagcttgggcagcaatgcaaagtcttcctgtgaccacatctttaatttgagtctattcgttgccgcaattttgcttttgtttttcctttctcaaaaatggcctcattttgtgaaaacaaagtgtttgcactgataattaataattactacacttttattctggtatgtatacatacttagaaagcatcacacatgcatgtgtgcacacatacacacacacagtgtgtatgtattggtagcttaggcctgggtcagtagctcagaaacatcagaatgcatttgaaggctttagcctttccttcatgattagaagatagctgtagctgctcaaataccaagtgctgtcaccatctccagagcaggaaggatggggcagaagcaatacattttgtgaggctctgcttattttattccgaagtcctttctgggagacttcttaagtgccattgaacacaacggtgtctcgggtcaatttttagttgcaagaaaggctgggaaataatgatccagcaaaggcgaatggaatcctcatggagaccaggtataactcattcctggacttgcagaaggccctaggtgcaaaggatctccatccaccatctgaacatcaggattccgcctgggtggagatggctgtgagggagctaacaagcggaacagcatctcccacaacatgttttaaaacattcacaacactgaccctcaagtttgtgcttccaattgctagtgacctcagtgtcaaaaatgtgctgacaactgtgatgaagagacaaggagagaaaaacagaccctcaggagaaacagtgggagggggaggggagtggttattaacgtgaagtttaaaatattcaaagataggaaacgagaagcttaacgtgattgtctacagtggtgtaaagaagatttatatgtgtgtgttcttcttttcaaaaggcagatttaggtaccttttggagcacaattggaatatgcaaattgctgaccacaattgctataatgtattacattctatgcatgcaaaaaagaataccagggtttgttctctcctcttttaaacacccagatttaatctgacctacaaaacaaatagggctaaaacactgggcacgtttatcaagtcttcaaaagaatggaatagaggctaatgaacaaaatgctcacatcccttaagataactcaaagattcttgctatagcacatttggggcctcttttttttcttttttataagtcaaatgatatgcaagtaacaatatttttgagtgccagatggagaagacatctgtagagtaagaaactaaagaaaacacacttccaagattaaggcacattagaagaaaattgttggctatgtgagtaatgaggagtttggaaagggttttctctatgtacaacatgctcacttactgggtgacacaaatggaagatgccaatttgtttttttggttttttttttgaaaacagttttctttactaaaaaggggctttgcagtcaaacaaaagcacactactttgctttctttcctcatcttttctgcattcctcagtgacattctgattgtttccatgaaggtgtggcagttttgtcaatctcccaatatatgcttagcctttcaaagaacctatctttgttccttgtgtctatggtgaccgtctgttagtgacgaacagatcaaggtcaagtaagaaagagaagaaataattcggcccatacctctaacccttccaaagggcgtagcttagtagtttagtagtttcgcttcaaacactgaggacagggtgattgctgagatgctgtggcagtggtttcgggctgagcaaaacacgcatagcatgctgaccagagacagcagcagctgtgaggctcatctgtttcccaacacattttctagactgtgaagtccccttggaggaggactgtccatgaattccaagcatggaaggaatctgaccattctttttcattttaaaaccacattacctttgtcctagccttcagctttcaaggccatttcacttggcatttttcattgatttgtggccagaaactgatgtgaaaaaggagaacttaaaacctgttattagtcagggtttggaatcaattatgcttcaagagtcattttctataaccaagatttcattcgcagaagacatacacttagaacaatggcttgatcatggattgggtgggggtggaggacaagaatgaaagaggactgagatggctgaaggagcctctatggaagacacagagcatacacgagacttgtatgtagcaagcgttaagaagagtccacaatgttcgataatttttattttgttttaatatgtgttctatctacttttcattttttatttttattcttttgagatgtaatctcactctgtcacccaggctggagtgcagtggtgagatcttgactcactgcaacctccgtctcccaggttcaagcaattctcctgcctccgcctcccaaatagctgggattataggcgtgtactaccatgcccggctaagttttgtatttttagtagagacggggtttcaccatgttggccaggctggcctcgatctcctgacctcaggtgatccgcccgcctcggcctcccaaagtgctggggttacaggcgtgagccaccgcgcccggccagtccttcttaaactcttattcacacccagcccaactacagcaaatcaattcctccagttttcattatcttactctttttttatattaatacctagcatatcaaaaattacagatggcaacattaatgagtactgtataatatttcttgaaaaaaatagttaattataaagctttcttagaaataaaaggaaaagactttcaagcatagagtccaggcaggtatctatcattctgctttcttccttcatggaatcaacatttttagttcccatgtatgagtggaacatgcaatatttgtttttctttgtctggattatttcactttacacaatgatctcccattccattcatgttgctgcagatgacagcctttcgttatttttttattgccaaattgtattccattgtgtatatataccacatttctttatctattggtccattgatgagcatttaggttaattccatatcttggctacagtgctgcagtaaacatggaggcgcaagtatctctttgatatactgattcattttcctttggatcagtacccggtggtaggattgctggatggtatggtagttcggtttttagttttttgagaaatctccatactgttttccatagtggctatactaacttacattcccaccaacaatatataagttcccttttcttagaggctgggaagggtttttggaggaagataaagagagcttggtcaataggtgaaaacatcagttagaaaaaataagttctaatgttcgttagcagaatagggtgaccatagttaacagaaagttgttgtatatttcagaatagctagtagacaggatttgaaatgttcccaacacagaaatgataaatacttgagctgatgaatactctaaatacccagacttgatccttacacattctatgcatgtgacaaaatatcacatatcccccattaatatgtacaaacacttgcatcaactttttaaaagtccagacaagaaaaaagcccatgttgttgataatatagaagttgcagtcctctccatcacacacgtcataaaggcagcaccagaaacaagccattgcccaagataagggtacctatttactgcgtgaatttttgtttcaggtttactttattgctgctctaattagaattcttgtccctttgtttcacactcgtagcatgtatttatgtcatctcttctctgatttgaaagataccattgtttcagcttaaaacagcccctggtttgaaagttgcacgggatgcttatataaacaacaggcagcatgataattcattgcttcctcttaattcccatgttagttgaaactggaaaaaaaatgacacatgccatttttaataggtagttgagcttcctgtataaaaaaaaaacttgtaaattttgtaatgcttcttgggacatatgtcagtaatcatcacatggtttcaagcactgggaaacatcttaaaagatgctttaaaggatgagttacaaaagaagaaaagtagtcacaagattctctataatccctgtttggtcactctacattttccttctgaatgcactttttgagaaagtaaacttacttcttctcttcagtgtcatctgaaattttgatactttaaagagacctttgcagttttgaattttgaatataatattcctcaatgtatgaaaaactacattaaaaatctaactgtggatgcctatacttgaattaacaaggagtttcatctcccaaaatttcctcatgctgtggttttttttctgagctggaattgacagatactaagtttcttagtcaatcttgcaggcgctttcagaataattaagcctgagactaccagaaagaaccattaaaaattagaatcagagttggtggtatggaaagttcttttgaaagatggaaagttcttttgaaagatggaaaacattaatttaaaagagttcaagagtttaagccaaaagagccagtcaggttatggagcaaaaaaactctgcaagattaccacaactgtacttctctttgaatagattttctactgccagttatatgaaatggatataaatcctcccattccaacaactcaggaacttacttaagtgcagggtacgatagcaactgcaaacgagtctaagaaaataggctgaatgtcattaaaatcctttgaaaatgttctgtgacatctgttttccattttgctatgctgtttaattaacttcagtcttgcagaattgcagaaatcttatttgttcaaaatagtatcttgaaggaagagaagtttatttaatagagaagactgttaagtgtaatacgggcttgattaacttcatctcaagttttaaatgtttcccattggcttcatgatctatccctatatatggctcatttccataaaactaaatcaaactctggatggcggatcactcttatccagttggtactgctgtcatgtttcaaggacaccaaaaatggaagaaattacagagaatagtgacaattcagaaactattcttatttgtcttcatcgctataatatgaggtcactggctcctgagctagtgaggaaatccaagttctaaaaaacattccttccttatatttgttttttttgtgtgtgtgtgtgtgtgtgatctttttgataagaatagttgtcaaggctgggcgtggtggctcacgcctataatcccagcacttttgggaggcagaggtaggaggattgcctgaggccaaggagtttgagaccagcctgagcagcatagcaagacgtcaagaccatggctctttaaaaaaaaataaaagtagccggcatggtggctcatgcctgtagtcccagctactcgggacagtgaggtggaggatcacttgagtccaggaattcaaggctgcagtgagctatgattgtgtcactgcgctccagcctagacgacagagtacaatcctatctcaaaaacaaaaaacaaacaaaaaagaatggttggagagagagagagagaaagaggaaaataaaaagagcaattcatcctgcaaagacctagaacatgagtgcctcttctgatgaggctcagtggtcctggaaagctcctattggacaaatcttggagaataaacagaaacattttggagaggtgggagagcgaaggaaccagtcttcattgacagctgactttatttttcgatttgtcagagcacgccaaagcccagtgccctgtgaccaggacaaaaggggaagtggctgcattttgacatgtcccagcttcactagagaaagcccacttgtttctgactttccagtgcgggcaaaagctggcagatccaccacctgtgctcttgctgcccagcatctagggagctttgctattctgagtgtttctgaggaagccatatggatggtgctcaactggatttttctacttagagggctttatggattttaatgtagaggtcgtggcttctctgcatcactggcaagtgttgtccatctctccgtccttcttgagttccatacccagtgcatcatgaacaaatccatcttttttatctgacctatgctgtgtctactctctcagctcctgcttttgcttatccctcaaaggggaggtgttcttagctctctgacctctgggttgatacagaggccaaatttatcccagggaaggaataagtacatttgaaataagtcactgagaggagaagactgtgtgttttaaagccaggtttgtttaaagtgttatgatagtattaagatgttctttcattttcatagaagtacttcatttggctagaaggtcaaatgcctggtgctttgaggacctgaacagtttctgttccatgaacataccggactcaggagttcttttgctccagatactaagttattagaacagtgtttcccaactatggtgaaagaaaatcaataatcagaattttttagtagttttcagtatttcaaaagatctagttcgtttcacagttcaactgaaatgatgggtgtatttgcatctagtggcaatcatattcactatgttaaccctacatatgttaatcataagctctgattgacagttgtatattttctgtttagcactaaataaggaaagaattctagtaatttattgaatgtagttggatttccttcagactacaaagaatgccttgacaatctcactccctccttttgattttcagtgattcaggtcatctggattcctggccttcctcctgctattctcttctgtaatctccatttgcccgaccacctcctaccatcttttagtttaaacgccattctctgccttccaggagctatagactagaatagattgccttctgtgtcctccccagcagtagaaatttctactgcgtgataactctcacgcaattactctctcagggttctctgacaccagagattgtgttatatcttattctttaccttgccccagcccctgccctggtgtttggcacataatctacactcaataaatatttctttgtttaatgggtggattgaattcattgtcacactgagtgacatccatctggatgcttgattacaccacgcggctatcatattctgaaggaacatgatatctatgaagatctcaatcatggtttaatccccagcaactagcacagtgtctaagacagaaacttaatatggttcaattactttcgagattttttttttaatggggacactacagatttggataaaagacattaatgatgatgtttcctgtcctatcactaggcagttctatgaaaaggcactccttttttcaaaattccaacttataatgtaagatttgatgggtttgttcaattcctactaagtgagcagtaccatgattttaggtctgtaagtagcttaaagttaaacttagaactttggttggcgatgctcaccctggtctctgttatggataacagtttgaatgaggttgatgactgggtcttttaacttgatgtccttgtttattttctgcttgctttgtttggtcaggtctggcatggagccgaaaaataagagcttgcttgcagtttgactttcactgtgattcagttttgcaatcttttaaaaacatccttcaggagaccgccatgtatctatctgtggacatctcccagattttccaaaacaagcacaagataaataagggggatttggaaatttccaaattttaacagatgggaatttgcttccactgtctgagaaatctttgctatagatagaggggaatcccagaaaaaaatctaagtctgaaagctccacagagttctctgcctttgccttccctggaaaaggggtcgggggagagcaaacagatgctagaagccagtaaagtcctgtcctcatgaaagctctcagcccagaggacaacactctggggcagtcacttcagtcataggatatttccctctccaaataaccgaggagagagcctaacctctggggtgagtgtggtgtataaagtgtgagaatcgtgcgtgtccaggaagagagtgctgctaacagatgactccttgggggccccctttgttctctgcttctgtttgtattgagtcagcttgcttaggaatatagatcagtgagactaaagtatctctgttgggccagttctttcttctctgtaccatggtcaatctacagggtgcctgcacatcctccacagcctcgaggtcacagacttactctctgtgtctctaggctatagagcagaacaaaacagagccaagacaaggtgtctggaaaaacagaactcatggtcttccaacagggcatcaaagggtttctaaaatttaaagccaaagggaacctcaggggtcacctggtccaacccctctgttattttaggaggacaagaggcattaagtgattcagaagacacagtctagtggtggcaaagaggacaattcagacagttcccaatttacaatgattcaacttatgaagtttcaactttatgatggagtgaaagtgatacgtatttagtagaaactgtatttcaagtataaccattctgtttgtcatgttcagtacaggatttaataaattacatgagatattcaacactttattataaagtatgctttgtgttggatgagtttgtccaactgtaggctaatagaagtgttcagagcacattaaaggtaggctgagctatgatgttcggtaggttaggcgtattaaatgcattctcaacttatgatattttcaacttacgatgagtttattgggccataaccccactctaagtcaaggagcatctgtataggctttggggtcaggcatcagctggaatcctgactctacctctttagttcagctatgaccttgaataagtcacttagactctttaagctttagctttattgataaaacaaaagtaataatagcaccataggactgttaagaggattacattagagaaaattcatgtaaggcacatagcctaatgcatggcactcagtaagtacctaaaaattagtagcaactattcatcttcgtcatcattatcatgatcatcaaagctggagcctaggacccaagcctcctagctcagcattcctcttacaacagccctttgaatcaccttcatatgtcgttaatacttcattgggtaccccaatctatattagtttaagtacagactgtggtgacatcattagttagagtctgtgagatgggaggggggggcaaataatgattcattctcttaaaaaggggatgtaacacttttttttttccttcttcaactggaatagttagggatgtaacactttaaaagagcatgttgtacatcaaggtaatataggtaacttaaatttattttggattttgtttatgtatggttgcaatcccattagagtttaatggtattttcattttacaacacattctagtgtgttaggaagtatgtgttaagagttctcttctatttattattttcattactttcccattccagtatagacatagtaaactcctaaaattaagtatattcttcttaaagaattctaagtgaccattttggtggaaaaactacctgcgctagtttgcatgtgatctaaatgatccaaactaatgggtgagctttgggtgcttgaggactatatgcaggagaaaagaggagggatggataaaacttttccaattttaaaataaaaattattttctgaatgtgctttaaatgcatctgctacatgtactcaagaatgttgagtctgacccctcaaatttattcattaagttttgctacatcagactacacaaaggtcgggaaatcatgtgtccaaaataaaatcagatttgagctccaccttattctggcctatacaatgtccctgttcttaccaccttttctcgtctttcacaaccttgaatcagaatctctagttcaacatcatttccttttttccctcccccacttaaacataaaatatagatatgtgaattctataaagcctgcttggataatcagcttaccctaattcagctcttttcctcatcaagaggagggacttgacagctactcaggaggctgaggcaggagaatggcgtgaacccgggaggcggagctggcactgagctgagattgcgccactgcactccagcctgggcgacagagcgagaacccgtctcaaaaaaaaaaaaaaaaaaaaaaaaaaaaaagaggagggacttcaaaccttagtgctggtagtaacacctgagacagaaaacccgtgtgacacagaatatgagtccttaagcaaaaggactgtcgtattcatccctgtgtctctggagctagcacagtccttagtgcattgtacatttgaacaaatgtttgagtgaataacaagcccgttctccattctggttaacttacgagtactgtaccaattttcttccctgggcggaaaaaattatgaaccatggttcttgtgaaagttattatttttaaatgcctagacattcattcccagaactagaaacataagaaacaagttgatacatcaagggaccaagagatataaatgataataacttggaaatatttaaagttgtaaagatcctgcttagaagagggaagttatcaaaaggggttgagacaatagttgaatgactgagaagacattaatgaaaatcacataggagtatgatctaagaaaaggtacttgacatttttccaagtgagaaaactgcatgatcagataaccatgcataggttggagatgtgtccagagaaatttattcctgaaagacagcgataaagtaccagagctaaaatagtccatctgatagagacattggagctgagatctgaaatgatgcctgtttcttattaagttggattctatttactacacattttttagtgtatagatagaaaagggtacacaataggtacctaaaagcagatagctgtaattactactatttatcttttgtgctctgaggtttctcatactgtgttggtgccacactctaatcagctgcataaaagggtagatcacttgccaccacagaggcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaattcaggctatatgctcaccatatgtagagaaggcagggaaatttaattgtttgtagagaaagagacccaagacttcgtaaagccatgggatatggagttgggggacctgccagtcaccttgtcagttcacttcattttataaagaaaatttctagtctcagggaagccaagcaactttcccaaccaaaacgttagctttgcgttaagagaattttagagatagattattaacatcttgcggctgagatactgtaaatatcttcaagaattccaacattttgagcaattgtaactcccagaataattatttttgctataaatattttgcccattttatggtagtattccagggtctttactcccaagtcaaactcaaatattgggaaaagtcggatcctttttcttatcaattcccacttcacattccccgttgtgatcagctttctgaatttatttgtaattatttcttcagaagagagaaatatggataatggacggaggaacaggagaaaatgttagcatattgacacaaaggtttcagtattctaaataatcaaatatttgaaaaatatatattttgtccttttgccctagagatataaattgacacaaaaatatttacaaaacacattagtagacatcaatgggtctaaaactgtggtcctccaaaccagcaacatcagcatcagctaggaatttgtggaaaatgcaaattttcagtctcaccccaaatcagttgaaccagaaactctggggtgggacctggcaatctgtatgtatttaaacaagtccaccaggtgtttctaaccactggtacagacaaatcagacaagcataaccagattattggatgtcagttctaagtaatatagggggtgaatatatcaaatcctttgggagaataaaagcttagttgacttctatggtgtattcgtttcctattctgtataacagattaccatgaatttagtggcttaaaacaccccacatttaataagcttcgtaagttcctgtggatcaggaatccaagcataggttagctgggtcctctgctttgagtctcacaaggctgcaatcaaggtgtcactcaggctgtattttcatctggaggctcaactggggaagaatgggcttccaagctcctttaggttattagcagagtgcatttccttgtggttatatgaccgggccttggtctcttattggccatttaatggaggctgccctcagttcctagaggccactccagttatctgccatgtggccctctccagaggcagttcacagtgtggcaatttgctgcttcttcaaggctttcaaggccagcaggagtctctctctagtctgctaagatggtgtcatatatgtcatataacataatcatgggagtgaccttccatcacctttaccctgtgacagagtttagatatatgtccctgccaaatctcatgttgaaatgtaatccccagtgttggaggtggggcctggtgagaggtgcttggggcaggagggcagatcccttatggcttagtgctgtcctggcaatagtcagtgagttctcgttaaaagtgtgtggcacttccctgccactctctctctcttgctcctgctctcaccatgtgacctgcctgctcctgcttcaccttccaccttgagtaaaagcttcctgaggtctcctcagaagctgagcagatgctggtgccatgcctgtacatcctgcagaaacatgagatgaataaacctgttttctttataaattacccagtctcaggtagtcctttatagaaacacaagaacggcctaacacactacataatgtaactaattgagtgagtgacttcctatcacctttaaaaaaaaaaaaaaaattggtcaagagcagtggctcacgcctgtaatctcaacactttgggaggccgaggcagttggatcacctaaggccagaagttcgagactagcctggccaacatggcaaaaccccatctctactaaaactgcaaaaattagctgggcatcatgggcacctgtaatcccagatactcagaaggctaaggcaggagaatcacttgaacccgagaggcagaggttgcagtgagccgagatcatgccatttcactccagcctgggcaacaagactgaaactccatctcaataacagtaataatgataatttcaacctttattttaggttcaggaggtacacgtgcagatttgttacatgggggtattgtatgatgctgaggtttggggtacaaatgattctgtcacccaggtagtaagcatagtaccccaataggtagtttttcagcccctccctccctcccctctcctctcatagaccccagcatctgttgttgtcatttttatgtccatgtgtacccagtgcttagtttccacttttttttttttcaagttggagtctcgctctgtcacccaggctggagtgcagtggcaatatctctgctcactgcaacttccaccttcgaggttcaagcaattctccctgcctcaacctcctgagtagctgggattacaggcacctgccaccacacccagctaatttctgtatttttgtagagacggcgtttcaccatgttggccaggctggtctcaaactcctgacctcaagtgattcacccacctcaccctcccaaagtgctgggattacaggcgtgaaccaatgcgcctggccagtttccacttataagcgagaacatgtggtacttagttttctgtgcctgtattaatttgcttaggataatggcctccagccacatccatgttgctgcaaaggataaaattttgttcttttttatggctgcatagtatctcatggtgtgtatgtaccacattttcctatcacctttatattctgctggttaaaaacaagtcacaggttctgtctacactgaaggccaggggattctacaaaggtttgacttgtggtttaggatatgttcaccatgttgcagaaattatatatatattttttaacaaaattggccactatttagtatgcttttttctttgtacatgaagcacttttgaaaaaaagtcactgactacagtcttagttaccaagttgaaatcaaagatagatttttcttccaactgcaagaaaaattcagtgagtttagaagaaaaaagttattctactcagctgggtttgacagaaacactatttctgtggcctcctgtccccatcccctagttatgccttaaggcccttctcaaatatcttctccagaaagactttcctaatacttctaactggaattgttctccattttagtgcccatttattattgtacttccggtttactttaccattatttggatagatgatttgtctctctgtctggttggtaactgaaggtaacagaaactcagcaaacagatgttacattcatgagatcacatattttatatatgtgtgtgtgtgtgtgtgtgtctgcgtgtgtatttttttttttttgagatggagttttgctattgttgcccaggctggagtgtaatggcacaatcttggctcaccgtaacctccacttcccaggttcaagcgattctcctgcctcagcctcccgagtagctgggattataggcatgtgccaccatgcctggctaattttgtatttttagtagagacagggtttctccatgttggtcaggctggtctcaaacgcccaacctcaggtgatctgcccacctcagcctcccaaagtgctgggattacaggtgtaagccaccgtgcccagtccacatattatatttttgaagcctctccggcagtataatatatgctaacataaggtttgatgaattataaaagcaattaattttaggtattgggacacactaaaatctatccagtgtagatttccacactgggagagcaatagcctgtcatagcagctttgcaatcagatagccctgagatccatgcctgacatctccaattaatggctgtgtgacctggagcaagaaacttaatgtcgctaaatctcactttccttaatagagtcattactgaataaatatcaagctattcttaatatcaacttggaagtattaacatttcttaacacagttcacaccagggcacggactccacagtttaacctcatctccaggaggttagcatgcacacgtatcatgttcattcggtaggacagtaacctgctagcaaatgtagactaaataaacactggatcattcctgtagttatttataaatagtctccatctttggttgtgattttagtggttagaatactagaaaaagagtgggtagagggacaggacataaggaattccatgttaatcagtagcatgggaaggctggtcattttcacaaaaccaagggagatgaaataagattgtcctaaacactgttctgagaattacacagaacatgaaaggctgcttggagtgagtcagagctgggatgttataacagatccgggctctgtcgaacactcagtcccccttgccaaatgtaggaattcacaagatcaggctcaaacttaaaagtcaatttcttgtaggctgggtgctcacggctgtaatcccagcacttcgggaggccgaggcgggtggattgcttgagcacaggaattcaagaccagcctgagcaacatggtgcaactctgtctctacaaaaaagtccaaaaattagctgggcttggcggcatgcgcctgtagtcccagctactcaggaggctgaggtgggaggatcacttgagcccaggaggctgaggttgcagtgagcagagatcacgccactgcagtccagcctgagggagaccccgcctaaaaaacaaaacaaaccaaaaagtctatttcttaaataccatgctagagttatgttcattccttgcagtcatctaatcagttcccataactttcttgataaaaggcagatgttgcttttccatagaatagagatggttatcttggccaaggtgtttatgcaggagtgcgggtactaagatgattctagatttgtacctttttaaaagtctgttgtacagttctgtgttctgagattaggtggcattgtgtttcctttttacgttttttattctgtttccacagagaacatttacacactttcaaatgatcctgataactattccatacatatgatatcattggcatctatatactttgaaaatatggtagtaatttttttttgccatttatatctactggtgacccccataacttgaagctactttttagtgaccacaaaacttacttaaattcccaatgtatattattattatttccagtacctaaaatcttttaaaacttatagtataaataattacaaaataactttgaggagaaatttagagagtgaaaagagtaagagagaagagaaacaagaggaggagaagaaagaggaggcagcctagacttgtgaccaaagcttttacatggggtgaaaaaaagctaaactatattaagagtacatttatgagacaatggcaaagcgaacaagcaagagaaaggattttgacatatctcagttgacattatgaaaactctcattgcttatccttggaggaaatatagcaaccacctgactactcacaagcagcaaatgctagagaagactctcccctcttaatatcaataaactaatccccaccttacatgccatttaagtacaaggagaaagtagggaggtatataggcttttagttcttttaacatttgagaacccattttggccccaagtttagatacctcaacatttctgtcactaaccttcttccctccctccttcccctgcttcctgaccccccaaacccacccctttgtctctctctctcccccgaccctctcctcctcttcccttgcttctgagttgggagggatttgagaagaatgaacccataccaactccgccctagccagcattcaagatggccccatgaatcttgtctcctggtattcatgctttttctgtagtctcctcccatatggactcagagttggtctgtgtaactcacagggtgtagtgggggtgacagtgtgtcacttccaaggctgggttaaaaaaatgcacagtggcttcctacgtgcaccctctctgtcaacttccattttgataggatgctcactcatcacgtgtagaggcccatgcagataggaactggggcctcccagtgacgaccagcaccaacttgccagccgtgtgaccgaaccaccttggcaatggatccttcagccatagtcaggcctttagctgactgcggccttggtcaacatcctgactgcaaactcacgagagacacagagccagaccccccagctagaccactgccaaattcttgcctcagagaaaccataagagacagttaatgcttattgttgttctaagccaataaattttgaggtaataggttatgcaacaagtacatactatgtaataggtatgcaatagtatacaataatacaaatactttaaaagaaaagtcagaaatctaaggataacaaattcagagctttttaaaataagaatgttatctcccttgagtatttagagcctctagtaattgtccttgtagaatttgaagaaggttgcaaactttccttctttgttatttagagaaaatgtgtaacaaaacctataagaaatcactgctaatctatacctcaggagcctcatctcctgataactttttttggcaaaatatcagtgctcttccattgtgtgtgttcaaagttttagtcatccttacttagttaagatgattatatatgagtataccttttagttaacttccttttgatacatggtttatttcatgcctagggtaatgattgatgtttattcaaatgagctgatgtggatgcaagttcctcagtgctatacagtaaaattgctgttgacatcttccagaacaaaactgagataagatcctaattgtggattcccaaatattacttttcaaatactgttacattatgctgactattattttccattctggtgcttcttaagctcattacatggtgatgatttgtatatgggaacagtctgaagaaaaacaattgtgtgattttagataaaaacaggattcaaccgagatatggagtatctcaaagtaaaatgtgctattcccatctttctattctgtgtttggctccaagtccttaaacattcattcaatacacactatacagatgttcaaagaatgcctagtgtgcattgcttagtgctcaactgtgctaagcattattccacacatggggatggaacaatgaacaagacaaacaaaggttctgccctcatgaagtttacattttagtctgggagacagttaataggaaaacaagtataaaacaatataatgtgggatattgttaagtactaaaaagaaaagggtggccgggcgcagtggctcacgtctgtaatcccagcacttcgggaggctgaggtgggcggatcatgaggtcaggagatcgagaccatcctggctaacacggtgaaaccccgtctctactaaaaatacaaaaaaattagccaggcgtggtggcgggcgcctgtagtctcagctacttgggaggctgaggcaggagaatggcatgagcctgggaggcggagcttgcggtgagccgagattgcaccactgcactccagcctgggcgagagagcaagactccgtctcaaaaaaaaaaaaaaaaaaagggcagggtagagggatagacaatggctgcaaagttgagggatctaatttagatggaggatcaggggagtaaaatatgggcagggacttgaattatatagaaagagcaaaccatgcagaaatctgggggaagaacatttctaacggggaaagatcacgtttttaagccgtgagtgaacagaagcttggcatgtgggagcttaagagtaagagatgagagaggctgtcagagtacatagggcatgatggggaagggggatacagtagaagatgagattggagaaataaacaggaaacttgcaagcccgggtaaggacttcggtgtctattcaatgcatgatgagaagccacaagaaaattccaagcaaggaagttatgtgatctaatttaattttttaaatagcacactttgcagctgcatgaagaatagtctggaggtagcgagaaagccagcaagaccccttgaagggttactgtagttcaggccagaaaccatggtggcttgtggggtggaagtagttagtggaggcaataagaagtgatgggagctgcatctgctgcaagaatgaaggctgttctcagtaatcagactgtccacattccagaaaatgtcgacatcactctgaaggggcacagttcttgtgaaaggccctagaggaccctgcagagggacttcagtcacgtcagtatagaactcgggctccttggaaagaaaaagcagaggctccagattgacaaatgctgagaagatgggaattggctgccatgcgtgctatctgtagtcatgcacagaagatgatcaagggcgttatactgggcttctgtgacaagatgaggtctctgtgttctcacttccccatcaatgtcattatgcaggagaatagctctattgtagaagtcagaactttcttgagcgaaaaatatatctgcagggttcgggtgagcccaggtgttgcttgttcaatatcccaagcccagaaagatgagttcatccttaaaggaaatgacattgaacttgtttcaaattcagctgctttgactcagcaaaccacaacagctaaaaaccaggatatcagaacattttggatggtatctatgtctctgaaaaagggacagttcagcaggctgatgagtaaaatctaagagttgtacagctacagaaacaagatgtcagataattcctaagacctatttgtgatattttaataatgcaataaaagacagctattgaaaaataaagtagtgatgaggtttcaagacatgaatgatgggatttgctgatggctagcactcaggatgtaagggaaagagaaggattgaggctaactattgagttttggtctaagaactgcatgaaaggtggtatttatggacgtggtgaagagtaagggagagcaatttgggaggtggaagagaaccgagagatctgtggccaggttaagtttgaggtgtgtttatacatttccatatgggaatgtcaagtaggcagctcgaaatacaaatcgcaaagatgttggactcaagctataaacttgagagtcaccacaggagaaattgtgtttaaggccatgagactatttgctgtctcttaaggcagtgaatgtaaatagagagaagttctaagaaccggccttgaagcactctagcattagaggccgaaggtgaaaaggggtacccagtaagatggaaagcccagaagagtttccagatgaggacgatgtttcaggaagaaaagaaatgagtgatccattttatccatgctacagagtgtccaaaacaaatgaggaccgagaataatcttttgaattggacaagacgaggtcctggttgacattccaggaaggggcggagacagagcctgagtgaagtgtgttgaaagaatgaaaggtaggaaagtagacaccatgaaatacaaacagatgtttcaaggaattagctgtgaggacaaacagaaaactgatacagtacccagctggaaatgttgatttcctcagatttcttatctacaaggtgaaaaattttagataacttctaaatcccaatgtattacattgccaagtcaaaaaaacatcctagggtgagtgcctgaaaggctaaattgtgaaaaagagtcattactcgggttgttgatgtcctaaatatgatggtgtcattactgactagggagggtgctagcatcatttgtatccaatgcccatgtaatgatttgagatgacaatggaaacgttaagaaataatttaaatctattatgagaacaactctcatttattagtttacttgtagccatttctgtgattcaaatgagcattatgattattttctgacagaaagaacgaaatctcaggacagttccatgtccatctgtaattagacctcatggccagagggccacaacagtgaggtatgtgacacatcacctctgggctgctgtagctgggcggcatgatgactaagtgaaaatgacaacggcaatagtaacaggtgtcactataccactttagaatttacaaagccttttcataaaaattaacatatttaggctgggtggggtggctcacgcctataatcccagcactttgggaggccgaggtgggaggatcacccgaggtcaggagttcgagaccagcctgaccaacatggcgaaacctgtctctgctaaaaatacaaaaattagctgggtgtggtggcgcatgcctgtgatcccagctatctgggaggctgaggcaggagagtcgcctgaacctgggagctggaggttgcagcaagctgagatcacgcaactacactccagcctgggcgacagagcgagactccatctcaaaaaataataataacatatttaatcatagggaccatttaaaatgctctttcatttgtattaaattagttctccaactctgacagtttgagcatggttggcccagctatcctgatggctccttcctgctattttttttttaatgtttaaaactcatcttttcaagctcaagagctgttgctttgaagaggatttgaataagcatctgaaactgttggctcagacattgatccaactcaaatttccaaagctgctaccagaatgcttttcccatacagatccaaaatgaatgtgaaatgctgcctgtcctctttctcctgtcttcctttcagtgactccactttctccacagtggccctccacgtcaggcagcccttctaaagaatccactgcttgggtgtgtgtgttccccacgttgcattcagaaggcacatccatgcatctcaggcgtgtaggttcttcagcatgaatcatgcaaacttggtgaaccataaacctctccctgtggatatgagtttgttggtattttagtctgcttggaaacagtctgagaaacattaaacccagcttttttgaggttagtccaaattatttttttagactagagaaaaaaaaatattatgtctcctaaggaaacttgtaaccacgaacagtaaattttaaatgttttagaatggttttctttttccccctcccacatcccccacttgtgcatagttgaaatccctagtttctctcaccaagaaatactacatgctagactcacagatccatgggctgggcctgtgcaaatggatttcttagattaaaagtataaaaacaaggctgggcatggtggctcatgcctgtaatcccagcactttgggaggccaaggcggatggatcacctgaggtcaggagttcaagaccagcctggccaacatggtgaaaccccgtctctactaaaaatacaaaaaaaaattagccaggcgtgatagcaggtacctgtaatcccagctactcaggaggctgaggcaggaggatcacttgaacccgggaggcggaggttgcagtgagccgagatcgtgccattgcactccagcctgggtgacaagagtgagactccatctcaaaaaaaaaaaaaaaaaaaaaaaatatatatatatatatatatatatatatatatatatatatatagaaacaatatatgctccattatactgaccccaccaatcttaccctttctccacttttccagttcaatcatcccctaagtattcgtgtatagtaggattttaaaatgcacagtaccattcatgtgcagaaaagcacctttatttataaaatatgaattcaacttgctctacttggcaggaaggtacctagacctcactcacctattcaaggaaactgagtcacttcctgtttcaaaccacagtttttccaggttaactcaatctctgtagcatttaccatatccagcctcaaaggaccccacccatccatcctttctttgttcctttggggaaagaggaacctgtgagaagaagaaaaccacagggaaataagactttgagtttggagaagaataagagagcattataaagtgataaaacctaaacatggttcattaggaaaaagtgactgaaattctaatcctgtgcaggtccaggattatgagggaagcaaaaagaatgccactgacactagaatagagtatttcctgctgggcatggtggctaatgcctgtaatcccagcactttgggaggtggaggcagtggatcgcttgaacccaggagttcgagatcagcctggccaacatggtgaaaccccatctttactaaaaatacaaaaattagccaggggtggtggctcacgcctgtaatcccagctgctggggaggctgaagcatgagaattgctggaacccagggggcagaggttgcagtgagctgagatggcaccactgcactccagcctgggcgacagagactgtctcaaaaaaaaaaaaaaaatttatgtgctgtcacaactgcaaggcatgaggcctctctccctccctggcgtttccacatggcacttccccttgtgtttgacgtgtcagcctctgtcctcattgcaaatctcctctgccttccagcctcagtctctgtacagactctgccctcctcatcttggctgcagggttgtcaggttctttggccttctcatctcacagccacaggagcgtttgtgaacttgtgatcctccctagttcccggctctggcagtgggtgcggggaggcctcaacacagccagccccttggttactctactgtgactacctccttttggctccgggctcggtgacctacttccaaataccaaattgcagcatgggacttttctgattttcatttgccccctcaaatctatgaggtttctatgatctctttcatctcttctctttctcgtgagttacaagggagtaggggcgtaccgggtgcctcagaaggaacccaagtagcaatttcaccatagtctcatccctccaaatttctcctaaaaaatattccctcaatccaggatttttactacttccctctgtggagagaaaccccatgtctaacatctgtctcacccaagagcatgctggaaaattctttggcttcaaagtccaaagattgattctggatattgaatgtccagctaagggaaaccaagaaaagacttttctgttttctccttcaggtacctggtccttgaaattgaaacctagacacttatgcctattgtttttcttgtaactttcaaaatctattttgatgtcaaaatggaacaatggtttttttgttatccatcgagttctgcccttctcaagaagtatggatggctcaacctcagcagatggaaagctacagggaaataggaagtaccatctcaaggaaaagaaatgtgcctcattagaaatgtccgatgcattttttgttctcagtcgttcttgcaacccaaggactgagttgcaagtcaaagtgtttatcaatgttaagtttgaaccaaagacaaaaatctctgttgttctttccttcttagtagttcttaaactacttatatattagaacgctgctgtggaggaagaaatatttttagtttttcatacggaaaagttttaagacacacatttccatggagtatatttttcccacagtgttttccaaagcctctgtctttggctcagcatttctccaactggaagtttcaccaatgagtcccctgtgttcctgtggtccgctgtagggctactctggagtctctggcttattagcatgtaaaactcggagattctttccctccagttaaagtcatatccacaggatttacatgaaatatattatatatggcacctttctttgtaaggtagctagaaagtggctttgggaattttttttctgagacgagtctctctccgtcacccaggctggagtgccatggtgcagtctcagctcactacaacctccgcctcccgggctcaagcgattctcctgcctcagcctcctgagtagtggggactacacgcacacaccaccacgcccagctatttttgttgttgttgtttgtttttttttttttttttttttttttttttttgtagttttttgttttggtagagacggggtttcaccatgtttccgcggctgatctcaaactcctgggctcaagtgatccactgcctccgcctcccaaagtgctgggattacaggcgtgagccaccgtgcccggcaggaaatattctattctagtgtcagtggcattctttttgcttccctcataatcctggacctgcacaggattagaatttcagtcattctttcctaatgaaccatgtttaagttttatcactttgtaatgctctcttattcttctccaaactcagtcttatttccctgtggttttcatttataagggaagaaaagaaaggacgacaagtctatttttagggatccattaaaaattcattttttaatagtccataaacattgcgaagtaacttgggactcatacatacaattctgattattttaaattgcttcatgtgataattgcaagcatttattgagcatttacacattactgaacttaaaacacataaaaatgccattctcggctgggcgcagtggctcacacttgtaatctcagcactttgggagccaatccaggcaaatggcttgagtccaggagtttgagaccagcctggccatcataatggaaccccatctctattaaaaatacaaaaatgagccaggtatggtggcatgtgcctgtcatcccagctcctggggaggctgaggtaggaggattgcctgagcctgggaggttgaggttacagtgagccaagattgtgcctgtgcacttcagcctgggcgactggagtgagaccctatcccaaaaaaaaagaaaaagccattctctggcgatcattaaaaagtcaggaaacaacagatgctggagaggatgtggagaaataggaatgcttttacactgttggtgggattgtaaattagttcaaccattgtggaagacagtgtggtgatccctcaaggatctagaaccagaaataccatttgacccagcgatcccattactgggtatatgctcattggattataaatcattttactataaagacacacgcacacgtatgtttattgcagcactgttcacaatagcaaagacttggaaccaacccaaatgcccatcaatgatagactacataaagaaaatgtggcacatatacatgatggaatactatgcagccataagaaaggatgaattcatgtcctttgcagggatatggatgaagctggaaaccattattctcagcaaactaacacaggaacagaaaaccaaacaccacatgttctcactcataagtgggagttgaacaatgagaacacatggacacagggaggggaacatcacacactggggcctgttggggtagggggcaaagggagggaagcattaggagaaatacctaatgtagataacaggttgatgggtgcagcaaaccaccatggcacatgtatacctatgtaacaaacgtggacattctgcacgtgtatcccagaaggtaaagtataactttaaaaatgccattctctacagaatttgataaatttttaatctcagagcttgaaatcagttacaacactgttttaatctatgaaattatttcagtgtctttctatgaaatttagacccaatcttcagataccatagagtacctactatgtgccgggtgctctaattagaatcttccatttcattgtcatttaattctcacaagaaccctgctaagcaggtggcattatctcctttccacctgtgaggaaacaggttcacagccgttccacagccccaagcctcacatggagtaagaggttgagtaagatctgaagacacatggcacttttaggccacacagtgtccaaggtatttaaatgaagtagatgactgagtgttttttaagccacacacttacagaaaagacactaggagatgagcagaaggtgtttccctggagatgctgccctggtaccacagcagcaggaggtgggacaagctgacttctactctgagtgagttaagaacctcagggctgctctgggatagagacagcatgaacaccagtgcatggagccattgtaccctggccatggtttttgttttagatcagcatcaggttcagaaatccagaaccaaaaagaaatgaatgcaactcccattccatcaggtcaggagtgaccaggcctcccacagacctttgcctgtttcctccccaagcgagcctcagagccttagaagccctctcccacatggtcttgtattaaatcatgttcttctaggtcaaataacaagggtccgttattcatgcctctgtttatttattcatatgtgtattcattttattcacctataaatatttactgcagtaatattaaccagcgtccttgtggatatcagagtgccacggatataaatatgggaagaaaaagaaaccactttaaagaaaaaaattcttttagagagtatacttactatatgtcttcttatagatatgggactttgtcaatggtgagtgctcagtaaatattcagagacgaataaaatgaataaacgtatgaatgaacagaggagtgaataatggacccttgttacttgacctgagagaacataatttaatacaggaccaatttctatcattttcctataagtaatgtatttctatattacatatgatattttgatataaattatattttataagtaaatcacctctaggctggaaaactcaccctatgttggcccctaggaacatttaaaaaaatttttttagaaacaggatctttctatgttgtccaggctggagcacaatagctattcacaggtgcagtcatagcacactacggcctcaaattcctgggctcaagagattctcttacctcaacctccagagtagctccgactacagatgtgtgccactgtgcccaacttttagagattttttttttctggctcagaaaaaatccctctcagtatgtttattccaaaccctttctaacaggtgtccatgcgttaggcaaaaagccttacagcttctcagattcttctcagattcaaagattcatctgtattcatcatttgagattcatctcaaagacttgcttagagatgaccgtaccatctctaagcaagttttcctttctctctaacctgctcctttggttcccgcacctctcttggctccaggtgtcaataaacaacacctttgtcagctctttccattgcctcctcctggtcagagcatgctgagtgagcttcacttaaagcctcacttttgcatcggataactttttctcatttgaatcgagggtttatacactgcccaatataccatatccaatataaacaggaaagaacatgatttctttgtagtaggtagcctcccttctaggtcttcttttacagtgtgatggttatcaggcttaggaatcagaaaaagttagtctgaatctaatctctagtccttagctttaacctgggcaagttattgccatcatctgaaaaatgaagataaaaagaatgatgaacaaatgagatcacatatgcaaaacatacagcacaatatttgaaaatagagaaggtttagtaaatggaagcgatgatgctgaaggagggagaaggaaaaacagagtagaagaagaagaggagaaaattgctaaataatgagtagccatcttgagagacagagagcgtggcccagaggacatgagagattaggaactgctgcgttttatagggaaagggaacacaagggtaggaatgtactggaaattccatccaaagaggactcaaggtaatgcaagtcagaatgggtacttgggagcatgggatgacctcagagccaaggtgatattacatcccactgtcacccacttcacactgtggtcttaatttagctacacgttcatggacaagaagttcagagccagctcacactgcagaactgggttccggttttataagctaacttactgtttgccacagattgtaacctctttcccaaagaacagacataccaggagccagaaagtagcttttaattaatgaatttgtcatctgctgctcagtggtaatgagggaaatcctgtgccatacattcttttaagtgtagattcaggatctggatatgtactagtgaggtcagcaattcagccctttacctctgattgtgggccaaataaatggctgaattactcatgggggtgtggattttgttaagtgtggtgggtaggggttgggaggaagagaagagggtgtgtctttcttggcataggccaaaatgaatgaaaatgctttgaatgttattataatctattctgtgaccatgtccaggtggctttctgccatggctctgggcacacccatatggacttagtccctttctgtagggatttcacagtttctggttggcagagtaaggacccaagcaggaagattttcttccccacccaacacacccctgaatcctgccaaatgtgaggtgtgggagtgataatatcaacgcaataataccaatagtaaccacaataggttcttaagaaactggaaaagggtactgagaagttttttccaccttttttgtatgcctagtttgctacattgctcctaagttcctagacttctgggcagctctgcctatggaatagccattcttttactcctttactttcttaataaacttgctttcacttaaaaaataataagttcctagacttctctttagtgaatactagagctctacctgaaagaacccacattttcaggtcaattcccaaaactcaaatggtagtgtcatggacttgaaagcagtcttagggactgtccattccaacattctgcccatcacagacattccctgggagcacccaaggcaggcggttgtccagcctgtgaatggacacatgcagagacggagagcctgtttcctgagaaggccaagccatgatgggcatctgtagtggctgcaagacagcataatgcgggggaaagagtataggattgggaggcatgggaattggttcagtgcttgttcttccactgaccagctgaacgaccttcgggagaagtcactgcgccttagaatgagtcacttatcaactatgaagctgttggatatgatctcagtcattctagcaataacatggtcatttaaagttgtttttctacgtctagccaaaactggcctcctgtaactgccagctattggtgttagttctaattttgagaaatgtagaggatgggtcttatctcattggtgtggcagctcatcaagtatttaaagatggctgcaatgaccctgtaagttatctcttctttagtataaacatctcaagatactgtaaatcttccttttatgacttggctttcagaaatcttcctcctcctgacagtcctcttccagacagactcaactctttaaattatggtccctagaattggatgcaacatttcacaaccggccaaataagagcccaggaagtactgggactgtaacaacccaaccctccacaactatctctgcctttcatctagaccctgtgctgcttttcacttaagtttgcctttgcgttagttatttcagcctccatcgtcatctcatgccacagactgtgcctgtggttgggtacagccaccaggcccttacacatgacctgctctccagccacttctcccctgttctggacaaacacatagaatgatttcccccttttcactatacaattaatatatatgcatagtaatgtagaaagctgaacaatagctgcccaaattgcagtatccagagataacattgttaacttaggctaataccagtaaattatttttaataacaatgtcagcattcatggttttccttacatactgaggtttatttactccctgtctctgattttttttttttttttttttccgagacagagtttcgctcttgttgcccaggctggcctgcagtggcgcgatctcagctcaccacaacctccgcctcccgggttcaagcgattctcctgcctcagcctcccaagtagctgggattacggggatgtaccaccacacctggctaattttgtatttttagtagagatggggtttctctatgttggttaggctggtctcaaactcccaacctcaggtaatccacctgcctcggccgcccaaagtgctgggattacaggcatgagccaccgtgcccagcctctgatcttatatcattcctcttaccctcagtggaagacctcagtccaagcctggctttcacccctacaccagcccatctttccagccttgtctccaccattgcccagctgttatccatacccaccatggttcagacttccatactccctgtaagctcctagaatcttccctcatctccctcatttgaccttttggaaaacctcctgttcatccttcaagacgtagttcaaatgttacctcttccgtgaagtttacccgacttcctctcccatccgcattccactggaatccccggttcttttatctatatttctgttgatctttgatactactcttttataacacatgagattgtaattaattggatgcacctgaccacaatcaagtcctaccctgggagccacaatatcattgggcaaactttagtctattgtccaaactgtagcatataaaagccgtgtcaaaaaaggaaaagctaaaacatccgctctacctgtgagtgctcttctttgaatgttcacattaattaccctgaacctggaacactttgttttaagacatggatgatcagacggtggaataaaggtcaagatgaaggatagagggaagaaacaaagatatgttctatttagtaggttcagggcaattcgtttcagaaaagtttcttacatttatatactacatgcatgactatatgcatatgatctatttattaaaattgtttttattcagcatgtgtcacatagacccaatttatttttggagagcatagactaacataaaaaataaataaatctggccatggcagctaatttgaatggtatgttttttcttttgtttttttgagatggagtcttgctctgtcaccaggctggagtgcagtgatgccatctcggctcactgcaacctccgcctcctgggttcaagcaattcccatgccacagcctcctgagtagctggggctacaggcacacaccaccatgcccagctaattttttgcattttagtagagatgggatttcaccatttggctggcagtgatgccatctcagctcactgcaacctccgcctcctgggttcaagcaattcgcatgccacagcctcctgagtagctggggctacaggcacacaccaccatgcccagctaattttttgtattttagtagagacgggatttcaccatttggctgggatggtctccatctgacctcgtgatccgcccccgtcggcctcccaaagtactgggattacaggcatgagccaccacccagccggtatgtgttttatttgagtgtgtatagatgacttttccagtgaagaacattcattgtatcccagtcaaatattaaaaataagctgttctcctggcttctataaatcagatttccacgcacacaatcctggaagagtatatctgtgcacatgcctgccctggagctatccgttagaactgtcctcacagtgacgtggaaaactttgcctcatctgtataaggtctcgtctttagagagaggagaaaggattgggaatttcaggcttgaatctctgaaggtgcaaagcttgaaaggttgagatggagagcagagtctgggaactctgtgtctctgccttggtctgtgacagatggggccgggctggtctcaaagccgttgcctagaactcaaccgtgggctggcgttacccttttgaactccccctgcctgctacaattcttctctgctctatcatgggtcccaggacagtttctgctccagactgtctgaggagcttagggaactctgaaaggaaaccttttaagtctgcttttcttgagaatgctaaccctgcaaaacttggccagacatcacattgggtctccctctgtggtgactcagaaatctcaaggagagcaggaaaatctagaggaacactcataatgttgaaagggccagagggcaggagggatgaaatttgtgtttccattgagtgggtgatatttttcatttcaaagcctgatgtaaaatcttgctggtttttagttatctacagattgagaatataaacactgctattaaaatatttcatctctcccaaatgaggccatgcacaaatttccttctatgtgcagagccttcagcaacatccataccaagcacaggcagacatccaaatctactctttttacttgaagggaaacagtgctatctctgtaggagacagaggctgagggaaaggaagagaggggtcttggaaggtcaaggctgagttgggggagagggcaacattcataggtcaggaaaggcaaaccaattataatgatttctttctatcactagcaacatctactctggaaacggttgtctaaggttatgccctttctggtaatattcagacttggagtacttaagcttagttaaaagaatttgctagcactttaaatgttggattgctggcgagaatagaaaagcctgtctcccttcaggcaaggtcctgccctgtgcttttgtgtgtacccctctgccctgagaatagctgggctattggaggttcacacagtcaataaccactgaactgcacccgtgggtagctctccagtgctgcctgctcatttaacaggtccttatggagatgggcctgatacacaagtgctggcgatcttcaggacaaacccaataaaatgagagaacctaagcttggcttctaaccttcctgggaaaaggaagtgtctgtggttttcatagagcattcagatcttttttgtacttctgtctttttccattgaagatggaattgttctaccctctccaaagtcagccctgaaccaaggggttttccatgactttctgtgaccatcaacattcaactgatgcctgtttcctatacacttcagagagagccagagcttcacaagccaattaacacattcctaagaatcaaaacttagtttctgggctgggcgccatggctcacccctgtaatcccagcactttgggaggctgaggcgggtggatcacttaaggccaggagttcaagaccagcctggccaacatggcaaaaccccgtttctactaaaaatacaagaacttagctgggcatgggagcgggcacttgtagtcccaactacttgagaggctgaggctggtgaatcacttgaagccaggaggcagaggttgcagtggccaagattgcaccactgcattccaacctgggtgggcaacagagcaagactccatctcaaaaaaaaaaaaacaaaaaaaaaaccttagtttctgaaacccataatgcaaatacatgttcctccaaaggtctcaatgttcttatctcaaaatacacattttattgcttttgaaatacatgattatcatatccctttggcatgaatttgtatgaatccttagatttaagtatgtaaaatataataaaaacaaaagtgtgtgaataccccctactgcagagttatgcaagcctaatattcaaagcatgacatattaaatattataccttaaagacagaattagaacatgaacacatgtataatgtctttgcctcaacttcaaaaatgcacagttgttgagagcctggaagagacattcaggaacgggctgcaacaagccttgctctggtgtggtcctgcttatccaattgttgctcaataatgtcccttcccggaggcatagaaggcaggcacccatacattcacacccacaaaaatgtcacctcattccccagagattgccagtctgggcattgaccttcacttaagcagggcatcagtgtgatgtggtccccctgctggaagtggaattgtttctaactctgggtgcccacaccatagagggcttgtctacacttggtctcagccatcaccccccaaacacacccagctctttaccacctgattccctcaaggcgactctccttccctctgccagcaccccttggttgtagctttggggaccctggatgtttgaaagtttcatttgtccacaatccaggtataagtcccccttccctggattctagggagggcagcagcggcatgtcgttgtcactcagcttgctaatcaagagagaaccccagaaagagtatttaggagataagaggggtagtatatatttttgtaaatagaaacttgttttctattaataattaaccatttttctgatagcaaaaacatcagcacaggtatactctatccatttatggttggttaacacacagaaccttttctactgagtagggttaataatacttagtatgtgcctagcattcaacactcacaacagccttgcgaaataggactatttttattcccattttacaggtaaggaaacagagaccagaggtgcaataactttcttaaaacgactagagggagcaagtgacagctaggacttgaacacaggctgttggccttcaggatctaggctcctaacacaatgcaccaaagccaagtcagtgccaaagttattccatacaaacggcacttgttctttcaccctttcaatgttcatgttatctctgctcttattttcatcttcattgtacacctccccttacatgtatttgcaagtctctcactttgcaaaatggaactgataagtactaaacctcctcaaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaaaggaagaaaaaagaaagggaaggaaggagtgagcgaggaatgaaaagagaaagagggaaagagggaaggatggtgagcctcttcagaaagacggctgctcatgcttgctctcttgggcatggagtgggtcactggctggacgtttaatgggtttacattattccttaacagtcattgtttcaaaatgaggcatctctgatggctccatgctggcttgtctctttccgcctatgacattctctcaagagtttagagtaggagaggattttagaacatgatagtaacaagtaaaattagtattttttggactccaggtacctgtttgaaattatattgtttagaatataacaataacagtgaaattaaattgttgtcttaaagtgaataactgtaaagccatgtgtgatctgaacccccgagcctgcccttatctatcaaaatcctggtgtctgaagaagtccaaaatggaaacacactctgaacagatttccggcaggagcttccaccaggttttcttcgtggcaagccctagaaatagtctggactacaagcaggtctttttaaaaccatgctcctttatttaatcatgaagatttaaagtttataagtttagaaattcagggataaaaataacccactgagtgtcaggcctgattgctaagtgctgttcaggtgtgatctcacagctctctcagcattttcatcactgccaccacttcacaggtgagaaaagtgaggcagacaacagacaagttactggtctaagtggtagaataaaaatataaccccagctccagagcctctgcactcagccatcatcgtgtactgccccgctgtgaatttcatctaggatatgccaagacctgctgatttttcgtcacttgccttttcttattaatgtctgttccttggcgacaatggcatctgctgagccccacccggcctccccacccacctcgccgcctgttctctccctcaaatccgaaaggtcacgggtacacacccaacttcagatagcatttagttagcttcccctccaacactgaggaaatgttcattaaatgctccagccatttaacaagtctatttaacttcattttcaatttaaccatgtattatttcagtttccttttcctccgtattgtatagccctgggaataagagttggaaatgtgcctatcataagctgagtcacattttatgtgtcccctcctctcaagccactgttttctctctctttttttttttttgcgattaaaaaaaatatatatatcctgtgtaaaataaaacagattcagaaaactgcgtaaaacaattcattatataatttgtatatataatgaatgaaagaaatagaactttctccttgtacttgcctcagaagccatgtgacccaagccagtcacagcccctgccaccttcaaagtcagcattgtattaacttatagtacttacatccttgtggatttttttcattgcagataatttttaacatttttgaggtataattgctatatataagaaagagcacatatttaacgtatgcaatgtaataagttttgacatatgtacatgcccttggaagcattatcacaattaagatagcaaatactggctgagtgcggtggctcatgcgtgtaatcccagcactttgggaggccaaggcaggcggatcactggaggtcaggagtttgagaccagcctggccaacatggtgaaaccctgtctctaccgaaaatacaaaaattagccgagtgtggcggtgcacacctgtagtcccagctacttgaggcactaaggcatgagaattgcgtgaacctgggaggtggaggttgcagtgagccgagatcatgccactgcactccagcctgggaaacagagcaagactgcatctcaaaaaaaaaaaaaaaaaaagatagcaaatacatccatcatcctcaaaaatttcttcctaccccattataatcccttcctcctgccacctgctccctcctggtaaccgctgatctgttttctgtcactatatatttgtcttcattttctaaggttttatataaatggaatctttccgtatatactctttttgtttgatttcttccactcagcagaattactttaaaattcatccatgtcttgttatatgtataatacctcattcctttttattgctaaagagtattttttgtacataaatatgatatctatgcttatagagcatatatatcacaatttattcattcattcagttgttgatatttacatcattttcaattttttactattgggcttttttccaaaatggttatatcgttttacctttccaccatgattgtatgagagttccagtttctccacatcctagtctgcacatggtatcattagtttttcttaattttagccactttaacaggtgtgtagtagaatttcatcgtggttttaatttgcacttccctaatgactgatgatttgagcatcttttcatgtgtttatttgccatctgtatatctaccttggtgaagtgtttgcttaaatctgttgcccattgtttaattggattgcttgttttcttattatcaagtttcttattatagtatttatatattctagatacaagttctttatcagacatgtgctttgcaaatattttctcctactctgtggattttttaaaaatttccttcatagtgatggagcagtttttaattttgatgaagtcaaatttatcaacttctatgtatcatgctttgatatcttattaaagaaattcttgcctaatccaagctcacaaagattttctgctatgttttcttccaggcacacatattatagtttatgttatatgtttagacctatgatctattttaagtcaattttttatatgatatgaggtatgaattgaagctcttttttatttgtttgcatatgcatttgattgttccagcaccatttgttgaaaagactgtcttttcctccactagattgcctttgtaactttgtcaaaattggttgtccatgtatgtgtgagtctgtttctggactctattctgttcaattagtctgtttgtctttatgccagcactgtactgttttgagtactgtagctttacagtacatcttaaaatcagatgatgttagcctctcacctttgttcaatctaaatagaaagttgttttggctactcttggtcctttgcatttctctatagatttttgaatcagcttgtcaatttttaccaaaaagcttgctgggaatttgaatcaaggttattttgaacttatagatcaatttgaggaacgttgacatctcaaaaacattgcatctcatgtctcatgaacaaagtatatctctccatttacttaggtcttcttgaatttctcccagctatgagttttcagtgtaacaggtcttgtacatcttttgttagatttattcctattttatgttcttatgctcttgtgagttcttaaatttcatttctgattatttattcctagtatgtagaaatacagttgacttctatattattgattctataatctgcaaccttaccaaacttattctagtagcatttttatagattccattggatttctacataatagtgttgtttgcaaatacagacagctttgcttcctcctttccaaactagatgcctgctatttatttttcttgccatattgcaatggccaaagccttcagtaaaatgttgaatcaagtggtgagagcagatccttgccttgttccttatattagggagaaagcatgcacccttttactattaagtatgatgttagctgtggttcttcagagatgccctttattagattaaggcagtttccttctattcctagttcacttagaattttttatcaggatgttggatttttgttaaatgcttttctgcctctattgagatgatcatacagttttccaaaattatatctgttgattttcaaatgttaaaccacctctacagtcttgagataagccccatttcatcatgatgtaattacctttattgttgtatttgatttactgaaatcatatttagtttttttatgtgttaaatattcccagtacacttgataatttgggatcccaatctggcttgttatatttagtctctgcactaagctctagctacggtagctacagtttacttaatgaccaaataacaaccttttcttccattttaaattttgtatgactttggctgagggtcattgaaaaatcaaggatgggaatacacacacacagaggcacacacatatacacacacacacacacgccccacagtcttacatggtgaggtcctgactgaagtttattaggaaaactaggagagacaggccacaggacttttcaaccttcctgagtagagctaacaggagactaagcctactcagtgagtctcagtgaaaactgggaaagagggatacggaggagaagcagtaagcactgctgcagttatggcttggaagaatgctgttaatactgctttatcccatcattgctccattgtccagtcttgacacaggacttcctgccgccttagactgaaatagaatcactgccccaagataaatgtgatgggggagacggggtttaggaagtgattatcagacacctgcatgataagagaaaatggaaagcaaaaacaaggagataagaaggaaacaagcccagcatgttcccatgggttttacacatagactcagaatatcagtagcagcagggactgtggcaacccaaggccacaatacccaactaacagataagaacaccaaggctagactagagaggctgttcatctgagagcatactggtttgttttgttttgtttttccctcttcctgatatatccagaaaatacttcctcctcccagccccgtttagcagtaacttacttccttggagaacaatgcctcaacccatattcaggccttaggttggtacagacaatggcactttacatgcgtgggactctccccacccccttcattcaatgctgcctaatgagcactcacttcttgggtctcatcaccagtcctgcactgtaattcagggagccagctgcctctgccaacagtgtaagtaatctcaggctattttataatcagtcctgaagaacccagagggggcaccagactcacctcaacctcagattatgttttggatccacttttcttcgtcttggatgaactttgtgaactttgtgtttgtgggagagcacagtgaaggatgaacaaggaaaaggaaaaaaggggtaggagaaccaaaggcaggacagcttttccttcctcttttctttcctgaatttttttttctagagaagtcttcaaatattccagcctcaacttttgaaaaagaaaaagcagaatgtttttagtaggatctttttgtttctagcttactgggagacagtgggaggatggacacttttgagcagatatgcatcacccaatcaatcatctccagaagaacatctgaatctctaaggaattgatccaaattgttaataatacttgtggtttaagacagatagatgaaacaccttgtataatcactatattcaatgtatttgactcatgtatgggacttagaatataaattttaataaagtagaggcttaagcttgcatctttgcttgtgtgtcgtactatggcgcgtaactgtgatttccttgctgaatccctttagggcaaagctggctttggtcatgatcagatttagggtgtctagcacatagtagatacttaataaatatttacataacaaacctttacatggtactgattatgtaccaagcaccgtgctaaatacctcaaaaatttaagctcatttatgccttacttgcgtaaggaaactgtcattactatctatattttacaaagaaaactgaatccagagagactgagcaccttgtccaaggtcacacaactagtaaagggaagagccagcatttgaacccaagcagtcttgctctttttatttgtttatttaatttttgtacaggcagagtctcactatgtcacccaggctggtctcaaactcctggcctcaagcagtcctcttgctgtagccttccagtgcttcgggattataggcatgagccaccgtcctccgccaaagaggtcctgctctaaacacttgctaagaatacattgacattgaatttttcagtcattaatgttatgatgcttatgaaatcgtgacatgattctgcatgaaaaatggggattatatgatgatttcattgatctaagacagttaactagacatcagaatatatcttcacttcctaagttacccactggttattgattctatgttggttgatctataaggaggcatacatttgttaatgtactccttactcaacattactaattacatttttactttaaaaagcatcagtgcttcttctcttactatatggaaattaaagattctttttgcaattttgtttcttattctttctacattctgtaatgtattagaaacatgaaattactcctttgttcttcaggaactgttcatttgaaactctccaacataaggatgctggggagaaaacattcctatgttttattttgataatgaaatattgtgtagttttaaagcttagacatataaacttcatgtgaacatcatatatatataaaaaatcatatatatataaaatatcatatatatacacacacacatgtgcacacccttgcatctaatttataaattctaagatagtcatgaacatacatttttagattctgtgacttatttggcttttaatgcaccacaaggtaaaactctttatactctgtcatatttttgtattttctacccacttaggggagactacaattatataaaagttgctataacatttttaattaattacttgactccaaataattccctgtaacattctaaatttaatcatttgactctgagtagattcgttcctcatttaatatctttgtcactttcccttcaaattctttctactgttctttactttgggcttacttttgctgtgcctctttttcttcatttctaatctactatacattctttttttttttttctttttgagagaaggtctcactctgttgcactgcagtggcgtgatctcagctcactgcaacctccaccaccggggttcaagcgattctcctgcctcagcctcccgagtagctgggattacaggtgtgtgccaccatgcccgactaattttggtatttttggtagagatggggtttcaccatgttagccaggctggtctcgaactcctgacctcaagtgattcgcccaccttggcctcccaaagtgctgggattataggcgtgggccaccgcacctggtctcactacgttacattcttaatatggttttgttagcactctctgtgccaaaatcctattttcccctcttttcccttaggcagggcatgcacagagcagatctatttcctaccaaccttttttcccatggcacacacagctgccccttggcaataagatgcagtccctgactaatgcagcattgctctctgaagattttaatccagctttcttagtctcacctagctttatgaaaaatgagaggctagatattttgctgtttcttactaagatttgcattgctcatactataggtgccctgtgtaattgctctaacattttctcttcacacaagattatccagtattctctcttatcctgcctcatccttttccttttctgtagccagttgttatgaaaggggtggccatggcagacactgttgcagtgtaatgtcaaatattatatatttaatgtgcatgtgcccgcatgtgtagttttggtttttttgttgttgttgtttgtttttggagacagagtctcactctgtcacccaggctggagtgcagtggcacaatctcggctcactgcagcctctgcctcccaggttctagcgattctcctgcctcagcctcccgagtagctgggactgcaggcacctgccaccacacctggctaatttttgtaattttagtagagacggggtttcgctatgttggccaggctggtcttgaactcttgaccttaggtgatctgcccacttcagcctcccaaagtgctggaattacaggcatgagccactgcacccggccatgtgtagttttcaaaagagccatagataggagtcgacatttgaaaccattcaaaatgaacatttttttaaatgccaacagaatacttccctgaaaaaaagagccacagatacttgttggctttctttctttcaatttttgtgatgacaaagctgttggatttgacttttgagtagtaagtttatcctcagggcctttaataacaccagcatggaatcaaaattaggagaattactggactttggctatgtatacaccaggtttgtgactgttgaacaggatgatgtttgagaagatttactgaggttttgggggtatcttccttccctgcattttggccagtttcaagtcagaagtgggcagagcctagttaattgcaatggaaaagggcaaaccaggagccagcagctggagaaccaccttgagcactggcacatagagcacagttgctcagcatggctggtgtggtggaggggataactatgacatggtgtatggccaggggcagaggccgggaagcctgtcgcagcacagcatgttgcagtgacatgatgacaggaagcctcggagcaaatgctgtttggagatttgagggaggtgaacaggctgtcagcattgaggaaaactgtcagcagaccacagtgatgcaggcgctgggctgtaggtcagaactcttaaggattattaagatcataccactttagtagggctggttacaaggtaggataccaggagaggaatatagaaatgagggacaagacaggcaattcagaacacagctcacagaagcccggaacaagactggaccaaacaagttcaagtacaagctaaaagtcatgccatcattatattgaaaagatgtgatgaaaaagtaatgtacccactgactgattttgccttattgcttgggcatagtgagaaggccctctcttcctatcattgttttgataaaagaaaaaaaaaacaaactaccctggcacccatcagagctaaatgctgtctctacctgccttccccaaccagattcatgcctggtttgcttagggattatctgatgttactagccatgtctcttcttgcctccactggcatggaaaatctgggtaaccacaagcaaacttgaccagactgctaccaatgcctgaaactgaatattatagtacaaccgtgtgacacattcaaagatgctgactgctgtggaacactgaggcgcaacagaacttcacgaaaagaaacttttcagtgcaccctctgttagccaactctttttgagtgtgcttgcaactgtgctgttgatgtagagcgaattatatgtttaattttgatcccaaaccataggtagatgcttaatttttaaaataggcagatagtgtctagaaaattagtagagaaaagtaagtttaagctaaatataaaaacaatgaacagaatgtttcctatttacatgttttgtttactttttgtctaaaccagagatgagcaaatttttctaaaaacaaaaaaccaaataaatattttaggcttagaaggccatatggactctataataggtattttacatagtccttgttgtgtgaagcagcaatagacaatgcatacaagaatggtcatggctttgtgccaataaaactttatttacaggccggtcacggtggctcatgactgtaatcccagcacttgggaggccaaggcaggtggatcacttgaggtcaggagttcgagaccagcgtagccaacatggtgaaatcctgtctttactaaaaaaaaaaataaaaaaattagcttggcatgatgatgtatgcctgtaatcctagtgctttgggaggctgaggcatgagaatcgcttgaacctgggaggtggaggttgcagtgagccgagatcgcaccactgcactccagcctgggcgacagagtgagactctgccttaaaataaaaaacaacaaaaaaaaactttttttacaaaagcaagcagtgggccagatttggactatggaccatagtttgccaacccctagtctaaagaaaacagcatttctactcacaaattttatatatatatgtgtgtgtgtgtgtgtgtgtgtgtgtgtgtgtgtgtgtatagtactgtttctgttgaacagataaaaccatatattcatggtagctgcagaaagcaaaagatacctttaagtgacttcctcctttttaatggataatggcaatatttattattttgatttagttaaatatttattgctgagtaccagttatgttcttattactcagtattaaaggaagattttaaaactcctggcagcctctgatctccaggagctcatagtataagagagctaagcaataatattgcaaagcagtaaaataagcataatacagagagacccatgtgcactgggacagtttggtcttcaggaggaggggtggatctagatgagtcctgagggccagcgcatatttctaaagacgggagagacaggagagcatctaggggagaggtgatgagaccaggaggagcatgaacaaagattatacaatcagagaaaacgaatagttaaaagaaagcaggtaactaggctagccagggcaagatgatcatgctggctgtgcctcttcaccttcatccataagatacggagagtaacagtagcttcctcgtagggctgtcatgaaaatttagaaagttaatatttgtaaaattcctggagttgttcctgacaaagaatatataagtatttgtcaaacaaataaatgctggaggtagaggtggggattggttgataagatatggtaagatggagtcaggttgaggacaagaataattttccaaaaacactttgatgatgtagctgtatagtgagggacctgtagtgtccactaccttcaggacaatagccaaactcccaactaggctttcataattgtcccctgatcccaaatgagtgatcagtaagtgaggaatgtaaaaggtaactcctgaggccaggcactgtggttcacgtctataatcctagcactctgagaggccaaggcaggaggataacttgaggccaggagttcgagaccagcctggccaacaataatgagaccccatctctacagaatattaaaaaaaattttggtctgagagctaggagcaagagcttagggaaaggaggaataagaggaggtagttggctaccaacagacatctgaattcttaaccaatgaagagaaaaaatgtaaaagtggtcccagccgcttgggagaatgaggcaggaggattgcttgagcccaggaattcaaggctgcagtaagctgtgattgtgccactgcacttcagcctgggaaacagagcaagaccctgaaaaaaaaaagagagagagagagaaagaaaagaaaagaaaagagaaaggtaactccagttccagcacacagtgccactgcaggagtgaggaagccacgtgggagaattattttgtgggaaaagctgaggaatgcttttgcacatgttgtattggaggtactggtgcccaagtggagacagcctgaaggcagagggcggcttgagttggggctagagatggacacttgggaaccatgagcacagaagagaccacaaacatgttgagacaagggaagcgggcgggagaaagagcagggcattgagtcttgaacattgctcacaccttcattgatttggaagagacaaactgctgctgtcaacccaagtttggggtaggcggaaaagtggatacagagattctctacctcctcttacttgggaatgtaagtcaaatgtgagtttcatagcaggaagagcgtgaagttgttaagtgcacagtagtccatgagaacagattttcccatcttgagcagactctgcagagccacaaacaatgccgccttatgagctctggtcagtctggtcatgggatacctgtggggatttctttcctgtcggagcagtggcttccgtgagacttggcaaagaggctggtctgaggaatgcttctggttgtgggtacattccagcccagggtggtgtcccagacattttccttttaatgaagccccagcttttttctcccttttgctttttttttttttttttttttttttttttgtaatgaaagggttgttacaagggaaatacaatggggccctggctgtgtttcattaacttttaatttaagctgttagtatggaattagttagcagacttgtgaatcaattagctagccagtgggattccattttaacaaggggagcactgtgcgctctcggatgctagctatgtgtgtgaatgcggagtttaaggagcttcgctgtttgttcgacatccgaaagtgaatcacagtccttgttcctgcctcctctactggttccaagttcactcggctagaacatgctgtgcatcacccaacccttatcttctctacaaatacaaatttggattactgaataaatccagtggaaattcatttttcatgctgatgaactcaaagactttcagagttaaaccaaaacaatgcactcggaactatagtgaaacatttgaacatttaccctttgatccagagtttccccatattctgggaagcagtaactcctgggcaattctgcagtcttctgaaagttctatataagcttaattgtccttcctcatttgcaaaccccaccttgggtttgggaagatctgacagctgctgtctgggtttggcgtacttaccccgttactggttgagaggagacccagttaacaatttcagcctcaaatttaaagtccagtcatctcaaaggaagacagtgacataacagggaggcctagctggctttaaaataaagggagaggggacagagtcagttctaataaactgtagagatatatatatatatatatatatatatatatagcattttaagcccaacttgaagaaagttgctgaattagcatcagaaagccacagaaaaatgcatagagggagagagataggcttgtgattcacattaatattttgggcaatggaatacagtgtgaccaataaaaatgattcaaatagtatgatagaagtatactactgtcggccgggcgcagtggctcatgcctgtaatcccaacactttgagaggccgaggagggcggatcatgtggtcaagagattgagaccagcctggccaacatggtgaaaccccgtctctactaaaaatacaaaaattagctgggcgtggtggtgtgtgcctgtagtcccaggtatttgggaggctaaggcaggagaatcgcttgaacccgggaggtagaagttgcagtgagccgagatcgcaccactgcactccagcctggcaacagagtgagactccgtctcaaagaaaaaaaagaagtatactattttcatagaagtatacttattggcatagaaatatgtttacctgtcaggtatggtagcccatacctgtaatcctagcactttgagaggcctaggccagaagatcgcttgagcccaggagtttgagaccagcctggacaacacaggaaaaccctgtctctacaaaataactttttaaaaaaattatccaggcatggtggttcacacctgtggtcaggaggctgaggtgggaggatagtttgagtgcaggaggtcgaggctgcagtgagccatgattgagccactgcattctagcttgggcaacagagcgagaccctgtctcaaaaaatacatatatgtttatgaatattggaacatttaaaaagcagtaaatatactatgaagtacaattgaattttaatttcagaatattatatgcacacacatatactgtcagcaacaaagaaaaaaactggatagaaaattataacactgttattaattaaaattgttatacaaaatttgagaacaacttgggggttataagaacatgaaaagctgtggtttgcaaccttcatagggtcccaaagcaagatggaaacatcccaatgggaggttaacacttgacaatcttataacaaggtctatatatcaaacttattatctatccatctagctagctagctagctaacttaccttctatccatctgtccagctattatgtatattcatgaaactcatttttaaaacatgggagataatggctctaaatttcaaagaaatgtttacaccttgccaggaaggttttcttttcccaagtcagggagtgaaagatgtctgctaattcattcgtgaacttatttacctattttttccacaagtatttattaagaacctgcccatcagccaggtaatcaggaatcctaagattaaattattagagtatttttcattgttcaagttttctcttttcagtcatattatgtgtgtgcctcctctgagcacaagagatcaagggaaactacttacaatcttgatttataataagtgcggtttatctggaagtagtattgaagttttcttacaattgagcattttttctagaagggtgatggtactgcattggtaagactatctaaacctgtgctgtcagcacagtagccactaaccacatgtggctatttaaatttaagtaaaaattcagtttctctataactgtagccacacttcaattgctgaatacccagatgtggccagtggctgtcatactgaacagtagagatataggacatttatgtcatcacagaaagttctcttggacaatgctggtctaaacctaattgctgagaacacttgtgtataaaaaggcacttttcacattttttctcttcattgcttaagaattcagaagtttgctgatagtcaactactttcttttattcctcctttccctaagctcttgctcctagctctcgaagcaataagcttttcagaatttcattatttgtcagcaccggctcgagagagcaggcatcaaagggccaacattacacacttatgtatgtttatataaatttggttaaatattaatttgaaatggttgtaaatgagatttcaggtttgcaacagcaggaaaaaagtctgtataacttcgctgtaaacatggtcattggcgttaagttgttaaactgtaactaatctggcatctttgttacgtagtcaagttccactgggttttgctgtgtagcatgcgattccaaaaatctcagtgatttttaacaagaaatattgctcactcccatagatagaaggtgaaatgatctcattcctaatttgcatttgagtagcaacctaagtactaaatcacaacccaggaattttccaaagttccttacaagtactttgaactggatctttccttagaaaaatgtgtagaaaaggaaaatacataatgactggttattattctactttctttgtgtttagaggcagcattaattttcaagtagaaattatatatatatttttaatgtgaagccaatctggaaaagctgcatgctgtataattctaaccatatgacattctggaaaaggcaaaactatagagtcagtaaaaggatcagtggttgccaggagttgaggggagcaggagatgaatagggagagcacagaggatttttagggcagtgaaatcgttctgtgtggtactgtgatgggggatccctgtcacgatccattcgtcaatatccatacaatgtacaacaccaagagtgaacgctggtgtaaactgtggactttgggtgataatcatgtgtcatgagggtcatcagttctagccagcgtaccactctggtgagagatgttggtaatgggggatgctgggcatgggtagggacggggaatacatggggaatctctgtacctttagctcatattgctgtgaacctaaaactcttcttaaaactaaaattttaaaattaatgacaataaatgaatttaaaaataaatgaattaaaaaatctattttaaaattaatggcaataaatgaatgagtaaagcatgattaatacatatactaccacccagatcaaaagaatagaaccttgccaccccaacttcatatacttcttcctttttgcaactctccgcaccttgagaggtaaaccagaatcctgactttcgtgataaaatttcttttctttataattgtatgatctatgtgtacatttctaaagcaatataatttagttttcctggtttggaactttatataagaggaatcatgacatacatactctttcgtatcttgattcttttgttaaaatttcatttttgacactctcattcatgtcttttagtgttggtgagcatttctgtaaattttggctctaactagaacattataccatctttaagaggagagctcagatcaatgcatgctactgtgcaatgggaagagttggggcaggaggaaaaatatgaagaaaatgttaaccagtgtatttgatttgttttaaaatacatttattacttctgtaatttttgcaagtgtataattttcctaggttctaatgcagtatatagaaaagacatttagggccgggtgcagtggctcacgcctgtaatcccagcactttgggaggccgaggcaggcggatcacaaggtcaagagattgagaccatcctggccaagatggtgaaaccccatctttactaaaaatacaaaaattagctgggcgtggtggcatgtgcctgtagtcccagctacttgggaggctgaggcaggagaatcgcttgaaccaggaggcagaggttgcagtgagccgagatcgtgccactgcattccagcctggcaacagagcgagactccgtctcaaaaaaaaaaaaaaaaaagtaggaagtaatgctgataacttgaacacaaacactttcgtattttcatttcaggtttaaagtattcatatatcataatttaactcactagcagagtgtacttaccctgcagtcagacaatttcctctctctttaaggaaaaagtataatctaatctggtaggggatttttcttttatttttaacttaacaccgtgaaaaatcaaaacactgtccttgagaaggcataatttttgaaatatgcaaatttaaacggtatcttccttttaagttgtgtaaaaacaagacttttgcctaagtgtaagaccagaattttgcaaaattctggacctgcctctctggcctgcctctctccggttttgtgtagggcagcaggaggcctggcaacgtgaatgtctccaaatcctacttctgctctaaactgagattttgtggtttcttttttttttttttttttcttgaggcagagtcttgctctgtcacccaggctggaatgcaatggcgtaatctcagctcactgcaaccaccacctcccgggttcaagccattctcctgcctcagcctccccagtacctgggactacaggcatgtgccaccatgcctggctaatttttgtacctttagtagagatgggatttcaccatattgtccaggctggtttcaaactcctgacctcatgatctgcccacctcagtctcccaaagtgctgggattacaggcctgagccaccatgcctggcatctttttttttttaatgttagaatttaaaccatctggaatttatattgtcatctaacatgaggtacagattgaaatttatttttccctgcagttcattgaccaatctatgctttctcactgatttgaaatggcacctttatcattctcgaaattattcatgcttatggctctttctgatgttctgttctatgctgttgtcctctatgtcttcactttagccagtgtcatgctgttttaattattgtacctttaaaatctgtcagcatctgctagcagagatactagcatgcatacacacacactgagtattcctctcttttattactgtttattatcagataaacttttgcatatatatgttaatttcagaaaagtattccattgtgattttgagattgatttaaaattaaaatttgattttgtggagatttgacatctttagatcactgactcttaccacccatgaaaatgactctctctccattaattctaaccccttcaataaagttttgccatagtcttcatatagactttgtatattcttattccatatccctatgttataacaggcatcagacctatcatttgacaccaacagctggcatccaagaccacaggaatgatgcccaaagcagtctacacccactccccactagggcccaggaggaagtgtgtttgcagccctgacctaaatccacttgtacctttctctcctctgcacagtgacctctgcctggccaaagccccatggaatgccctaatcacatgtccctctgcagaatagtcctttctccaaaatgatccctcttttattccaccaccaccataagtcaatctctagtttcccctctgggaccctgtattactctgttttcacactgctataaagaactgcccaggactgggtaatttataaaggaaagaggtttaattgactcagtactgcatggctggggaggcctcaggaaacttacaatcatggtggaaggcaaaggggaagcaagtaccttcttcacaaggcagcaggagggagaaaaaagcgcaggaggaactaccacacacttataaagccatcagatctggtgagaactcactatcacaagaacagcatgggggaaacgggccccatgattcaattacctccacctggtctctcccttgacacgtaaggattatggggattacaattcaagatgcgattttgggtggcgacacagccaaaccatatcagatcctgatagattttaagcttggtgttgattatctgattgaaataattctgaagattgttttaagctcctagacaacaaactatgaacaaagctgccttctagagaacaggatcaggaggttgggggaaggatactttagatatttccttactgttttgtgtcactttatgtctccaaataagtacttcttttataacataaaatcttctaaaaaaaagcaaacaaacaaaaaaaactgctttccccctcccaagataagttgttttaaaggaggaactattcaaatgaatacttagtactgaacagtcattcctatcttttgggaccaaggaactcttcaaaaatttgatgaaaatggtagacactttcctctgaagaatgcacatatgtacatagctacaattttgtgtaggatttcagaaaataaaaggctgctgccctcagcagagattcgtacctctgtataattggtttctggtgaggtacacatcactggatcaagattcctgtgggggcttctggagtccccagcttccttgtcacacctcatgtcgcatcacggagcagaggctgactcccaaaagttactcagcccctttttagaataagaatagcctcagaacagggttcctttaaaaaaaaataggagagtaattttacatgacacctaatgagttgaggaaaacagaactaacctagggaatattgccaagtaaaagaagtttgtctttactccgcagcctcccgtgtcccccactctgagtctctctatgactcttctacttcctctcgcctacccaaaatcttggcatccttaaggtgcacctgagtcctctccactccaagaagctttccttcgttcctcaactcaagcctcccactcgtcaaactttcccacaaaagtaacccaaacagaagagagaggtgagcctgtatagcctgggaactctagggacaaagttcaaagtagtcttcgcaatcaaggaattccactccaaaacacatctgtgtgggaggatgctgggtgtgtgaatccagcagataaattctatttaatcttattctttttttttctttttttgttttttttttgagatggagtctcactctgtcacccaggctagagtgcagtggtgcgatcttggctcagggcaacctctgcctcccgggttcaagcgattcttctacctcagcctcccaagtagctgagattacaggcgcaggccaccacgcctggctaatttttgtatttttagtagagacagggtctcaccatgttggccaagctggtctcaaactcctgacctcaaatgatccacacacctcggcctcccaaagtgctgggattacaggagtggggcgtatttttaaatgtgcgtaatacatgtatgtaatttacaagtaaatatacctacatattttatatatgtgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatgtgtgcatatatatcacatatatatacacacacatacatatcacagtaaaaatatagaatggagaccagtgctttacctgaatactagttaaattacttaactctgctttcctgctccctcccacctcaccccaaatcacattgcctcagaaagaagggtagagagtatttaagtgagaccaactgagtttgaatcctggctctgcgactcactagcatgagatgacttaacccttctttaagcatcggtttccccatctgtaaaaagtgggtgacaaagtggggttgctggaaggatgtaatgggtaaagtgatcaatcaacattggacatgtcgaacatcataaagatacgcacaggaagagcacagcccatctttccctcccacagtcgttatctcctaccctgtggttctttctctgcactgggtgaaatcccaagagacctcatagctttctagtagctttcagatagaagtcttcccatcagaaacagatcattctcagtatagtaattaaaatcttgtctggttcagtcatctaaacttgggtctaggcctaggtgaaacctctccccaccctcacactattccaggaaggccacgttctgcctagggtatccaccggggaggcacagggttggcctcctctctggctgtccccagctttctaggggctgtttctcctctaggtgcagtggcacggctcctcccgtcctcagcctcgacggaaccccttttccaggggttctccaggcccgctcctccagctgccctctcagttaggttccctccccctgcaggatggtcctgtggatggagttcctgtgatagtgacccggtaggctccttccaggcccacctggcctgaggcgaaactcctgcatgccctatggcctgtcctcgggcagtgagagtgtcaccctctcccacctgcctgaaattccaagggacttactcaggccctctaaggggtcctcttgaggccctcccacttcactgaaggtgaggggaaagcaatcctctcctcccccagggtggaagacacaacacacatgcgcacacgcatgcgcgcgcacacacatagacatacgcgcagcgcacagacgtacgtgcacacgcacacacacatgcacgcacacacacacgcacacacacacacacacacacacacacacacacccctctggctgcctcaacccctctttcactagctagaggggttatcagtggccaggctagcagaactgatttctggctctgtggacataacctacacgtccgtcttttagcctctcggtatggtggcttagccctttccttcagtgggtagagtgttcagcatctgtcttactgctcacagcctgtggggaatcagccaaaagtgaggctgaaagaattgccatgtaatatctttaaccctgtgcttagtaaatagtaaatgctcaatgaatattagcgatcattagtagtagtggtagtcatagtagtgtgttttcttatggtcttactctgtttgggctgctgaaaccagccattatagactgggtggcttataagtaatagaaatgtatttctgctagttctggaggctgggaagtcccagatctaagcaccagcagattcagtgtttggtgagggttggcttcctgcttcatagaaggctggcctctcactgtgtgctcatgcggtggaagggaccgggagctctggggctaaaactctcatccatgagagttccacccttgtgacctaatcacctcccaaaggtcccacctcctaaaaccatcacgccagcaattaggatttcaacataagaattatagggacacacaaacattcagtctttagcaagatctcacaatgtctgcactatatatagctttaccaccatttgaaaagtacaattcctgtcagtgtttttggtaacccactgttgtgaaatcaatttaaaggttcttgagtggcaatttgaaaatgaaatcgaagagtagaaaaaagaatagaaaaatcaagaatgcataataggtgttgtttggaaaatttgtgatttaagataattaagtatatatatgttgccattttaaatgtatgtattatattggttgctgtcaacaaaatatgaacgctacagcatctgaggttttccagttgtccaccacaatgattaacatgtgagaatcttcctgaaaaagttcaatgattaacatgtgaaaatcttcctgagaaaagttcctatgtggatgagctctaaggaatgaatatagaatgttctattccccacaggtctctgcagtgaatacagttaattgggagctaatcatgaactgctttatatttttccctaattgtctttttttttttttttgagacagggccttgctttatcacccaggctggggtgcagttgtgtgattatagctcactgccacctcacatttctgtgctcaacagaattctcccccctcaaactcccccgtagctgtgaccacaggcaagcaccaccacatctggctattttttgtacttatttttttttatgtttaatgtttgtgggtacatagtaggtgtatatatttatagggtatatgagatgttttgatacaggcatgcaatgtgaaataatcacaatgtgaaatcatggagaatggggtacccgtcccctgaatcatttatcctttgtgttacaaacaatccaattacatgcttttagttatttttaaatgtacaattaagttcctattgactatagtcacccttttgtgcagtcaaatactgggtcttattcattcttctatttttttgtacccatcaaccaccctcacctcccaccttgccccccactgtccttcccagctctaactaatttttttagtatttatggagacagggtctgccatcttgcccaggctggcctaattgtttcttgagaataattgttgtatcccccaaacataaggaggagagaagtcgttttacatttctgatgatgctttctcagagcccagtgcaaaggagaacaccagtcactgctggcgggtgtctgacattcagtttggctgtttcacttgtcctgtgatagctaactgatcttgctgtctcatcatgcattatttgcacgattggcagttattaaggtacaccaggctagaagggagtccatctggctctccgctgggccctgtactcttggcccaggatctgaaccatagcctatgcttaataaatatttgtggaatgagtaagaggttccatctatgagatgaaaaccactggtggctgataagtattcaaatggcatatcttctgtaaatgttacagaacgtcaatgccattaggtgcttgaagagaagtttaaaaatattcatatgcaggaaatgagatcatagaatttctcataaaaatgcagtttgatcaaattgaggggatggatacccacttaccttttcatagtaatagtaaatttgttatagaaaacacattttaccttccttgtctcctaattcgaggtcatgtgaagcttagctagaaggagcaaagtacattttgttctgcctgaactgtctctagtgaatacagttaccctgggctttattatgaatacctggcctgttccacaaaagcaatgaatagtgcttcaaggaagaaattttacttgttttatttcccaagaaactcaccaaattgagttgtctctactttcctttcaaaactataactaagtacagtagtaatgtcaggtcacttatgattttgacctgtgccaatctttgaatatttgaacatttttatctcctgaaaaattacttggcttgagggagacacagttggatgagcaaagaaaaaaagaaacaatcaaatgattttctgatgctttcgaatgttcataggcttgctttgaaatccctctgtctatatcaccccatcctgtttttgacttctaatctcctttaccaaatactatgtagcaatattttgtgagtcatccaaaagttgagtatatttagaccaccgtgacaatcaaacagtataaacagaactactcatctgtctgttcatcatcatcccacgcagggagttaattcctaataaaggagtttatcagatcaccctcaattacatcactttgggataatttcatacccaaggaaatttgaggcatttttgccttggaaaagagcaggtgccttacgaaaaagaaactagatttgtgagaactgggcttatgtttcaaatttatattctcaactttactctgaagagatggcttggaagaagtgacggtaacacagaattgccagtttgcttggcaaggtcaaactattccatatgttaccttgcaagaaaaatatgttaatttaaaaaatatcagagaccaaatgagaagttgaacacacagctgatttagctcagatttttgtttgttgttataccgattgccatattagctccctcttctaccacctcaaccccacccccaccaccatacagctgctcgcttgctcgttacaaagcatatttccccctgtatattaatgtcatattcagcaaatcaggaaattttgcaacttcccttctgatcctaatctggctatttttcttgagttcagtgtcatcaaatcagaaccagacacttttgttaagggtatcacattcaaaattgcacacaaacaagccccaccttatttttatgaaaagtctgcccagttacccgctttgtcccgacactaatagagccaaggctcagggtttgcaatgtaaggaaatgtggagtacattccagcatgctttctatgatgagtagatgtttgatagtacacctcacttatctgtgcctccccagttggggagcctttttcttatctaaaaggccttgccatatcaaaggtaaggatactgtttggtaaattcctctaaataagaatgccactaggagaaatttaaattatatgtaaaggaataaaagttgaaaaataaagggttttttgtttgtttgttttgaaaagttggtttcaaacttaaaaatttgcaagtgtcattttctgaattgtggaaatagagtaaaatttatcatttcttataaagttttaacattagaaaaaaagcttcttatgactaaaactaaggcatttggtaaaattttcttaccgcttctactataatatctatttctctttagatagataaagatacagatttgcagtaacattggaaagtaagtgaaaaacacagaggaaattaaaactttactataacctacctgtgtagaaataatcactgttaattttaatgcataaatataaatttttaaaaagtggaaccgtattgtaaactgatttttatcctactaaaacaaacattaagtatctgctgaaatgttttaaattttttcaaaatatatgtattttctgactcatttgctataatacttaactcattgctgcccatgtaaacttgaactgtctcatttgttaaagcgtgagagaattcatagttaattctttgtacagctaaattgttcagtaggaaatgcagaaagaagtgttaaaagaaaatcttcagccaaatttaatttaatttaaaagagtttaattgagcaatgaacgaatcatgaatcgggcagcccgcagaatcacagcagattcagagagactccgggggtgccttgtggtcagaacaaatttatagacaaaaaataataataataaagtgacgtacaggaatcagaagtgaagtacagaaacagctggattggttacaggtcagtgtttgccttatttgtacacagtttgaatacttggcagtgtgtgagtggttgaggtatggctgctgggattggccaagactcaaccactgttacagatgcaaacttttaggctgtcaatcttgtttacctattaagttaggttgcaattcatccacaaggactcaaatacagaagtatagagtccttctcaggccatatttagtttgttttaacagacgtagaagagaaaacccttgttctttgctttgtccagggtagtcagctgattggaaaggtaaccgaagtctctcaacatcaaaacatttctaatgcaaattctttaagtcgtactgttcctactcaccttgaacttatgagcaaatcccttatcaattgtgctaccttttattcagataatgaatttgggaatagggtttggaattcaagtcccatagcttagaaaagattgagtacctggcaattcagtatagttgtggattgcaataattcctgtgcttgttaagtaaccaagatttttgtgtgtgtgcgaaaagcatgtgtaaaataattgacaatcagcacttctgttggatagatgggttcctgaaagagcatatgtgaataaattttggtgtatctgatgctactttcctgttaagctactatggaaattatcttaaacattatattcttttccctgaggcagaaaatgtaaataatacattcccacaggtaacaactataactatttcctatgtatgttttcaaaaatggttcatgcacttacgagcatttgtgtactgtatgtattcatgcacttatatagggtaccctaagagatgatttttacatgagggcctatcacacttacatattcttacttcttaagggaattcaaaggtagatactttgttgtccctaaaaaaggtacatgaagatctatttccctcttatcagaggcaggcttcatatctgtagtaaaggagaaaaatatagaacatttgctttaaaagttcctctttttataaataatacttgctaacttttatgcttctgttttataaggaatttcttccttgtgctatatacaaaagttgcttccaggtggattaaacaaggcataaaaagataataaaggaaaaatttgataagtagttcaaataaaaaaattctgatcattaaaaggcaccctaaggagtattaaaagacaagtcatagggtggaaagtatttgcaacttatgtagacaacactggaccagaatatgtgggttacaaatggaataaataaagaactcgtacaaatcaatttttaaaagctaccaggcaataaaaaataaataagtgaaaagtagaacagccacttcaccaaagagagaattcaaatggctaataaacatgaaaagatgttcaatctcattaagtaataagaaaaatatgaattaaaacaacagagataccattacacacccatttaattggcaaaaatttaagcctgataataccaagttctggcaaggatgtgaagtaacaggatatttcatatactgccagtgggagtataaattgttaaaaaccacgttggaaaagagtttggcataatttgataaactcaaagttatgcaaactctatgacctagcaaacttcactcttgagtatatttctcaaagaaatgcttacatacgtgcacccagagacacgtaacccaaatgtacatagcagccctgctcataataaccccaaactggaaatattccagaagtccatcaacagtagaacaagtaaggaaattgtggtagagtaattcaattaaatattattcagcaattaaaataaatgaactatagctagacgaaacaacatgataaatcttacacacataatatagaacaaaagcatacagacaaaaagaatacagtcagattccactgatataaagctgaaaaaggagggagaaaccaagtaccttgctcagagatgcataactgaatagtaaagttagaaagaaaatcaaggaaatgataactctgcaagtcaggattgcggttaccctgggaaaacccaggggtatgagggggaggcacacacaggaatcttctgttctatttttttacctgagcagtggttacaatctgggtgtttgctctataactctttgttaaagtgtaaaatttttttgtttgtttgtttgtctgagatggagtctcactctcttgcccaggctggagtgcagtggcacgatcttggctcactgcaacctctgcctcccgggttcaagcgattttcctgcctcagcctcctgagtagctgggattataggcgcatgccaccacacccagctaattttttgtatttttagtagagacagggtttcaccacgttagccaggatgggctcgatctcctgacctcgtgatctgcccgcctcggcctcccaaagtgctgggatcacaagcgtgagccaccacgcccagcctgtaaatatttttttaaaagacgtgcagatagaaattatcttaaataattgcttacaagacaaagagaacgacctgcccccaagtcccccagataaagtaggatatcactaagaatccacacccaagtaaagtaattaaaggggttaagatgtctctccttttgtgattaacaccccgtcgtgcttgcagaggcaccgctgggtgtcagggaacctgcctgctgctcacctgaacaccccataaataacaccagctctaggacatggtccatgtgaacaaatgaagaatctctccttcagccagagggtgagagtggcataggtaacaactagataatgcttggctctgcctttttcttattgatttgtaagagttctaattgcaagataggctgagaaaagtagtctagccatgttccatgaagaagagaacatggaattaggttagtagctagcagcctcagccacaataactttattttgtttgtgcactcatcatttaagaagtatgtgagagcctacaaaattggggagttacttctcgggaatgctccattgagaaaaactgctgcctcttttatctgtgtagtcaatatcatggcctaaattctagaatcttctcacatagccagagtttagtgatcaagcaccacaaaccaagagatattacataacaataggatcgctcaaacaaatctacgtgaactaggaaactgctttttggctcactcagaggtacaaactttacacccactgaaaattgtcccaggattggataaagaaaatgtggtacctatacaccatggaatactatgcagccataaaaaagaaatcacatcctttacagcaacatggatggaactggaggtcataatcctaagtgaattaacacaagaatggaaaatcaaatgttgcatgttctcactttcaagtggaagctaaacattgagcacacatggacataaacatgggaaaaatagacactgcagacgactagagttggtgcggggaggacatgggttgaaaaaatatttttcaaatgtaactactgtttgataaaaaggaactatgctaaatgaccacttctcccagctaaaggcagaccatctacattacatttttttttttttaagacggagtttcactcttgttgcccaggctggagtgcaatggcaccatgtcggctcaccgcaatctctgcctcctgggttcaagcgattctcctgcctcagcctcctgagtagctgagattacaggcatgtgccaccatacccggctaattttatagtagagtagtagagacggggtttctccatgttgctgaggctggtctcgaacccccgacctcaggtgattcacccaccttggcctcccaaagtgctgggattacaggtgtaagccactgtgcccgggctacattacatttttactcagttaagagcaaacaataataggtgaatagcagcctgattctgtatgttaaaaatgattggtgattgaatctcaaatgtattagtccgttctcacactgctataaagaactacctgagactgggtaatttatgaagaagagaggtttaattgactcacagttccacaggctgtacaggaagcatggctgcgtggctgggaggcctcgggaatcatacagtcgtggtggaagtgtgaaggggaagcaagcacatcttaccatggtggagttggagagagagagagcaaagggggaagtgccacacactcttaaacaaccagatcttgtgagaagtcactcactatcatgagaacagcaaggaggatacgtacttgcatatatactccctgaatctaaaataaaagttgaaaaaaattttaaaaagaaaattgttgggaggctgaggtgagaggattgcttgagcccaggaactcgagaccagcctgggcaacatagaaagaccctgtctctaccaataatcaaaaaaattagctgggctttatggcgcacgcctgcagtctcagctacttgggaggctgacatgggaagatggactgagcctgggattctgaggctgcagtgagctacgatggcgtactgcactccagcctgggtgatagagtgagaccctgtctcaaaaaaaaaaaaaagaaaaaaggaaaattgtccaaggaatttaaaaattttcattttggctctctcatgcgcagtaaccgtgagggtttaaaggacagtgccagggccccatgttgttagagagcactctgttgtctttggcatgggagaggacttcagtgcaaaacggtgtatgaagtgtgttgtcagcagaagctaatttacaccctgtgctggacggagggttgcttgtttggagttgtttttcctgtggctaaaggattcctgggaatgctgttcaggcatgtctctgctggtggtatgctgtcatccttttcttttccatttacagtgtagagctgttacagttgtaaacaggcctggctttttacattgttactcactggtgtgggaacaatgtatgttaatgacataagtactgcccttgagagtactgcccaaaacagccccaggttgaaaatgtatcctcacagatttaatttttcttataaaagaaagaggtatgttccttctgtgtagagcgaactagaaatatattaaccctgcaactaacatgcagcacttcacaactcattagtgaggcccctgggatatggctccatatatttgcccacaagttggtataggccagaaaccagctgctttttcacctacgtggtgagagccagaggccagtcaaggaacaaggaactataggagaggaactacaaggagaatcttcagattttcaagcctattattgttcaatacatagtagtttaaaaaactttgacagttgtacttaaagtcccttctcatcctatgagtctctgcctctgccagtatgtgatgtttctggctcatggtgatgacaaattcggatgcaaaagtaaacaaataggcccccatcagcccatcggggcagcagccctaggcagtgacagttaaacagttgcaaagacctattttcagaggcatgtacccacacctgacctactattaagtaagcatggaaattagtatttctgttggctttaattaagtaaatattatagtttgatccacaacaccaaatctttgtcaatgtcctaaaagaaattgttcttttcaccacaagagttatgtattcagagtaaaaatgggtagatgtatattttctctgtgaaggaaaagaactggaaggtgcttattttattccaagagttcccaaagcgaggccgggtgtggtggctcacacctgtaatcccaacagtttgggaggccaaggcgggcagatcacgaggtcaggagttcaagaccagcctggccaacatggtgaaaccccatctctactaaaaatacaaaaattagctgggcttggtgtcaggtgcctataatccagctactcaggaggccgagacaggagaatcgtttaaacccgggagacggaggttgcagtgagccgagattgcgccattacatctcagcctgggtggcagggtgaaactctaaagaaaaaaaaaaagagttcccaaagtgagaccattactcaaaaatttgagatgggaggctaaattgcccctgctgtgtatttagagggttagtattgaataggtcaacaagcatttcctaagtctctaggctgaatttctaatacggtttcttagtaaccattctcttaaagaatgtgagatttgaggtaagctttgctttaagggagggacagatgtgaaccctaatactggttagaaggacataagagaagagagaaagtaaaactatttaaggaatttttttctctcatttaaggcccaaagcagcctttccttttctcggtccaatccgatgcttaaacttgcctgaatttcctctggggttaagttcaaactaattttcactgttctaagcatgcagggctcttgcacaacttcatgcctctgtgcgtgtgtttccaccagttggaatgccctttctcccacccacccctaaactcgtacatgcttatccttgcagagacctcctttgtaaaccaagaagcccccgactcccctgttacagaggtaattgctttggccttacctgttttacctcctggtaagttacagcacttagcaccttgcaattagaggtcatagatttccctgcttctctagaatgtgagattcttaaaggcagggattttatctcatttattagatttgtatcccatgtacctgacctagtatctagcacaacttagtagatatcaattaatgttcattgtatagtcctttgatgatgcggtttggccctgtgtccctacccaaatctcatatcaaattgtaatcctgatgggaggtaattgaatcatgggggcggacgttccctttgctattctcatgatagtgagtgagttctcacaagatctagttgtgtattttattatttatttattttttgagttggagtttcactctgtcacccaggctggaatgcaatggtgcaatctcagctcactgcaacctctgcctcctggttcaagtgattttcctgcctcatcagcctctcaagtagctgggattacaggcttgtgccaccacgcctggctaattttgtatttttagtagagacagggtttcaccacattggtcaggctggtctcaaactcctgacttcagatgatctgcccacctccgtctcccaaagtgctgggattactggtgtgagccagtgagcccagccaagatctcgttgtttaaaagtgtgtggcacttccccctttgctctctttctctctccaactccaccaaggtaagacgtgcttgcttccccttcacccttccaccatgactgtaagtttcccaaggcctcccagccatgcagccgtgcttcctgtacagcctgtggaactctgagtcaattaaacctctcttcttcatacattacccagtctcagatagttctttatagcagtgtgagaacagactaatacatttgagattcaatcacctatcatttttaacatacagaatcaggctgctattcacttattattgtttgctcttaactgagtaaaaatgtaacgtagatggtctgccttcagctgggagaagcggtcgtttagcatagatcctttttatcaagcagtagttacatttgcagagtactttttaaaagcaaaatatttgttcttattttcctggagtttacaacctatttgggctgacaagatgtatagagatgtgtgtgtatatatatatacacatatatgtgtataaacatgtatatgcacacacatttacacacatacatatatgtagtttcacttattctttcaacaaatgcatatggagtgctaaacacgtgcccggagctgtgctgggtgctggcacccgagatgcggactccacggtgcctaaccacaacacttcaatacccagggcgatgagagccagaaacaaaataagtaagataacttcttggtaagcaggaggaaggggaaaagattagaggagggtaaagaaagcaacctaagtaaaagttagaaggtacaaatgggcatggaatttgcaggagtggtgaggagattcatgagactaaaggctttagggagaaatttgggggccaataaaaagctatgagtacacacacacacgcacacacacacacacacacacacagtgaatgatactcagtttaacctaattcaacaagcacttcctgattcctgactgtatagaaagtactgtgcaacatattgagactcattcagagatgtttttctttctttcttttttatgtttttgagacggagtttcactcttgttgcccagactggagtgcaatggcgcgatctgggctcactgcgacctccgcctcgtgggttcgtgcgattctactgcctcggcctcctgaatagctgagattacaggcaagcgccaccatgcctggctaattttgtatttttaatagagacatggtttctccatgttggtcaggctggtctcaaactcctgacctcaggtgatccgcccaccttggcctcccaaagtgctgtgattacaggcgtgagccaccaagcctggcctcgttttttcctttgagatagagtttcactctcgttgcccaggctggagtacaatggtgcaatctcagctcactgcaacttctgcctggcaggttcaagtgattctcctgcctcagcctccagagtaactgggattacaggcatgcgccaccatgcccagctaatttttgtatttttagtagagacagggtttcaccatgttggtcaagctggtctcgaacttctgacctcaggtgatccatcagcatcagcttcccaatgtgctgggattacaggtgtgagccactgtgcctggcccagagattttgttttaagagaagatttagagtgtcaagtgctagcagttcagcgggaaaaacaaaacatatctcatatgtgtaatataagtactacatatcccagtaagcccatgaaaatataagaggaaaatataataatatatatgagaatataagggaaaatatattaatatatataagaatataaggggggccaggcacagtggctcatgcctgtaatcccagcaatttgggaggctgaggtgggcggatcacaaggtcaggagatcgagaccatcctggctaacatggtgaaaccctgtctctactaaaaatacaaaaaattagccaggcatggtgacgtgtacctgtagtcccagctactcaagaggctgaggcaggagaattgcttgaacccgggaggcagaggttgcagtgagccgagattgcaccactgcattccagcctgggcaacagagcgagactccatctcaaaaaaacaaaacaaaacaaaaaaacatatttgtgttgaaaattgagtagatacataagaggaagcacatccagagaagcttaacataaagcattgtattagtctgttttcacattgctgataaagacatacctgaagactgggcaatttacaaaagagatttattggacttacagttccacatgtctggagaggcctcacaatcatggcagaaggtgaaaggcacatctcacatggctgcactgttagagagcatgagagccgatggaaacgagtttcccctcatcaaaccatcagatctcatgagacttattcactactacaataacagtatggaggaaactgcccccatgattcaattatctcccaccggatccctcccacaacatgtgggaattatgggagtacagttcaagatgagatttgggtggggacacagccaaaccatatcaagtatataagcaggccagggattttaagcatttgcagtgggtggactaccatcttttgaaccaggagatgaaaaaatatcctcttatttatttaaacacagtgtcatttttatataccctatgtctaatacatccaatattggaagcatttgtgggtgagtttcttttgctgctgtttctcattcactttacagggaatggtctatgactagcctcttcacctcaggccagccttgggttttgtcttctgtctcttgttttcatgaggccatgaaaactgaagctcattctctagcttctgagaaattccctcagggtaaaacagctttaagtgctctgctttccactctgtgttcccacttttatttaaattttcccttataaatccttcttcttcttcttcttcttctttttttttttggagagacagggtctcaccctgttgcccaggctggagggcaatggttggaaagatatttctggaactcagaagagaggttaagactaaagacatgttttagttatccacctagagagaaacataaggccataagaaagaagaaatgctccagggaaagtcttagactgagaagagaggagggctaaagacagactctggaaaatgtctgtattcaagaaccagacgtggggctgggcactgtggctcatgcctgtaatcccaacactttggaaggccaaggtgggtggatcacttgaggtccagaagttctagaccagcctggtcaacatggtgaagccccatctctactaaaaatacaaaaattatccagacgtggtagcaggtgcctgtaatcctagcttcttgggagactgaggcatgagaactgcttgaacccaggaggtagaagttgcagtgagctgagattgtgccactgcactccagcctgggtgacagagagagactctgtctcaaaaaaaaaaagaaaaaaaaatcagacatggggcaaaatggagctgatgaacacagctaagaaggagtagtcagggaagtgttaatagaaggagggtggagagaacaatgtgggggcaaggagtggaggtcagcctctgaggaagacagggctcattctaaagattaacattctgaagatcttaagggggagcactaggaagaggaattagatttggtgtctcggtggctgctgaggactttctcaggcattttggtataatttgagaggaagaagcaagatcgtaagaggttgagaggaggacgggaaaagagagaagaacaggaaaagagcaagaatgggaaaagagcatatatagaccatgtttttaaaacatttggtgatgaatggaaagagaaagaatgattcttgatcaccaagccaggtcattgaaagatgttcttagcataagagaaatttgtaaggagcccattgacaagaggagatttgaggattgaaaattcaagataggctgagcatggtggctcatgcctgtaatcccagcactttgggaggccaaggctggtggatcacctgaggtcaggagttcgagaccagcctggccaacatggtgaaaccccgtctctactaaaactacaaaaaattagccaagcatggtggcaggcacctgtaatcccagctactcaggaggctgaagcaggagaaggtggtggtggttgcagtgagccgagatcgcaccattgcactccagcctgggcaacaagagcaaaactctgtctcaaaaaaaaaaaaaagaaggccgggcgtggtggctcacgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaaaaaaagaagaagaagaagaaaattcaggatagccaaagtatgatagttagatgtggaccctggaggagtctggaaggagtgggaccatgaccacaagttggggcttgggtagtatttcaagggaatggaaatacttcccctccaaagtcagaggttaaggacaaaaaaattgagtgctcacaggtaagctgacggagatctcctagatagaacagatgttgaaagacatgagatttggtgacttaaggagaatgggagagaacagcagcatttattacagtgaatcttccaaggaatcaactttgcacccaaaaaactaataagattgtggacaaccgaaagagttagaattgcctggattcgtggttcagccaacatgtaaagtgacatcccaaacatattcttcaggatccactctcagagcgtcttggtgtttttccagtactgccgtcatacctgtgttccctttccttttgttctctactagcacctggctgttttagagtggaattgtgtgtgtgtctgcttggaaggaaagattaatatcttgattctcttttgtcatgagtagataaggaagtgtatttttaatcagtaggtattcaaaaaatgtttactgctggccaggcatgatggcacatgcctgtaatgccagcactttgggaagccaagctgggaggatctcttgagtccaggagtatgagaccaacctggaaaatatagtgagacctcatctacaaaaattgtttaaaaaattagccgggcatagtggcatgtgcctgtagtccccgctactcaagagactgagacaggaggatcacttgagctcagcaagtagaggttgcagtgagccataatcgcaatcataccactgcataacagcctgagtgacagagcaagaccctgtctctctttctctctctctttctctctctctctctctctcacacacacacacacacacacacacacacacacatttattgaattgagagaaacaggaaattttggatattatggtggcttctgttcagcgttggatattaggggtgtcaaatggaagtataaaaaccatatcaaaatattgggtgaaggtgacagtcctaccctcgcctgtttcctgaaggtctgttgagtgagataagaaaggtggttgctatggagctgctttgggacttttgtttgacaatatagaaaaggccaaaagtataaagcaggacatcaaggaaaaaacgtatttccataaaagaagagaacatgaggtgagagtggttatgatgactgatgagaaacatattaataaatggctttataaaactctccttattctcttagattggcaagacaaagactagacttttgtgttagggaaactaaccacaaattgtggcctggagccaattaggattgttcccaacccccttgtccaagcttggcctccttagaaatacggcagtacagacgattagtaaggggtatctaagaatctctgctttctgtttattgcttcatgaaggtggttagcttaatttggtttgtcggggcactgtatacacagaaacatctcccttgggcctcttatgggtaattacagaatctgtcaaatagggctgatctgcctggagagacaaggagcacagcatctatggaacagggagttgggcagaaagtttagcaaagaagcctccaggatggcaatctgagtcatggccagatgtcaggcgagaatgcgtttccagcacatcgctgtgatgatttaagttacacactctctcctgcttgctagtttgcaaagattttccatctcaggagatatttctgcagctcttcctaagagtgaagacattctgagcatgttacattcacaatcaggcctccttgataagtattgagattcagagtcaaagttgggaaagcagccttcaattgtactcattcatgtgaagttttataatgaagagtgtatgtgtgtctctttttgcacttaaacaaaggtagggaagttgatggcaactattttccttctttccccatcaaaacctggagtataaatgtgggcgtggaaattagagggaagcctaaaatttgtactggtccccagcccccgtgtagattcatcagcgagatcccaggctgtttgaaagaatgctgggcctggagctgagggacctccccagaggcaaattgatggttggaatgctgctgcagaagggctcagtgtccctgtggttctttaagtctggaatttttctttcttttgaaaaacgtacttttggggggggcggaaatgaatttgaatctattttctaccacatgtttaatgaccgaggtgatgtattttttcctcaaattattataactcccagtaaaaattcaagcctgtagaaggtaaggaggagattatatgatgaaagtattattgattttagtggaatcatggaatttaacatatcttctttacttccaagttagtgcttttcactctacatcatgcccaacactttcctaggtaaacaagggctataaaagaagggcttttaatgtatctcttcccctgctttggagcaaggcagttacagaacaacaacaacaacaacaaaaataacattatctgattgattggttgattggttggttgattttagagataaggtcttgctctgtcacccaggctggagtgcagtggtgtgatcgtggctcactgcagcctcaaactcctggactcaagcaatccccccacctcagcctcctcagtagctaggactgccggcacatgccaccacacccagctaatttttaaaaaatgttttagagttgggggtctcactgtgttgcccagactggtcttaaactcctggcctcaagtgaccctcctgcctcagcctcaccagtagctgggattacagatgtgagctgctgtatgattctgtctcgcataattggatatattttaaatggtaaacttgatctgtataatatttggacctccctcaaaaaacaaatcattcatgaagctttggaaaggctattataaccaaataatgtgtgcataaggaaccttctccccacatctctgagccccttttcattatggaacctcacagcatccctcaggatatccctgagcccaggggaagatgagagtgggaggaatttcagtgatgggaaatagaatcaagttaaagtaaactctgaattcgatagagacagtgtgggatgaagcaacaacaaaaaaatgtattaagacgctatcaataatacattttgccagcatttttgagacgttccaaaccagtctcagaaagtttgagactgatcccaagaaaacaatgagaaaggttgagtctaagcctaaaattttggctgaatttggaaattatcagtgtgaaggctacacaccaaaaatataagaaccaactgtcctgaaagtttgggagttaagatttggggaaattatttgaaatcatttcaatctaccaattcctgatttttttgcactaagaattgaaattctgaatcccttaatttatgtatcaaatatatctaccagcagtgcagggacaatgagggtggaaatgcattaactaatagattatatggactgccttaagcaactgtataatttctgttaggatgaaaccgaaccatgttgggaattctgatttaaaatgaggtctgtactttatagatgtggaaaataaggttcataggacgaaattacttcctcaaaagcgacataactgcgttgcagcaaaaacggcaggagagtgcaggtctctaagccaagtcttggactaggttcttgattccaacagttctccagtgatgcttctgaagacactgggctgaaagtgaacagtgaccctctttcccgaatgtctataattttctcaatttaaaatttttctcctaaaagacaatggctattttaatcttttctgtttgtttgtttgttttgagacacagtctcgctctgtcacccaggctgtagtgcagtgacgcgacctcggctcactgcaacctccacctcctgggttcaagcaattctcctgcctcagcctcccaagtagctgggattacagttgtgtaccaccatgccttgctaatttttgtatttttagtagagacggggtttcaccatgttggccaggctggtcttgaactcctgacctcaaatgatccacctgcctcggcctcccaaagcgctgggattataggcatgagccattgtgcccggcgaatattttaatcttttagtgacctctgccatttttcttttcaagaacaagatgaatgagcaaatgtaaacattttaaaattaacttggaagggctttgacagatttcatttctcatggacatatgcttgtgactgtttcaatattgcaggcatacactagcatcattttcttttagcagaattgcttggtgctcctgtaatagaatgaagtgtaatagtgtgcaaacattcacaacttccatgtgctctaaaacctaaacaagtttgaacccacaagtcactttgtaaggcacatccaggctcgttgagattctaactggtggaaatagttgaaagtatatttgtcacttacaccttgcctatatccaagaaggatttgagtcttcctccaacaagaatgcatccaagccagtctaaaactgtcctccataaaatagggaaatacactttgggaatttcataagctaaacactatttccacattggtcaccatggtgaacacaaatatgcaaaatcgactgaatggtaacaaggcagggagagaacgtgcttcctataggatttgatctgctgcttattctgatcaaagtggaaactataaaggttggttggagcggatagcccaatgcctgcccagtaacagggctgcaggaattaacacggtggacgagggaaggtacagaccattttcggtggctaaatgagaaataatactaagcgataggatatcctgtatgtttagattacttgcctctgaaaacgagctccaattctttttcagaacaagtattgggaacaaactgtggatatttaatcacttaagggtactttcttctgggaaaatcgctcactcttaatttttcagttgagttagacaagggctaattgcaagaggattaaaaccttgaaaactgctttgttcagcttattgtttcaggtttccctttggagtgtggatgatgtgtttatttgacataatgaataccaccatccgctttgttccgggaaccaaaaggctatgtgcttgcccaaggaatttctcagttgtttatatgtaaggaaacactgctctgtgttattggatgggaccattacagctctttcttaaatagggaatgcagagagccgtgctttcctcactcacatctgagcagagaaaccagaaaatagccttcagcactccaaatgcctgcttgttttcaacacaagagagcaaagggaacatttattgaaaatgtgtgttcttcgcttaggaacccagagctttactttgtgttattggcacatctacttagacctatgttatatgtgtatgtgtgtatatatatatatatatatatatattttttttaagtattagattggagtgcttggcatgaatcatagattagagaacattgacaactaaccagatagtgaactctgcctctatcagccaaatctaactgccaaaacactgaggaataaagtaaccactaattaagcagcctggagttttgtttttgggttttttttggtggtggttgtttttaatacataccctgccataggatgagggcaattgtgtgaaatacatgctttgcggtgacttccagtgatgcaacatagcagtctttttaaacagctgaaaactctctggtcctttatggtttccaaaaggtactccttaaatgggcataactgatgggggattggctagtgagctacagagaaggctgagtcagagtgacctgttggagctagccccgtgtgtgtgtgtgtgtgtgtgtgtgtgtgtgtgtgtgtgtgtgtgtgtgtgtgtgtagaaaagggggagccgtgggcaaggggcgggggtgaagggaggctgcaagcttggcagaatgtttgaacaagacaaagagcagttccagcgaccaaataaggaagtgagtgctgaagtatttcagaatagaagtgtgtcagggactcaaggcaattgcggagagtaaaaataggcaaagaagaaagggcaaaggatttttgttttacttgttccacaaaataaacagggaaagaagtatctctggtctttcagctggagtgagaaaaacagatcgtatctatccctttctgttggctttttatagacatgtgtctgaagagatgtttagaagctctttcagtggcaatggcaataataagcatgcttttgttaaagacagaaaaacgcaagttgtgcattagacgcaccatcacattccctttatgtgtaatgcatgaaacttttagcccaagatgatggaagtttccaagaaccaacagaaatatctggaaacccattttcagacatgtcctgaacactgaattataactgtatcctttgagaaaaatcttacctcttaacaagccagttaaatgtccattagatacagtgtctaacttaaatatgttgatagttactgaaaaagatgtcaaaagaggcaaattacgcaaagaaactgtcagtacttgttttaatcttctcaataccatctccccaactctccagagtggccaataatatgtcactgatcctatggataaatgctgctcttattttgatactttttttgcagtacgggtggaagagaacaaagatttggaaggagaatttcagatactcctaaacataatttgaaacaacctttttttgtcctacaaaaccaacattgagaaattatttctattaaccaagaaatcaatttacttatgtctgcaactaggaataaatagaagacattcatcctgggtaagacttttgaaagccctcaataactaaattgttggcaactctaggattggcaattgaacaaatctatccttctgttctcatgcaaaatacaaaattggacagcccacacttgaatcagaaactaccagaacctgcccagaagagtttgggtagagagctaaactggagtgcaaaatagggaacacacaaagattgaccacggcatgtagatgatcttacaatgtagtgtattctggctccaaaaataacctgccccccacttaaactgaaatataaactctattgaataagctaccttgatcatgcttcaagaaaatgttaggcttatgacaaaatgtttattatcacaaacaaagaaaaaattaaaatgagacacagtgttatgcccacgaatagtcattttaatgaccaagctccatcctaccaatgcttcactagttgacttttttttttttaagcaatttaacaatagatgtcaagagcagggaaaaaaggctgggtgtgctggctcacgcctgtaatcccagcactttgggaggctgaggcaggaggatcacttgagcccaggagttggagaccaggctgggcaatataatgggactccatctctacaaaaaaatatttcgaaaaagccagacgtggcggtgcacacctgtagtcttatctgcttgagaggatggcttgggcccaggaggtcaagactgtgtgagccatgattataccatgtactccagcctggacaacagagtgagaccctgtctcaaataaataaataaatagtggtaaaaagagtatttgacttcaaaatcatacttctcagtatttgccctgaggaagtaactcaaaatgggaaaagaaatgtataagcctgaagatgtttagtatagcatattttttataatttcaaaacaaaaaatttagaagtcaaatacacagaatattctcttatctcaacaatgcaatattatgcagcaattaaaactggtaatgattaagcctatgaaggcaaaaaatgtttatgataaatgatacaataatgacgaaaagttaccttgtaaaattacacactatctgtatagctatgttttgaggactagaaaagaacatggtgaaatagtgctagtgtgttatacatacatagaggtagattttttgtcatctttattttgtgtttttcaataataaatgcctttcaaaaaaagatgatgatgaacaagcttacaggcaagaggcaggattccagagtcagaaagaactgaggcttcagagtttacctatccagcaaatataagtcacaaagttttgtgtagctagttagtgatgttgtaatagactttgccatttacagaactgttttacttactgatttgacttgtcaattatttaaaaatagcaaagctagcaaaaatagcaaaatgtcaattatttaaaaatagcaagtgtaattcttttgtgagaaaaacaatcacccacaaaaatgtaactgcagaggctccgagaccatttgtgtgtgtgtgtgtgtgtgtgtgtgtgtgtgtgtgattcctccggtatagctgtgaataatgtgaggtaaccagagactggcagagtcagcccaggattaaacaccgtcatcagcagcaccccagtttaaagagaagattcagagcacctgcatcaggatctccttctaaagccctgaatggcaattgggagccaatcctgacattgagatcacataataaactgttctcacaaagagcagttcatttaatctttccatgcttttgttttggtgaccccgctactgctgggagtaattataaagaactccaaatgattagaaagcattttgcataaatcagcttgtttgaattattgcatttccagggaaaattaattgcgacttagaacaatgcagaaattatttacacacccaggtgtcaaaaagcagaggagaagcaaagaagtaaatatatatttatagaatttcctgtgatggcttataataactattgagtaatcatagaatgttaaatgtaatctcatccaaccctctatagtggagatttgaaaatggagacacaggactcgaagtgaatcgtgcagggtctcataaagagttaatgccagagccaactcctttgttgaaaatagtagttaaatccttaatggctgttctctagagctctacttgctgcctttgccttcttgcccctctcctgtggcgaacttaaacagtacttccatcagtcttacttcgaaagacttaagagtttgaaggagctctagacaatttatagtcttgtcttaggcaaggtgattctgcttcatctagttacttatttagaatgttaactccttagtggcagaagtcatgtttctcagtaataactaaacttattggcagcaatgccatgtgcgccgtgccaaatgctttccaaagtctcgttgaatccttgcagcaattaatcaggtgtgcagtgctattattctcattttactagaggaggaaactgaggcacagagaggttaaataacttccccaaagccttacacctagcaatggaatattacgcagcaattaaaactagtaacaattaagcctatgaaggcaagaatgtttatgataaatgataaaataatagttaccttgtgaaactgcaagctatttgtatagctatgctttgaggactagaaaagaacatggagaaatagtgccagttatgcgtatggatacatatgcatcacaagtgcgtatgttgagatttagacaaagtatcagccttgggatttacacccaaagcatgagctcttaagcatgaacttgcattacttcagtaggtgttcagtgaaagtttttgaaaatacacctaaagtatcccaagcagatgacaattctcttgactatgaccaaaggtatgaggaagaacttctactttgagtaaataaaatgatgggcttccagaagccaggtatccaggtgataatttttctatttgaatatgagaatgatagttacacagataactccaaaaattacctgcatcagtgaaaatttggaggacagacatatataaattttgcaatgttgtatgtcataccagtgaaggaatctaatgatactattatttattaagtgaggatcgcaataagagttattgagtaatcaatgtctctgtatttctttgggttatgattcctgtcacatcagtatggaaaaagatttagcaagtcgcatgctttgcttgtccacaacatccaagctccaaatgtcgcagacataaagatatgcccagagtaatctactctgtaactcacagtgagggtatttagttgaatctccatataaaggaatgatttgaaggaattatctttacctaatccatcctcctccccaaagtagtggaaaatagactcaattatttcacctgaagttaaatttgcatgtgtgaaagtgtatgtttatgaaacaaatagtgctaagcatgacattagaaatggaaatcctaagtcctctgcaaaacattatctgatgagttgattacgtatttgttctctacttatttcatcttaccttaaaaccatgggatactaaggtattttttttttcatcattcatcccctttggtaaaatatcaagtatatgtatgtgtgtgtatgcagatatgggtatatatatgtatgtacaaatatatacatgtttaatgtattattacacatacagatatacacaaagagagaaaaatttgaagaattagatgaatatacgtataaagagaagttttaggccaggtgcagtagctcacggctgtaatcctagcactttgggaggccaaggctggtggatcacctgaggtcaggagttcgagaccagcctggccaaaatggtgaaacctcgtctctactaaaaaaaaatacaaaaactagccgggcatggtggcgcgtgcctgtattcccagctactcagaaggctgaggcaggagaatcacttgaactcgagaggtggaggttgcagtgagccgacatcgtgccatcacactccagcctgggcaacagagcaaaacgctgtctcaaaaaaaaaaaaaaaaaaaaaagttttagtattttttttctcatctctcaatagactgttgttgaagcccactgctctgtataataccccaacacccatttgaagagttgctgaaagttctgtgccaggccatggtgggctggcctgaggcctgatcccagaaccctccagctgaaaggaatgttagagctcagccatccagcccctccgcagaacacatggggaaactaagagagtatgagaattttgtctcaagacctcatttccaagaggactcaggacctgatgaggtctttgttatatttaaagtctaaatagctgtgtgataataatgaacctagcttaggaattgttttacatactagagcttttgtttggttttagatttttttctttttggggagggggtggggtggggaggggaggcaggtagcaaagtactcttcaccacaaagaagttgaaattgaaaaggaaatctgtaggcacttaaatgaaaagcagggcattttgctgatgaggtcaaatgatactgatcaatgggaagctctgggagaggtggctgtgtaaaggagagactgggtgacccagggaagtgtccggagctgaatgagaagttggaatcacatattcctatgttgcagccttcaacctgatactaactcattcttcagacacggagtccaacttccaagtgcttcagggatttttgttaagccttttaagggtatccaaatgaattaactattgtgtttcaccaacgctctagtaattcactttcagtgggcggttttattttcccagatgtgcagattgttcaccatggagctatgagtaattaactcataaaagaaatgtccagatgaatgaacaactgcaaagcacctgttgtcaacagctgatttttgtctccgcgctttgattatgaagagcttgagaatactggaggttgttttcttcttctaaaaccttgtgacacctgctgatttaggttcacatagaatacaatggtaaatagagaataggtggtagagcttgtctttatatctaatgaaagaaaagtgtcaaagtttcagatgaatgtcagatacccaaggatagggctgcattatgactttcatgggccttaggcacttttgcctttgtgggtccgtttctccattaaaaaaaatagaattatattttatagttgtattggtataacgatgaatgtaacccaggctggattcattattatatggtcatcattgttatatttatttatgttcactttttccttctgggtttattaaaattaaaattttttcttgggttgcccaaagtgtcagccctgcccactgaacctaatgaataaattggccctgcctaagattatggacaaagagacttcacggaaccatagctggccccatcgatttttactgtcactgtaacagagaacactgctaggcccatttcttctatttttcctgatgttgtctctgaacaatgagcagctcaagaatcagaaatccctttctcggcaaggtagttcacgcctagagtcccagcactttaagaggccaaggcaggtggatggatcacttgagctcaagagtttgagaccagactgggcaacgtggtgagaccctgtctctacaaaaaatagaaaaaaattagccacggggtggtgcacgcttgcagtcccagctactcgggaggctgaggtgggaggatggcttgatcccagaagatggagactgcaataagctgagatcataccacggcactccatcctgggcaacagagcaggacccatttcaaaaaaaaagaaatccctttctccttatgtaacactacttggcctagaaaagccagtatttgtgtccactgtgctctgccagggctgcttatgtaggggccttcgttcataatatgacaacgaagcaggtgactgaatcaaaaattaattcctccatgatgctaaaagactgtgtctgtgttctccaaaatggagtcagtttgtgaagagaatttttgtcagaccagtttattcattgctacacaaagctttcttaagtgacatgcagtgggcaaacaagggaacaatgacaccaaagttatgtcaagcttgtacttgtaccacccacaaatgaagatggaataataatgttgccacctataagctaatgaacaaaatgcaacaatgggcccaaacatgcatatacccattgccaataaattaatctctaatgagacttttgctaaaattgaggtaatgatttacagaaggcctggcttttaaagaggcctgaatttagtctttatttatggttgccgtattttcttttcacttgcattgaaaactttactttcaaaatcttactttgtcaactttgtccagaaatacatttttttatttttttatttttttaccaatcctcttaagtgaatactttttaaatgatattctaaactcttatttctctcagtgcagtcttctctctgaactcttttcatgagccatatcttattaaaatccattatatattgtaaaagaaatagccattggaaaatattcataggccaccagttcctttgaacatagcagattgaaccaaagtttaatttgaaacatcttttgataaatcttataaattgaccaaattttctcaaaatcattgaactttttctaaagttactaaaaacagacaaatatcatatactaatacaagaataatgatcttacttctttggagcaatggaattattttttacatttacgactatggaaatcttgggtaaaaaaaaaatcttaattttttttccttgaaatctagtacttcattgtatcagcagtgacctagtataactcacttaaggggcctgtaacaggcaatatcaatattattgtcaattgttttaactgtcaattatataaactatatatcagataaattcttttttttttttttttttttttgagacaagttatcactctgacacccaggctggagtgcagtggcacgatcttggctcactgcaacctccacctcccaggctcaagcgattctcccacctcagcctcccaagtagctgggactacagacgcacaccaccacacctggcttctattttttgtagagatggagttttgccatgttgcccaggctggtctccaactcctgggctcaagtgatcctcccaccttggcctcccaaagtgctgggattataggcgtgagccactgtgcctggccaaattcatttctttaattgccaatgttaccaaatattctctcctatggagcttatggtctatattcagagaattttctaattttaaatacatttattacatttttatatttaaagaaagtttaattggaatatttgacttctccttattctctctcttctctctctcttctcattccatttccatattggagtctaggtttgtacattttattttgttaaagatatatactgcaaaataatctcaatgattctcttagtagttggatatctttgttagaaaacctttaacttcagcactgaagcaaatcattatgtatttgcctaatgagaaaaataaagtacttcagataacataatcccgtttatttgacgcagaagattcgtgtattgatccagaagaatggatattcaagtttaagatgtgaagtgctgggtagaaggaggtttcagagatgacaggttaatcagagttagggaaatagacccaattccctccttcttgtgatagtcccctatgtatagcctgtcggagtccatggtttcctttgaattgacttcattcttctgaaaacggcgctgcaacaccctaagcagctccattgctgagagagttttacttcctgtatttctgcgagcaacaatggaatcatggctgatctgggtgttttctaagcaccctggaaatctacatgaaatgcgacacaagattccttgttatggtgtcaccagaggtaatattaatagtattaaaagaacaagctgaggactttatgcatgatcttacccatgacttcatgaattgccactgggattaacgtaaaatctgtaatcctcgcctaaataggccatctttgtctattatccatcactatatatataagatacaacttaaggtttttcttatgtaggataagttcaaatatttagtccactgataacggtatttcaccacttattcaggagaatcacataaacaggcaaattctcactatgcctctttagtaatccacatggaatctgtggatgattccttcagagccagcataactcatttgatttggaaaagggtgctcaatagtgagtcagattctactgtggatcaagcaggacatgtttagaagctgccttaactatttcagatcaagcagacctgactatgcgcaataaaacttggcaataatcaattgctccattggtaaaatggagatcttagggacggtgaatggatggtgaatgcactttccataaatatgtattttttactccaaacatatatattccttggagcttggactctggagttaaggatttacatctccgctcctccccttaccagctccgtgcccttgggtaagttacctaacctctctgtgctcactgtccctgggatgatagttatagtgatacttcttcatggtttctatagtcagataaacaggagaatgcatgtgacatgattggcataatgccagcccaaagtaaagttcagattattttttttactctgttttttaattatctgaaactaaatactgtgttttgcaaaaacaaaattaaaaggcaaaaacaaacaaacaaaaaccagctccccacctgctacataccaaacagtatgttaggtactgcaatggcagcatcgcactgtgtcttttcaacagcagtccagggtaaataccttaacctccacttcacaaatgagaaaacaaaacctttgtgatttcaaggtcatggaaacagtggaactgaccccactctgtccagctccaaaggccatgctcttttcaggacatgccttcactagatgatctcttcagccccctcccgactctgattttgagtcctctggaattgtctcggatgttcaaggcttacctcactctcataagctcagcctgttttttgtttatcgtagcgtggcctttctttacattccaactgcagacctggttgtcattctccctgtgacatagcatttgatgtccactgggttctagttatgtctatataagtacaaacagtcccatttcttttttcccgatccattctcccttatcttaataaaaagttgtgaacaaaccaaagagccataaagttatctttaccaataggatagatgaatttgttttcatgttcaaagtatgagttgtcctcggaggggtgccctttccctcctcccctactagtctgtcttcatgatcagataatgcatgaggctgagcctctttagaatacccacattttggttttttaaagtttctcacttttgttaaaataattactagttgttgatatggagacaaatgtgttttgtataaaatgttacacttaattacagagtccaaattcaaaatagtccaagattgttaaaagttgcttattcttaaaaatgaatggactaaaagctgatcttaagcattctactctcagaaacattttcccaaacataacattactatgaagcaatatcaggtaaaatctataattaatctgttatttccttagtcttgttcttgtttgataaatgtagttgggagcccttgcaaaggtagcaagtacaatagaagaaacaggccattcaggcaagattctgtgactctaaaaaatatagtaagagctaaatcaagtttttaaaaataacatcaaaggccaggcgcggtggctcatgcctgtaatcccagcactttgggaggccgaagaggcagatcacaagatcagaagttcgagaccagtctggcccacatagtgaaaccctgtctctatttaaaatacaaaaaattagctgggtgtgatggtgcacgcctgtaatcccaggtactcgggaggctgaggcaggagaatcgcgtgaacccgggaggcggaggttgcagtgagccgagatcacgccattgcactccagcccgggtaacactgcaggactccgtctcaaaacaacaacaacaaacatcaaaacaccagaagtgaatggaacaagatcctgatgctgacctgattatcagaacatctgttatagacaacattgatcactctgaggaaatacatagcaaaagcctccttgtagaaaatgtgccaatccagaagccaggaatcttctaggaaaatctcaagttttggtaattttcattaaaatattaagcaaaatgccggaagatatattaatattcctttgctgctacatggaaataaaataaatgaaaatatagattttgggctttaattcttaagttagaaaagcgtgattgaacaatgtcgatttgtggtagcagtaaaaagacatttacttggtttgctaatcatatctactttataaaatattatcatgttacctatgctgagcattttgagctagatagtgtgcaatacccgtcagtagttagatagatcaatcagtcgattgataaatagatagatctgtgatttggtttcactgccaatatcttctttctttagtgaatactgttggtttttagtgtctttcgttttagtgttttagtttttaaccacctatgtttcactattttcattgtgagaaaaatatgaaaaggaatgatttgaaggttactttcaccctttccacttttctccccaaatacttggcgaattgagcccaatgtttcatctcaaagtaaatttgcatgtttgaagccttaggcctctgagccaaagcctgtgaaggtaaagccagagatgcacggcctaaagcagagactctggcagatacagccagcgaagctggagggagttccttgagtgtcactcctgacgaaataaaagttcattgtgtatttattctctgcccctttcatcttatctcaaatccacagagcgctaagttttagtcaaggaagaatgaaataaaagtaatagaaggagaagacttgatcagaatcttcagtgttcagaggaggatggaatattctttttcaaacttggcagaaattctcatcagtgcttctactgatactagttttagcaattctgaggcttgttcaaagtgatggccaagatgtatccacacctcccacggttcgtgtgtaaaaccttcaaagttgcaaacattggaatattcagtgttttgcatcagtgccttaaatcttcatggatttcggcactgaaaagtgaaaactggtccacgtgtacgcatctttccgggcacctgtagttggaataaggcagacacacagagatgacagatctaatggatcatccttcttttgctgtctcctcagagtaaaggaagtgcgtatgtcttctcacagccaatcaactctccaagtctattctaccccacagtcccttccatggccggtaaacactacaggtggtaatatcagacatctgttttattctttctgctctttatgttgtgaaaggactcctaaatcataaaatcataaaatttaagaagcgtaacttaaaaatccatcagattaatcccattattgtggaaataaggaagcttcagagtcccacagttaatggcacagatcacacgtcctaactctcatctggtggcactctttagtcagtgtcccatcacagcctgcaagaaaaccctgctgcaggccacgtgatgtcattgctgcagccctaagggccctttgacatgggcgtaaacaagctgagaattcaaagaaaggtgaagctaaacagggaaatactgttagaaatattagaataggcaaagtgattttcactctttaaagtttgtgttccaggacaatgaattgttggtctatcaccctctcaaaaatgcaagagatgataatgctttgtattatccccagaaagatgactatggtcagtatattattaggttaaaaaaaataggttacaggccaggtgcagtgggtcatgcctataatcccagcactttgggaggccaaggcaggcggatcacttgaggtcaggagttcaagagcagcttggccaacatggtgaaaccccatctctacaaaaactacaaaaattagctgggtgtggtggcaggcgcctgttatcccagctacttgggaggctgaggcaggagaatcgcttgaacccaggaggtggaggttgcagtgagccgagatcacgccactgcactccagcttgggtgacagagtgagactttgtctcaaaaaaaaaaaaaaaaaaaaaagttataggctgagtgcggtggtcacgcctgggaggccgaggtgggaggatcacttgagatcaggagtttgagaccagcctggacaacatagcgagacgttgtcttgaacaaaaaaaaatgttttaaattagctgggtatgatggcacgtgcctgtagccctagttactcaggaggctgaggtgggaggatcacttgagcctgggaggtcaaaactgcagtaagccatgactgcaccactgcacttcagcctgggcaacagagtgagaccctgtctcaaaaaaaaaaaagttacaaaattgtatggaaacaattatctaagctattttaagtgtgtgtttaaatacacatccaaaagcctggaggactatattttaggcagctaacaatttatctctgggagtaaaatcacagggacattcaattttggtttattgtttaaagaacaatatttggtttttaatattttacagacatcgttattcatttaaaagtcaataaagatatttccgagagaggaatagactacctggctgaagacagtgaacctagcaatgctagtgttagatatcagtaatgacggcaggatacagttacagtactaaaccctttaaacaagtggtctactggctattcaaaactagttagcatttattggcagttactgagtgaccacgttaccgaaacagcctggcacaacagtaagttcagtaaatggtagatattaccattcattcattcattcattcatgcattcattttgttaacagcttattgtgtgtgaaagatttggtcccagtggccaaggagcacactctggaaggagaaagaagacagaaattgttgtgacatggtgtgccaacccagctactggaggattatacacagagccaggggtgtccttagctgatctggtgaaagaaaagttggtgatctggatttagggctaagcccacaatctgtcacaaattttgcatagaatattaattctggaacgaatgagtccagttcctctttgaaaacacttctacagaagttcctgtgtagatgagcgttaaaataagtgactcagggcctccagtagtttatgagctaagaggatcacaggataggatagggaccgggttcctcagatgttgctagatcaaatgctttactcttctcaccctaagggctcctgaatttagctttttattacacagaacccagtaaactaattaatggaaatctaaaaattatccttcctcttcttagaaaagaaatatactgcatgatgatttgtgcttttcgatttaatgtcacacaatcgtttttacactgtatgtgctttccctccccacagccccagtcccagccccagtctcgcagttccattccttcagggcagcttccattctaccgtgagtttttattgctttcccctaaaacgctgccctggagtcgcgtttattggacactctttagtctgtaaaggaaaaaaacacaaacaccggaggagaatcatcctaacaagccgacaacatatctatgggcctaaaaaacttaaattctttcccgttattagcacttctcgatcgttccaggaaagcccgatttgtagcttggctgccccaggaaggggcctgcgaccagaaagatgcaaagggcgggacaaggttacgagtgggtgcggggaagcctccctaacctgggggccgcgtcccagagctgcgagccacgcctcctctctcccgcccgccgcgccgccggactcttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgaggtaggcgcggggaatcggccctgaggctggtggaagaaatgtgtgaattaaagggagtgcagcgtgcagggtgggccgcgagtcgggagtgcagggctcgggacagggtgggggcggggaggacaagagactcgtcagcgcactttccacccggccggttccttcccgagccctctccctcccccggcccgcgggagcacagatccctgaaagcggagctccagataggaatgtctgcatcatcttggcagggcccagacgggagaagatgctctgctgccacggacgatccctcccgctctcctaactcttctctgaacacctcgcacccccacggccccccgcccctctcttaatcttggccacgctccctgaggggtcagacctggggtgggagagcagagaaagcggggctggcagagacaggggtgagggccgggagaggcgatgacatcattccctggcagctggcggggagagggtggggacggaggggtccccccgacctgagccgagccctcccttcccaagcccatcctcctttctttgggatggttcaccccacctgggcgccattcaaaggaagtttgcgcgtaactcggggcgtcctttccccggccgggtgctgtgcccggcccgcagtcggtgtttcttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaagggagggtcccgtgagcagccaggctggccctccccgggcctgggtgagctcccaaagctggagcgcagggctctaggccggccccgccccggggctgggggcttcccgcccgtttgtctcattttaacttttgggggcagctctgtcccgaatggtgagtggtccagactctagaaaggggtttggtcgcttgagcccggattgaggcttgggacctttgctctcttgctggggacggaagggggcgcgctgggcaggagagggggcgtctcggtcgggtctccctgggctcgggcatcttcccaccctgcggagccgggtcttgcgctgcgtgccccgaacaggcccgggcacaccgagtcccgttactggtcttcaggcgaaattccaggacgggtgtgcattcatcaacctgggagtctctaggagccagagatgactggctctacattttaatgcgtaatcacagagaaactagcacgagaaaaggacagagggaccgacccaagcttcagagacatggaataatatgatcctggttcataagccttgaaaagctcccctccgccaggttaaggaatggtgtcaccagccttggctgtgaggataatttcttgatttgtgttatgcaggctcctgtcaggactgtctccttaactcccactacctaaggaaaagatagccagagaattgtccagggatttgggtttgggttgcttctagaaagacagcatctttcttgctattttttttttcacatccccccaaaacaatttttttcccccttcagacttggcagactttgatttagataagaggtttgagttaatttgattttccccatgtctgtttagatcaatggatataggagatagtttgaagctaatgtacccctatgcctttgtgtgagtgtaagatttataacttgagggaggcagttaataaatagcacatccttgaaccataaacatacgagatagacaagagctagataataaacagtttttcccccaatccctaagctttacttattttttttactgattcttgtactttgtcattagaaaaaggagtggggttggtttcccagtgaccgcattcattaagaaactgggcatgtacagcaagtagcaaaatatgccaacatccacaccatctctggctatgtgaaaacttggtgccctgtgtgaggagcatgggggatggttggaaataatgcagctttatttttattgtgattgttggaattcatgaatcataaaattctgatagctgggatggtgtggtagctcacctgctttaaataatgtaataacgacaggcccagtctgtcccaggtgaggaccactgacttagtaaacaataaacaggtgtcctactcatagtagccttagtgttgcttcagtagatccttatgagctctagatagtttttagttgacttttaatatttttaaaggtaacaataggccgggcatagagactcacacctgtaatcctagcactttgggaggccgaggcgggcagatcacgaggtcaggagttcgagaccagcctgaccaacgtggtgaaacccggtctctactaaaaatacaaaaattagccaggtgtggtggtgtgtgcctataaccccagctactcaggaggctgaggcaggagaatcacttgaacccagcaggtggaagttgcagtgagccaagattacaccactgcactccagcctgggtgtcagagcgagactccatctaaaaataaaaaaaaaattaaatgtcaccaccttgcattgtacttgatcttcagaattttactctattgtcttaagcctttaaaactttgctcatgaactatattatttggactacctttgagggtagttgcatttttgcatttttgcaaaatattattttccctaggttacagtaaacctttgactctgttatatttgaagcaactaattattcctgaaacatataaagcatttcctggcaatgttggtggagttcatactgctcaaggtgctgaagtcattatttcaaggggaaattattagcgtgttccaacagttcttaattgtccaaacaattgttgatttcccccctttccagatttctttcacaatcattgggaactataaaaaggtgtattcgacattttcttttgtgtatattttccacttcaacaattttgtatcaaaacgtatggcactttttcagcacttatttcaagagatccggataaactctgagtaatcacaattcactatacttcaaaaattgcctcccattcagtattttacaaataatcttctacaagtaaatggggaaaatagacactaaccatatactttttaaaaataatacattaaaagagcactaaagcgttctttgaaagtgctcctggtactatatacgtattggctcattctagcaatgttcttttgagacaccatacaagaaatggaactcgaccagatttgagaaaaagctgcagagaaggtgaggatttgttccagggccatacagagaggaaattgagacactcatttcttcttagttcagtctcccaggtgtttagccctagatctctttgagattgcacgaatttaagggattttttttaaaaaacagggaagctctgttatcaaattttaagagaggataaagaattagagatggtagatgagaaatgtttcatccaaagagttttttgtttgttttgttgtttttttgagacatagtctcgctctgtcacccaggctggagtgcagtggcatgatctgggctcactgcagcctctgcctcccaggttcaagcgattctcgtgcctcagcctcctgagtagcttggattataggcgtgagccactgtgcctggctcaaagagttttaatgaatagaaaacagtgacccattcttgtagaaaagacatggagataaaatgaaataaggagagcctgaggtgtcagggaaggagaaagagcattttgaaactggtggcaggtacaattctctgcctaactccgtggactacttagggcacagatttcttcctgctcagtcagtgttagctgccttcctggttatgtgctttagggttgaccgtaattggtaacataagccattccagttaggtgagcctctcttccttgtgtattttggataatgactacgaggaaacaagatggaaatgtgggatggttagctaatgtcagtgccgagtctccctgctcaatgcgcgttagcccaactgccaaagctctgccactatggtaagtgaagatggtgattttcagtttggcagagactgttggaaggcgtaatggcttatttgatggaaaagatttcctgctgcgggagaagctgccatttgcagacaaggtgtgtcagccagaagaaatgagcaataaccgttttctggtttctactggcaaaagctttgtatttttttcatatagaagtgttaaaaatagattcataagaaaatgcatgaaaccaagtaaaaagtacagacactgaaatttcaccaatgaatgggagagaagagagctaacctttgttgaatagttattgctaaccaggtgcttcagttctcacaaaattgtgtgaggtaggcccgccacattagagaacggggatcaggcaaacagagatgaagtactgctggagcgccacgcaggagactcttaagcttggcgttgacgtctatgacattcggatgcctttgtgaggctgtcaaacctactgcgaagtaggcggccctcagctttcagatgggttgtgttctgattgtgggtttgtaaaactcattgctgggaaccctgaacacactttttcactgaaactatgtcatatttagtggtttcccaggccagcccagaaatcatagctgaagtattctgtcttattaatagtaccatagaaccaaaccactatatataacatggtttttgtgggaaaatgcactcagagctccaacttgagttttttaaggtttttaattccagttacaatggcaaaagggactccaccttctctctttttccatttaagccctggagggaaaataaaggtacacagagatacatttcctttcacgtttcctcatgctaacagagaccccaccctggactgcagagcgatggggaggggggatcctggcagtagctggctttgtgacaacagaggaaagagaagagggggaagagagcacaggtagcggaagaagtgaggtctagatgtcatcacctatgggaccaattttggatggcttatcaatatgagctgcaggctgactgacatcgtttccttactaaacatcatttttactgagaacttagtaacctagacctagacattaatgttacttagttgtatgttcagtattttttaagtgaaggttagtttttaaatagtcttcagtagtagaaggaaagcacatatgtagacatcttatttttctttttcatgccagtctactgaatgtccaaaccagcacctatcggtagctgaatacactcaaggtaaacctggatgctaatggatatgattcgaattaatcatagaatatataccgttcgttgagtacttcaaaccagaaaatgtgctaaaatgttgaacacattttatgtcatttaatcctcaccacaatcccacgtagtgagtactatcagcactcccatcttaaaaatgatgaaagtgagattttaagagggtaagtaatttgtcaagatcacacagatcagaaatggcaagtctgggacctcattaattcaacaaatatttttggagcaagtcctgtggcccaggctctgtgttagactctgggagtaaagcagtgaatgaaatggacaaatatgccgaaatccttgccctcgtggagcttatatgccagtggaaagagatgaacagtaagcaaaacaaactaaacagctagtgcctcagatacagttatgtgctatgtggtaaaatagatctagggagcatgaggaatgccaggttggggttgcagttcaggcaagtagagaatacaggctgaaggacagctgtgagataacaaaatcagtccaggagtacatacgctattgtttctcgcagcaacccattttatgtcgtaacaccaaatgttgagtacatgtcaccctcatcagtcactgcttctactgcagcaagtgactggggaggtatccaagaatgactggtgaagggcttggccttttctatcccaaggtcaggaaagatgaggacagttgctggagggatgtcctagagcggctggggttttgtgcacaagcagagggcttgacctcagccaagagcacagagctgattctcctgtagccccagaaaacaggcggaatctgggggcacagatgagggctgggtggaaggagcaatggaagctcgtggaagttctgtgttgcttctgttttcttagtggaatggggagtgtggtcatcagtggggagcgagggtcggggagggagtgcggggccgggggtgcagtttgaggagagagatgtgaaacagtcacctggcagaaagggagcctgaatttagctggtgaaatgtacactcaggatctgcccatggtcaaattctgactcttaacatccttccacagtatattggagatcagaattctctagttcacttcttgaggagagagattatcttctaactccttttttttttttttttttttttttttgctgtgtcatttacttggagcagagtcctgcacttactatgtgtatggttaatgcttgttgagtgactgctacaggaaacctacacacttgtccagaaatttcatttaagcttttcgtcctaattgtcacattgttctctcccttttctgaaatgctgtgatgttcctagttcccaaaacagtacttgtatagcaattactgttaattatttcattgagttaatctcattcccataacggattaagttttagactaagaaataattttttttgtttgagacatgaactcactaccttcacccaggctggagtgcagtggcatgatcatggctcgatgcagccctgacatcctgggctcaagtgatcctcccacctcagtctcccaaatagctgggactacaggcatgcgccaccacgcccagctaattttttgtatttttaatagagatgaggtcttgccatgttgctcaggctggtcttgaactcttgagctcaagtgatctgacctctcagcctcccaaagtggtggcattacaggtgtgagccaccgcgactggctaaaaattcttaattgtatactcttttgtagtattctcttgggaccacctaagtcaagcctcattcccaccagatggtgcccctgttgggggcagtgaagaagccttctatgtctgtttcatgactccttcttggctggcacactgttgtgggcgctctgtaggtagtcaatgggaaacgggaaagctacttgcggttagaataatacgagaactagatattggtaatctcagctgagcgaatggcaaaggaactgatgaagcaggtggattccaaggctagttaggagaaggaattgactacaagtggtgttggtgggatgggaggggtgagggaggggggatgggaggggtaagggacgggggtgcatcagaggttactcccagggctctgccagaccctgggtagatggagccgccgttttacagaggtaaggacaagagtttagttttgaacattccaagtggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccagtgaaacctcaaatagattgattcaaaactggagttagaaaaacttgtggtttttcttggtaaagcttcattttctatttgtcttcataactataaatggatgtatttgtgtggaagatgtagattttttttaaaaaaaatctatttttggctctattaagagacaaaatgaatccaaatgtattccatacttctctcacattgcaccattttgttatgtaacagagaacgtttgagtacatactgtccacaccagcaactataaatctgtcctggcaagtgactgtaagatacccaggaacaagagataaggagctcgcctctccagggagaagcttttatttgcaagagagagagtgatatacaagaacttgcaaatgtctttgaagggcagaaaaaatcagctagggctaataaggcagctgtccaagttcatgattccttggcccttctttatacacaaccaccaagagttgtcagtttgcaaacctagaaaagtataccattgtaatatcagttcatctcccgcttttccagagctactcagaagcgtggtggatgcttagtgaaacgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggagggtcaagttccattcgtttaaaaataccaggacatttgctgctgtttagtaggggagttgggtagggtagatatcctcacctccactatacagatttatttatttatttattttttgagaccaagtttcgctctgttgcccaggctggagtgcattggtgtaatctcggctcactgcaacctctgcctcccagggtcaagcaattcttctgcctcagcctcctgagtagctgggattacaggtgcgtgccaccacgcctggctactttttgtatttttagtagagatggagttttaccatgttggtcaggctggtctcaaactcctgacctcgtgatcctcctgcctcggtctcccaaagtgctgagattacaggtgtgagcctctgcgcccggcccactatataaatgtttaagaattaacatgtataaaggttgggactttcccaaggtgagctgttggacctggatctcctgaggccaactgtgtttttcttctcagcacagcaagcatcctttgagatgcagagtgatcttaccacttgaaaatgtgcatcaagggcaactgcagaattttccaaaagcttaagcacagatggcaaatctggcaaagtcaaattgagaacactgactacatgttcaggaggaaagtttttaagggtaaatgcttaaaaatcctgaagaccagtttatttgggaaagcaattccaatggaaaagtgcggttggcttactgagggaaccacacagtggcagtttctacaacttggccagctgccctgggctggcagttgaggagaaaatgcagcagtggggttgagtagacacctcagccacggagtgacagtcattgtgttctaggtaccacctgaccgctctctgtctgctccttctgtggctctataatatctgagctcctgggtaagctccatgcagcctctacaactctgcttggagctcagttttcctatgtgtttattttgattttgtctacttattaagttaaatacaaatctgaaaatgaaagaataatcaccttggactcctgaatgtttgctcaatgtcatttagctcccattgtttcctgtcaccatagcagtctactgaaatctctcagcatatatttcagaattactctgatagtgaaagatttcctatcctatgtagtccaacaattattggtttattatgtgaaaaataaagcaagtatgtagcatttacagagtaatccagctccactgttaatactgtcatttgaagagttagcaaggaatgtgatgaagactgaatatcttgaaacaaagtttggttgtgcagttgctctgctatgaattatgggtctgattcccctctttatatgtggcttttggattttcttctgcccttgaggtaatctgctcctcctttcattcaccgtgcttttaggtttggtttcagatacagcatcccttctgctacattctttaaagttaaaaaaagaaaaacaatttcacttttattggtgatgggcattcaactgaaattacaaatcgggaaaacatgacattccagctcacagcagtctgattaaaggtggaactcttatgaaaccacaggatctgactgaacatatggatcatcttctggcaagcttaacagacacctgatgttttccttggccatccagaaatctgcatcctggtgtagatatcatgagttaatgatggagtcaagtgtagaaatgtgtctgggacttgcagacctcttgctttgtgatactttcttttattttcttaactggctgagaaaatggctgtcactccaagtctatcttctgatgggctggtagctctcattcaggccatccacagccagctgcctttccccagacaacctacattgccttgagtcttctcttaaagcaaaaagactagaggagaggagtgctactttcttctcagccttgctgtccctgtcatgtaaggaggtacttaaaaagcattcctatccagttctctctatctgctccgtcttctctccatgccctcatggagtacttggtaaaaacatttaagtagatgactttatggaatatgattccccggttttggagaaataaaaagatgaatctcagacatcagtaagggccacattctagttcaaattataagcctgtacataatcagtaaaactatattagaaataaaagcttctcaaaaatcccaagtgctcgttacccaaaaaatgatgatagacgggggtcccacaaatgtgtagttgtgtatatgtcatagtatacgaaggccagggaaatacatagtgccacctgacctaaccagctgttaagcataattactgtggttttgccagaaaggaattctaaatgcaggaaggtttgccattagtgggccacagaacatgaaagacttccctgcaaaccttttagaaaatttatgctagtttatatttcaggaggtaatacccattggatatactctaatttgggaaacatgggatgattaatgaattgatacaacctctagaccaggggaacagaagaaagtttggcttgcaaaatcacaggctccacctggtcagcgcttatcttccttgtttagctcaagttaggtaagtttacctaatactccttaaaaggagtattttaaatttatgtttgacatttaatgatttcagatagttcttggacatcaggataaacaaattcagtgtagcacatacgtagtataagaattctgttgatataatgccgcagtcatagttgtagcccattattccaggtaataatgatgctacaattagaaagttttccaattgtagttttgatttgcacagtagtaattgctgtttctattttcataggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctacccaagtccaagtgaactgctttatccatttagtcaatacatattcagtgatgctggttatttacaaagtattttatctacattctgtattaattctcaacagtcctgtgagatcattgtttattcttgttaatacacatatacgcacacagaagagagaagtggggaaccccacaagccttgagaatttcaagaatttgtggatttcagaatggttgagcagctcatagcttttctaacactgaacttttctctctccaagtcccagtcgctcgtcaaaaactgtgccatcagcgcaagaccctgtgatttctgtggtattctaattttatctgagatttattagaatatatgaggtggaaaaaaaagttgtgcaacaggagattggactctggcatcccacagcgtatcttccctgccaacttcctaataaagggtgaactccaaatattaaaaagttattaacgtgcttgaaagtctttccaaatgcttcaaaaagctagcagacacatccagtatcatttattcagcaaacatgtactgagtttgttttgtgctcagcattcccgactaagtaggacattgaccaggccatcatgggttaggctcggaagggaggggcccagatgcagaatgaattgattagttctgtgggtgaaacagattcagtgtcctctgaggagggactgaccagctctgcctgggggagtaaggagaagcttcaggagagaaccaagagctgagagtggagagtttgggagaaggctgaagctgggtagagaagctggaggggggagggctgtgtgtccggaggatggcaggtgactggtgtggctagagaggcaccggagcagaggaggtgagggaggctttaccagctgtggaaggccttgctttccacacccaaagtgccatggaaaacatgaaaatgtgctttctatcaagggatacggtcagaaatcgaacaaaatatttcctacctgtctatatcattggagaaattgttctaggtcctttaaggaattttaggacccttactaacacctttcttcttttccaatagcatcatctgtcttagataatagttggccctctggatccctgggttccacattcatggatttaaccaaccacagatcaaaaatatttggaaaaacaaaacaaaaacagtaatacaacaatagaaataatacaagaaaaaaagcaatatagcatgacagctatttatatagcctttacattaggtattataagtaatctagagatgatttaaaatatacaggaggatgtatgtaggtgatgtgcaaatgctaggacatttttttatcagggacttgagcatgtgtggattttggtatccgaagggttcctggaaccagtccccctcaaataccgagggacaactgtactcacgagacaggttgttagagtttaagagattcctaaatcataaaacctcttgtaaaaaggaagacttatacatacaaagaactcagctagtcaagactaagaaagtaccagtgggaagtaaagccacggttttaaatagtaatgtaatgaatgcttcccaagggcttgaaagtcgtttgtcttaagcagcacttttgccaattgttatactactgatttatttgacaagccccctttttagttgttagtgaaaatctcagaggtatcacagatttcaaattaatgtggtctcaatcagtgaggcttcctcttgcaataatctgagatggcaagtagctgttctaggatacctctttttgctactcttctgtcccttaactgaatgtcatttcaataccaagtcctcttctctaatatgcattcaaccatgcatgtacaaatattgacttgtccctttgctcaaccctaagcccactgcacgctttactattttcattcttacataaaagatctagaacagaaaatagattggaagtactatatagatccactacatacagtcaaggggaagtctcaagttttctcatgtttccttttataacgtggacaactgaaagttaaatatgtccgtttgatatgggtaatttaagcagctataggtacttggtgattattgtaaacctaagaccttaaataatacataaggaatcaatttcaacactaataacatctgatcaacaaagagttccttttataagatgagaacggcatggaattatttctagttgccttaaatgaattttaaacacccgttatgcgagggagagtaggtatggtctgtaagaggaactccaggaagcccatgtggaattttgcagtttcctctttacaggtgacctgttaaacagcctgcatgtcatggtagtgagatgtaacagaaaagctatgttaattaaggtgactgattaccattcaaatacatgtaaatcacagtctacccagaggaagataggagtcctctaactgcaggcttcttccgaagaattaaagggctttctgaaaagctgaggctctcaaagtgtgggtatggtacccacactggtggtgtcagcatcaccatcactgggtacatgtccatggcatccagtgggtaccaggacatccatttcttacccactactagaaataagcaattcgcttacggttagcaatattaccatgaaaaaatgttaatttgacaatattgagaccaaagcaaaacagaattttgatatttgctaaaaaagaaaaggcctgaaattagtgggctggttgaaaggggactggaattgcaagctgctcccatctgccattccagcttttaaggcttcttaattgaattggaagctcagttgaaaaaagaaaaggatcatctattctttcctctgttttcagataaagtcctaagaacttttttgagggcaatttatacccattaaaatgtcaaattcacatatcctttgacccaataatctcatttctagacatgtttgccacagaaaactcaaaacaagtatacagtacaaattagttgtacaggcagctttattgctacactatttgcactaatgagtacttgaagagagcatgtctatcattaataaagaatggtttatactatggaatactatgaggccattcaaaagcatgaaataaaccttcatgtaccaacatggaaggatacccatgatacatcgttgaaagatacaagatcactgagggaaaatgtgcatatgcttcatccaacttttgtgaacaaaaacccaaacatgtaaacatatgggtgttgtaagtatttatatttgtatagtaaaggttctggaaagatagcaccaagattttattggtgttttgccctgtggagtggaattgtatgaggattggtggttatgtgggaaattctttacatttactttattatcgtactactttcactttattttttaattaatattttatctttaatttttgtgggtacataggtgtgtatatgggctatttggatatggacatgcaatgcgtaataatcacatcagggtaaatggggtatccatcacctcaagcacttatcctttgtattacaaacaatccagttatactcttatactttctgatacttcagtttctcacaatgaatattccttttctaaaaaagaaaaaaaaaggaagaaactaagtcccaggcatattaagagagagctaattagctgtagaactaattctgacactctatttcccaatcagtattattcagaattattttttacttccctgtaatagttactcaattttagagccagaatttagcctaatctactcatttaacctctaagaaaactgagcccagggggtgctaagttcctggagagtggtcctcaggtggtgactgaggactgagttagcctcctccggcaaccctacccccgtcccaccccaccccaccccaccccacccctgggcaaagtgaaagtgaagcaaactgagaggaactcctccactgtcccttctgcttactcagcagatgggagccagccactttgttttgtcctggggcctgtccttgatggcttctaagactaaaaatcaaagctgtaaatttgtgtaatttagagattgaaggtactgatcgttgttgtcagtgactggaaaccaggcctattgagcaagagccattgttcagtgcctgtcagcccagagagtgtgccgaatgcactggccatcttagacacagatctacttggtggtgttctgtgttttttctcctaaaagaaggcttctcacaccaccactgatgagaaaacaattcgaggaaaacgtaggcacactcagtacatgaagggagacactattaaaagcaaaaagagggttattgtcaaacttagaacgatgctaatttgagttctgagctctaaaactggtagaattcaaacattaaatgtagaatgtactagtattctatgccttaaacagttgaaaggaaaggcttacattggcaaaatgtatttcacaccaaataatgatcctaaatcagtcttttgcaacgtcataagatgcagctttgtaagtatactttatttctaaactttaccaatctcaaaggctacctggagctcttatttctgaaataatttcaagatgttcattctctacagttttgtggtatgattaacttcgaagtccactgcagacacaaatgaactttccctaaaatgcaacacgagagtactaactacagtcagtaaagatgagagggggttattttgtagctcttcctgcaggctgtgagaatttttttcgttaaaaaattcgttaaaaaagcaggatatactgcttcagtccttaccatgagagccactcccatcggaacataaattagtcttagtatatttcaggttctcccacatgttcacattccaactgggtgcaacagttgacttttgtctttaactttccttggcaaaccgatagcatcagaggaagagataagctgccccttagggagctgattgtaatgcgttccagacgtctgcacgcccctggtgcaagcaccagctttctgttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaaaaaaaaaaaacactgacccttggaaagaagaactggcactattgagattcacaccacgtgtggctggctgcatcagggggctcataaagaattcagagctggcccccagcttatcttccccattccctcttctcacccccaagctacctccattaaaagagatgccaggctatatttattttattatgtatacttacgaatgcatttgctcatctttggtgtcataaaatacaatgaataaactcctatccagtttttcagtgtatttccttaatttttaaagcaataaactcctttaatcctcccttatactcaatactaaaaaatgaaagatctgattttaagcaggaaaagttttgtcttagcatatagccaggaaacttcatctgcctaggtcctgaaatgtaagtgatctgccagaaccaagcgtgggggtagctcgcgaggcctcagccctcctgctcctgtgtgagagtgctttcttctgcaacctggctcctggaaggaatgaatgctcccccttcagcccctactccccaccaagaatttaaaagataagagggaaacatttccctgactctaaaatggtttgtttttaatatggtatgtccaggcctgcactactaaaatccttcataaaagtcctctagaagataacgattgttcacattgcaaacctgtttgaaaagcctggaaaaaatgcggtatactgtagggaaagtcagtctccttttctcacttatataatttgtaagtctgtcatttcttttttttttttttttttttttttttttgagatggagttttgcttttgttgcccaggctggagtgcaatggtgcgatcttggctcaccacctccacctcccaggttcaagctattctcctgcctcagcctcctgagtagctaggattacaggcgtgcaccaccacacctggctaatttttttatttttagtggagacggggtttctccatgttggtaaggctggtcttgaattcctgacctcaggtgatccgcccgcctcggcctcccaaaatgctggaattacaggcatgagccaccgcgcccagcctaagtctgtcatttctaatatgctctcctagttttagctcagtagtagctgagtattatacaaaataagctctttttactgctgcttagcatgtgtctgcgaaccctagctcagtacctggcattccatgggcaggcaagaaaagtttgcagaatgaattaatctggcccaagtgtgactgagaggccagaggaggtcagtgggtgccgtctcccaggccagcagcacacacacagcttcctacagtctcccttcttgtctttgtctctttacatcctcttcccttcctcccatgtgtctctaacctgccaattgcaccaacatttattccctgctgcagagcctgtggacccacagtctggcttacctttattttctccatctccagaatatgtctctcctccatacccccataaattaaaagtgacttaaatatataaaatggaagagagaggcaggataaaactgtttgataacttaatagtacaactggccagtctctcgtagattttttgcattcattccaaacctgttttttgttttgttttgtttttgagacggagtctggctgtttcacccaggctggagtgcaatggcgcaatctcggctcactgcaacctctgcctcccgggttcaagcaattctcatgcttcggcctccctagtagttgggactacaggcgagcaccacctcgcccagctaatttttgtatttttaatagagacggggtttcaccatgctggccaggctggtctcgaactcctgacctcaagtgatccaccctccttggcctcccaaagtgctgggattacaggcataagccccacgcctggctgaaacctgtttctattaaaagacttataccttggaactttaataagtaatttattaaagaaccgttaatattagacattaaaataattatgactcccttacccctatttgataagcatataggtgacgttacactaaatactatccctgtctgccaaaataatctaatgttgaagcagtccaccgcatttcaggtctcctggaaatgtgctgcgattttctgaaaattagaggcaacaacttgctgttgaggacaggaaaaaaagaggaggctaagacgcaaggtcctctgaagcttctgccagctctctcaccagaacctaactcttgataccagtggagtgaatctggaagtctcctgccttcctgagtgagttggagacgtagacactacctggacaggctggagaaatgagggacttaaaacgtagcacaccccttgccccatgccacctgactagaaatgcctgccaaaggtatatggacatgcaaggctggcacagatgtaaagctcaatatattaaactagatagcaaagaaatatacaccaagcccagcaatacaaagcaccctgccttcatgcagttaaacattcttctgttttaggccacactgtacttgctggcttcatgtggcttcatgaaggcaagtgctgtgtctgttttgatcactactagatttctggcacccaacatgtagtaaaagctcaatcagtatttgttaaattcattgagagagctgggaaagaaggtagaatgaaaagaaaagaaaagaaacaaacaaaaacacaagcctgggcaacatagctagactatctctacaaaaattagccgggtgcagtaactcacacctgtagtgccagctactcgggaggctgaggcaggaggattgcttgagcccaggaagtcaaggctgcagtgagccgtgactatgccactgcacactccagcctgggcaacagagtgagaccctgtctcaaaaggaaagaaccatccacaaagttagtagtgcctacaagagtgtagttgctctttaagcttgaatttttggttattttgcaagaggtattatttgccttaagccatggtaattagatttattctgctttgtgggcttttagatgagttaatcggctacaatttctcttaattccctctaatgctttctaggtgtggatatcaagaaacctacatgttgtgtttagaatattttatgtatcacagatatcagtgggtagtagactttgcactggaattgcccttttccctgcctcagttgtttttggtaatattaactctttatttactgttaaactttacaaaaaatgtcaagtttactttttaggactaataaattagttttcataattttagccatttaggaaaaacagaagaaaccacattgcagtgtaaagggagaaaagtcacacatagctaattattgataggaaaatgagaagtgagatagcaacatctgagaggacttcatatatgagcatctcacagagtaactttttcttttagccagcataattactagcttttcccatgtgtgtacagacatttttttccttagaaattttggccttaaaagtcaaatacaggttgttttacagatgatcaatggtccttctagaagaagtccacagaagctctcagatgccctctagaccagcctttactcactcctctgtcagcatcctccctcccagctcgcattttaccaaagctagaaaagaccctcaagggcctgggtgcgtggaattattagagaccagataaaagacatgtaaggagtgctggtgtggcagatgctgcgaaaaaaatgtgccacaacctctgagggcaggaaactgaaagacctcgtgtggtttggaggcctgaggaaagagcctcaggaagtgatgtttgacctgacatctgaaggctaaatgggagacagagacaggtgtgcagtcaggaggaatcgcacattgaagggaagggctgagactctgagaatgggggtgggagggagaaaagaagaggctacagggggcgaccaggcctggtgggccaggtgaaggaatttggagttgatcccaagagcaagcgaaagtcactggggacagggaagtcaagagtcacaggattccatgtggtttttgaaactggctgcatggaagagaacagcgtgtgggagaagtgtaggagagggaaaggcaggactcatgatggttgagatgagacggatggagacaggcagctctgacttctgcggttctgacttgtgaaacaggatcagggatggtgccactgactaaagaggaagagaggattccagtaacaactaagcactattctcttttaatctctgcaacagccctactctgtgggttctattattaccccattacatagatgagaaaacagaggtacgaaagattaaatttgtctagagtctcctggtaagtgttcagtaaatgtttgctactactgcctctgtttactcatggagtcattcattcattcattcattcattcattcatggatggtatgctgtatctaagataatacattgttgaacagaatagatgtgaactctgctcttgagaaagactggtagtgggagaaaaagacaataaacaagcagttatcttgcttggacaagctggtcagggatggtaggacggtctaggtttcttagactggaatgttacaattctagctcttgcataaatcttggatggatatacagaggaaaaatacgtattgacaaagccaaaaaaatgtttcccagatgttctctgaggttccacaggcatccccaatgagttagatcagaagtaggccctgtgccgattttgtaggtgggaagctgaagatgcaagaagagaacagccgtgcagctgtgctgaggtctcaaagagcaagggttccaggtgccgccgctcctgctgtccagcaggttcagctgcctttgggcccaccaaggtaggaaatggcccatatctgactgcctctgtacaggtcaaatcacagctccctgttctctactatatatagtaacgaccttacataagagtgctattaaaaaaggacgacagagaggaaaagagaatgccagctgaattttttccactaaagctcatttttaacagatgtgttttctctgtttccacaatgacagtgtaccaggggactgttctccaggtcaggagggaagcaacccaggtacttgtaggactgtaattgggtccgtctgtgctgagcacaacaataaaattacttgtacttccctttttatttaatgttactctcctcatcagttcccattttcctgatatttgtgggaaggaggccatgaagaaggatgaaaacactgtaaaaataatttaaactaaactttacaatatatttgggataatgctgagaaggaatgttcttttttttttttttttttttgagacggagtctcactctgttgccaggctggagtgcagtggcgcgatcttggctcactgcaagctccgcctcccgggttcaagcgattctcctgcctcagcctccaaagtagctgggattacaggcacatgccatcacgcccagctaatttttgtatttttagtagagacaaggtttcaccatgttgaccaggatggtctcgatctcttgacctcgtgatccacccgcctcggcctcccagagtgctgggattacaggtgtgagccacctcgcccagcctgaaaaggaatgttctaagttcagcaaaatgagtgattaacatgtaagtggtacgtctatcttaaatgctttaaattataattcatgattttttaattaaggctttcttattccatctgatctcttatacactctagtacccagtgatacacaaattttgttaattttggtaagtcagtctgtctgtgcagtgtgtgaccttgacattatgtaatatgaatgggatggctacgtgttcccttttccccaggacagtcaatctgccagttgtctagagttctatatagttcagcctttgtcccagattaaagggcccacatttggacactgaattatttacatgaccgtcctgaatactaatagctcacatttatcaaaggcatgcttgaacattgctcaaaatacttcacatgtactaccacatttcatcttcacagtctaggagggaagtgctatcatgacccccattttatttattttagattcactggttacatgggcaggtttgttacaagggtatattcatgatgctaaggtttgggtttccattgatcctctcacccaggtggtgcacacagtacccaagaggatgtttttcagcccctccccacctccttctctccccacttttggagtacccagtgtctgtcgttcccatcttcatgtttgtgtgtacacagtgtttagctcccacttatcaggaggtatttggttttctgttcctgcattaatttgtttaggataatggcctcgagctgcatccatgttgctacaaaggacatgattttgctctttgttgtagctgtatagtattccatggtgtgtatgtaccacattgtctttatccaatccaccattgatggcatctaggttggttccacgtctttgctgttgtgaacagtgctatgaggagcaagtgtacatgtaccatgtggggttttttggtagaatgatttattttcctttaggtatatacccaatactgggattgctgagtctaatggtagttctatttttagaactttgagaaatttccaaactgctttccacagtggcctaatttacattcccaccaacaatgtataagcattcccttttctccacatcctggccagcagctgttgttttgacgttgtagtaatagccattctgactggtgtgagatggtatctcatcgtggttttggtttgcatttctctgatgattagtgatgctgagcattttttcatgtttgtcagctgcttttatatcttcctttgagaaatatatgacccccattttaaagatgaagaagcaggttcagaaaaattaagtgatcaaagaaactcagccagtaaataatagagtctaaaatttaaacacaggcagtctaactccagagcctacatggctaagaagtacagcattacctttcattcctaaaccagttaagaagtatatgaataaaactcctagaggatggaagggtcctttggaactgggaagttcttggagtccttgaatagaaatgctttcccaatttgccagtgcaggggccctttatgggaaacagtgaggaccatccaacagtccaattaactgagcacaaagcacaaggcatatttgtttttctttcttttgaaaacataaatgttagaaaagttcagaaatgaagagatttagaagtataaacttataactgttggaaccatcctcgtattttctagaccagtcttccttctctcgacaacccttctctcatggccattcctcgccctccatgttttcatgaacagtgtgattgactactctgattttgttagctagccaaagtggaaaatgagaactcggtgagtgggctggtgtatgctgcctgccagaggcagcgctctgtaagacgacttcattgtttgcttaccctaatgctccattacatctcaggatttatttataaattatttgttttaggatatggtactagcttcatgaaccccattgtagacttcacatttagaagtgttttttccaactcttttttacttaattttcatgagaatagtccttacgtcaagatgaaagaaaggtgaaacaccaggtagaatcagcaaactgataagcagccctgtttaaatccatggaaaggtaatgtttaaagaagacatttgttttaattgatttttattttacgtgtacacattaacttcataaatcttacctttcataccaagaagcctagatcagctagcgtgttaatatgctgacggctgagagcaaaaatagataacctaaagttgtctaacaaattagacatcacttaagaggaaactcaagtgtgtttcagggagcagtggcagatctgccttagatttttaaccactgcatcatcctgttaatcaagatcaatcagatacaaaaatctttggtcagaaccagtattacaaaagaacctaagaatttctgctttctcatctttctgtttaccataacacaggcatatatccaaaaatatatagaaagcaaaaatttggagagaatgacatgcgctttcctaaatgcaccttaatgctttccctggtgttactattactactgttggaagcatcactgttgaaatgagcctgtacgtcacacacattgctccccacacagcaacacttctgatgagggcagccccctgccttgttattcattgagaaatagaaactctgattatttagagcaaaatttcagatttgaagaagttttcctaataaggaagaatgatgtaattttcatggaggggggccaggttcccttcatttgttttatttatattagctgaattccaggggaaaatgggctatgaagcatgagggctgctaactatatttagccacacaaagttagtacatcaggggtcattttttctttaagttatacactcataaatgggctggaagatatttttcccggcatcttgtttttataaagtttgatcaagcataaatacttttattaagatgctatcttttatttcgagtgtgaagaaagtatccattgtaatctctttaatttggcatgtttctctgagatactggtttttgggtcaaaagatggataactaataacaataccttggttcagaagattgtattaactttccagagtgctcacgcctgtcatcccagcactttgggaggccaactcaggagaattgcttgagcttaggaattggagaccagcttgggcaacacagggagaccccatctctacaaaagtaaaaaaattagctgggcacggtggcacatacctgcggttccagctacttgggaggctaaggtggaaggatcacttgggcctgggaggtcgaggctgcagtgagccgtgatagtgccaccgcactccaaccagggcaacagaatgagacccagtctcaaaaaaaataaaaattaaaaaaaaaaatccagagtgggctttaagaaggaagcaatagtagtttcttggaagaaagataatgtgtgtttaagagtcccgttctgcccattgtctggcactattcaatctggattcactcccatccccctcaccttactctaaatataaaaatagtcggtgcgtcttaagacagtagactatcatttttgtacttttgcattaagacttttatttaaatgtatttataaactggagaaaaatttgtagcatttaaacataaaacctcagcgttataattggtcattccttcctcttgtcaacgtgttacaacatttttgctttgctctgttacatgactcggggcttacctgcatttcacgtgagagaaaagtcaaattcatctccaccccacagcctgctatcttctgccttttaccctaaatctttggaggcgacagcttcctccccatgactgatagttatccatgctcacagctgctggcaggactgactcctttacaactgtggccttgtagttgatctgaacaggatgatcctgtctatggaagcggagtcttctctcactgcctgaaggagaaggctctgctggagatggagggctctcatctgtcaatgggtagcaccgacggtgccccagacatgctgaccatgtgtggatgtcttagaagagtggaaaggcttgagaaatgcaagcttagaatcatttctaatattacttgatgggaagtcagcaaataggaaacttgtaaaaaattggaggacaactttttgccactatcatggacaaatctatcaccactaccccaaatatcggtccctcagagaccaagtccttagattctgaggctctgctgtataattcctgttcagtagagcatctggcgaacctctagtaggacaaacagacagtaacccttgtgagaagtgagggaacttttagaactaggcctcaaggagcactgtacagtagaaacagaatgtgaaccaccacaatgaagaccacatatgcagtttgttttctagtagtcacattaaaaaggaaaaagaaattaattttaatagtacatgttgtttaacccaatatattcaaaatattattttaacatgtaaataatataaaaattgtcataagatcattttccaatatctttttaaactaaattttttaaatctgctgtgtacttgacacttacaacacgtctcaattctgactaaccactgttcaagcacttaatagctacatgtggctaatggctaccatagtgggacagtgcaggtctggaggatgtgaaatcgggtgaacacacaacctttacacccgaaacagtgctgcagaattgatgataattactctaaatgctcatctcttatcttttcgcgtctgaaaactgctgctgagtgtacaaaccaggtaacagtaataagggccaatcccagtggtagaaatggagttgatatggtggagaaggatctgttgacaccagaccctcaaccacagccatgcacagctggacagaagccccctcggactcccaggtctggagtcggggcagaggcagaaagtctaaaaagaaatacatcagtgtagtcatttcagtaataaatgctgtgaagtaaataaaacaagatagtaaaagagagatgggagtactcttcttgctcactccaatagttgagtgagtcatctgggaagtaagttgtgctgtggagtgtgaaaggtgattttaattcagcctgagagccaggcgcagtggctactgcctgtaatcctgcactctgggaggccgaggtgggcagatcacttgaagtcaggagtttgaggccagcctggccaacatggtgaaaccctgtctctactaaaatacaaaaattatctgtgcctggtggtgcacgtctgtaatcccggttatttgggaggctgaggcacaagaatcacttgaacccaggaggcggaggttgcagtgagctgagatcgtgccactgcactccagtctgggatgacagagtctcaaaaaacaaaaaattcagcctgaggaaaatacttcctctagtcctcaacgtgactaaagagatcctcatttttctttaagagagaatttcattatttgaaaacacaatgcccaaagaaatggaagaaattgaagaagctggtttctatgtacttcaaataatattttggtgtgaggccccacatgacaacatctttcccccaggataccacagctgacatagctaaaatatgaagtatggcctaaataatacacagtgagctgataacttaggaaatattttttgtttgttttagccaaggcaaacgaattaaaaattttaatgttttgtttccatatttgcttaagtaaacttcaaaactaattacttgcaaagaattttgcctcggctacatggatgaccagtgaatgcttttgggagtgtaggactacactgaataatcgaataaatctattgaatatggaattaaaaaaaaaaaactaagtaaaaaagcattagaaccaccatacagcttatatctatatgcttattatgtatgggctggcttaggagggaacttgagaaatggtaacagtatttggttgatgctggagagggaaattggactgggaagaaaaagtaagagatgaagatgtactttcagtgttctctttatatcttttgcattttgaagagcagaggtttttaattttgatgaagtcccagttcatcaattttttttctcttatggatcacccttttgttgtcttatctaagaaatctttacctaacttatggtcacaaagattttctcctatgattccttcttgaaatgttatagttttagattcacatttatgttgaagattttttttaatttttttttatttttttagagatggggtctcgctctgtcccccaggctagagtgttgtggctgcaagatcatgacctcctgagcccagttgatcctcccatctcagcctcccgagtagctgggactacaggcatgcatcaccatgcccagctaattttttagttttctgtagagacagggtctcactttgttgccaatgctggtctcaaccttctggactcaagtgatcctcccccttcggcctcccaaagtgctgggattacaggcatgagccaccatccctggcctgttgaagactgatattagttaacttttgtataaggtatcagttgtgagctgaggttggaaatccaatagggtttggaggggttttttgtttgtatttaatcatgtgtattctttaaaaaataggatttaatttcaagagattaaaaagaaatattgtatagaaatgtctgcagttataataagtagttcaattttaaaaagaaaaagttgttttgtttgctttgttttgagacaggatcttgttctgtcatccagtctggagtgtagtggcatgatcatggctccctgcagccttgttctcctgggctcaagcaagtagctgggactacagactcacaccatcacacctggctaatttttttttttattttagcatagacgaggtttcactgtgttgcctaggctggtctcaagatctgggctcaagtgatcctcccacctcaacctcccaaagtgctgagattacaggcatgcaacactgtgcccagccaagaaaaaagttttattatgactactgtactgattttcaggaacagtcattgtgctttaattctctaagccaaaaatgtccaattctgttgggcaaaaagactatgttgttgattgcgctctctcatatggtcccttgccttcagccattttcataatcaaaacttgatggcagtattttgttacagggtaagaaactaaaaatggtaaaagccatttgtcagggtaaatctgaactaattatttagatcagctgaaataaaaagggttacaaagacaagttttctgtcttcaggaggggatgtggatactaaaacttcaatggaaatgaaaagatatggataaatttgcatctgccagatctgcttagggaaagcatatacatgaagtggaggaagtcttcccatatcccttacataaggattgagatctgctgccagagacacatgttgcaatatcaatagaaggtcgtcaaattgccttccatgagggagtgggtctgtttaatgctatcattttgtgacattgagaacacgtgaggccacccacaccttctctgcccttcaccagagctggggccagcctcttccgataaatgctaaataatgactatcgctttgaaggtgcacttattagcaagggagtccatgtgtctagggttcttttacgccattacagtgtatgaataatgtacatttgacgggggatgatcctctcaccctactcaagtttggaaccatttgacagataaactgaggagtcagaaagagatccaagcaccagatttgtactggggagaactcagagaagaaaggggatgcactgctgggcctcatgagttggcttatacttcaccttgagctaagcatactaatacccagtccaggcagcattgaacagctccgcgcagatctcaccctccaaaaaacaggaagaaaaagccctctcactgcaagcaagatccaaagagagaagagcaagggaggggctgatgtgagcatgcccagatccatcccccacccatattcgccaccaagggcggagacaggcaaagagggcccctgtcctggaaatccctccatgaggaagcagtgaaggatgcagggcccactctgtcagtgtctagtgttccactgatcctacatagtaattttgaaagacgatagcatgatgttcctgaaaggaaaaaaaaagtttcctctatgaggtcattaacatatatcttgagtgactttattgtcttctggttcattttgacatttttgtaaattctatagatcttttatttactcctgtgatatattttaaagatcaacaaatgtccacaccaaagaaaaaaatcaccagtaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgcctaaaaggacaagttaggaacagaagtgtgattaagtatattctgtattagttttaattaggactatagtcctttaacaatttcatcatatttaagcttgaaaatatacatgattgctgataccactatagtcatatacatgtatatatgcacacatacacatgagagatgagactgtgttactcagacatagaaccacgggacagtcagctacacattacttctaggcaatggttcatcttctctcttcagggaaaaagtaacccttgttggaacctgacagattttgaacatatcttttctttgttctttgtaatgtttatctgtattcttgttagaaacgactttctggttcagttatttaaaagattaagccttttagtgaaagaagttctcaccttggtgtcatcacttgagaggctaagagtgaagcaacctagttactactctgggctctgttggtggcctcctgtgtggcactgcaccaaacgtacttattactcagctggatgagatgatcccggttccttccatccacatgttccatgctttcctgtgtatctcggcgcacagatactatacatacttcagtggctttttccgttgtttaaatcttaaaaagaaaaggcatattctggtgtatatactacttccctaaatgaagggccatctactatataagtcttacagtataatcatgaaatccagatgtggtgtgcaacaaacttcattatttacatgttttggaaaagattaataaagtacagcaaaataagctcaatactacagctgtacacactatactataaagtattcttcttttgaaaagcatttcaagattttgcagcatttttattgtattggaaacagtcacagataccatattatagaaaactctgtttgacagaacgccagatgaataactgttgactatacacagtcatatataaccacattggaaacttcatgtagctatgataaatttctctcattttttccttaggagtaattacattagataattgaactgtttcatctaagaatttattttcgtggttttagtcatttctcagggagggagcctcatttattacagttctccccaagacacactggatagacttcatccactgctggaaggactggtgctgccccctgaggggaaatggctaggcagcactgtcttcactgcatcttatcctttggcctctaaggaatgtcaaggtcagctggtcaaaagctaagaagggccaaagccatttaaaatttacagttcttttccacggtcacaagtctcttaattcatgctgctaggctgcatctcttgtgcttgccaaaacgcatttttgagctttttcaagaactttctccttcttcagaggagaggttgggaagggagtctggtgatcaggcaagccctgcattcacaccacggaccctttggcttgtatatcttggccattagcatttaaactatcaatggtagacttgtaagaggaaataaattgctctgagtatccagatccaactgtgcattcctcacattgattgcaagaccaaaatatgtagaaaatgttattggcaacattatttattcaaaaatgtttagttcttcagttataggcctatgttaatagaaatttgaaaagtcgtctttatagtgttgttcaccatatgatataatgtttctaaattgtatcacatttagtgatacagtatctcaagagatggaacagcataacagatgagtaatattagtgatattcagatgttcaaatgtacaatcttgaaagactaaagaatgaatttattagcatgggcacattttaaaaatatttaaaggggactatttaaaaataatcctactatactgcaaagatatgaaagaaagaccgagaatgatttagtgaaggccacacagaaaattggtggcacagtcacttctacccgggaaagtactaagtagcccagtggcagcagatgctaaaaaagggctgtcggtgatttaaaaacaaagctatttaggccatgtgtggtggctcacacctgtaatcccagcacttggggaggccaaggtgggaggactgcttgagcctgggcaacatagtaagaccctgtctctactaaaaaaaaaaaaaaaattccactgggtgtggtggcacacaccagtagttccagctgctcatgaggctgaggcagaaggatcagttgagcccaggagtttgaggctgcagtgagccaagatgacaccactttactccagcctgggtgacagagcaagaccctgtgtcattcatgaacaaacacataagtaaataccaaactatttttaagaattcaaatccaattattttggaaatgattctttttgtatttatttttttctaccacaaacgtgttcaaaaaagagagtgaaggacagaaccataagtatgtaggaacttccataccatgaaattctatggtagtatttattgcccttatgtgatatatgtctcttgatttttctcagaaatttgaattaatactatacttggaaaatgtgaagtaagaacctttatcaattggtttcatcttcctgttcacattttggatatacaatatttagctgtaaacacatgatgtttgtttagtagagaccaaccattcattagtttctcaatataatgaacgctagttgatggtacttacactgaagtaagaaattctggaagcaaatttaatttcttagtttcaaagtcagctcctccaggttgctttgtacattcttatagtttttccaagaaatgtttttaagtctagcatatgagacataactacctaacattatatgcatggaatgtgttcaggacatagcccagctgtctctatagctgttttgggtgccattgcaatatctgtatctcaataacaaagaaatagggcataggaggggcagacttagagccatagtcttgagtggagcccaaatcagaaaggtcctctgtgtctgaggaagtcgcattgcacatggtaaatataagataagtcgtggtgctttggttagagacatggtaacgtcatggtcatgagccagagctcctcagtttaaatcccgtctccacttctttccagctgcataatcttggacaacttactatatatctttgtgcctcaatttcttcatctgtaaaatggagataataaaagtggcctctctcctcgggtttttgtaaaaattaaatgagtttagagggaaaagtgcttaaaatggtgtttggtacatagtaagtgctctatagcagttagctctcatcactagatgtggtgacgctgttggtgctggcagtagtagtagcaatagtcatgcttgatgaaattatttggaaaaggcctcccctggtggctttaaacacaggaaatggatgaatggatacccttctcaggcctccaggatattttgttactgtctaaggcctccttttaagttacaaacttatggagttttatgttttaagagtctttttaaccactatactttttatatgcacatagttaaaaacagtcaaatagtatagaagagtataaaatgcaaaaataaaagatgtcccccctccacctcattctagtcttactttccagaggtgaacactttagactatttgtttttagcccttctggtggtttctttcacaagtttatgaacaatatatgaattcatccatttattgattcatcaactgccgatagtgctattagattaatttttatattgttcgtaccagcaagatgttcttgttgggcctttggtaccaaccagctgataacagcaatttcttgatctccctgtgtctccatctacatatcataaaataaggatattggacttgttggtttccaaggccactttctaaaaagtgttaagagaccatttgaactaatttaagtgaagagaaaaaaaaaaaaagaaaaaaaaaattctgagataaaactggtctgagggttatctggatccagcggctaaaatagtattccaattttaactgcgtctctccctttttcttttatataaggaattggctgctttttatgtactggcttcctttttgtagacccttccatgatggccaggaactctaggtgattctatgcttctagacacatttcccttccatcttcagtacgaaaagtcccagggaaaggccctgcttggcctggcctgacctggattatatacttatccttggataatttgctgaagccatataccagttgactagtcctggatcacatgctcaccctgcaaccaagggcaagaggattgtgactggcagacccacaaggaatagggtagaagcgtatctgtaaagggagggaggagtgctattaccagatgaaagaagaatggtagagaataaaaacagatgtctgccacacttggagtttcaggaaattgactttaagaagaaactcattcaattctccacctactagtgagtcattacttgcttgtaagaatgcttactgccacacattcaaccattggcctcattctccttccagaaataaagcatgaactccacctacacattctttaacttagtatcagccataagcgattcctggcagtacttcacaacacttgaaaaatgaatacagacatcagtgtgatgttccaggcagacatcagtgctttagcttctagcctcaacacaggcactcaatgcggccttgttagaaacactctgtccggtcttttatgacttgctacactacacaatggacacacaagggaactgtttcctctctctgtatagggaccaactttgttatctcaggatacagtctatgttttgaaaaagtggctgtagaacagtgcagggatgggaagaatgggtcctatcaaagaaaagaactgcctagagatgactgaagttctcaccaagtactgaaaatatccccaaggcacttctcttcaaggtaaacataaacttattgcgtttttgactgataaccaaatcaaatggaaaatgggcactggtacaggctgccactgcctggaacatgatggagcgcctcacagatgccagattaggagctgcattaccaggttcacaaacgttctcattcgggtttgggagtttcacattttggatactaacaagccagaaatatataagtactgttacttataagagctctgatacatatatatctcctttattagaagatgcgtttccctttcctgtattccacacaaaaggatgcctggcaatcttttgacaggtagtaagtgacatctatgtgcaaaacactgtaataatcaagaagatagaacacatctggctctgggcgatctgggctggtgtgtgagatgataatgccactgccaaactgacagtgccatgccagccttgtgggctggagtagtatggaggagggagtaagaactgctagatgttactagggagagcttcaagaagaaatgggcattgaaatgggcacagaaggatgaagacagtggatggagagaagttggtgggggtggccctccaaaagagagcagtgcatgagaagaggccaacaggaaggaaaactcaaaatgggtttggggaacaataagagtaacaaacttagaagaatgaaaaggtagagatacagcagcattagttggagataagattgttaggactgtttgaggccaaattatgggtatcttaaatatcagatattattttagggagacaagttagatcagggtgagaggagctctgtctagacataagtttgaagtgaagtagcacatttatgttacatggaagtggatagtggaattcaggactgagggctgggttagagagatcagggagtgagagtgatgcagctgactgactccttgtgcaaagaggagtgtaaagtttagatcttggtaaggtacccatatttagagagatggagaaccagtgaaggaagtaaggcacagtcccagaagtaagagaacaaggagagttgttagtgatgtcaagggagaagagtgcttcaagaaagatggagtgggtgagcccactgtcagaggctgcagagataccaagaatgaaggcagagaaaagccatgggactgctgagcatagcacaaccctatcttcatatttgaatgaaatgtcaaagccaaaacatccaaaagagtagtggcagaaagaggggaaagggttattaacagaaccttggccacttaccactgaaatagtttccatgtttcctttaagggaaagcattatagcagaaccacatccaactctagccccatagaaactattttgagacacacaaaacctaaaagctatttttgtcttgatctgggtagaatttatctataggtatatctgtcttaagaaaaaaatgcaattgacgttagctagttagttgacagaatattcacagaacagattattcacagaatattcttccttttgtaagatttaccatggaattgtttttatctgcctctcgaatgcctttaaaatcttcttctgttttccaaaaactgatatatacgtttttcaaaaacagtttaaataggtgtgaaaacagcatatgcataaggttaatatatgcacacacacaaataagtaccatacttggacttgtttagttgtccaagtttaccagtgtctttgaaatcaggttctttataatatttaaatcttacagggctaaagaggacaggtcataaaatctaaaagtttattaggaccttaaagttgaaaaactaccccagaaaggataaataaaatatccaaagtcataaacagaacgtggcagagcaggagccacactatttgaacgtttctctactgggctgactccatgtttttacttgtaaataacctgcatgatagtggctttatttctaagaatactctcttaggaaaatgcaattgtgtgttgctgaatgccatagagcttgatggaacagggagttttacattgtatagaaatctagggatttgacttcaacagatatttattgagtggcttccctgtgagtaaagaggaagatactgaaaatggagggctcagcgaagtgggaggattgctactttttgtaaagccatttggggagtagataatggttatttgtttggaaagagatgacactctgcccttagtagtaatcgactcttataaatactgactgcataccactgttttggatgtattcaacccagcaagcataagctatgatgggactgacacaagggatggcaccagccattgtgtgatgaatgaaaatgaaaagttggggaaacattaaccatatgaaaccttaaaatatgccaaattcgtcatttcattggaagacagaaagtgaaatatctgtctgtcctttcttccctaattcttcaaaatctcagagaaattttatacttaagaccttaaagtttctcaacatctgtctcacagggagcttttccttggtgtttcaattagaaatgagatcactgattttgcttcaagcattgaaaaaaaaaaggttgaaaaacagattttttcttcaaaaatgtactttgtctatgttaagaattgaaaccaaacattttctattaggaacagtcggtattaattcattttaatgtccactaaattagcatagtttttataagaatcaactaatatcttcctgctgttttcactggccttcgcatcagtagaaatgaaaatcattttgggcatttaactgtgatgcagagtcaactcttttagaagctgacttcggattcctcccccaaaaagaggctgggactgaagcgccagcattctgtgttagattcctcaggcacatcacaactgcaggcactggcaaagcctgtcccttatcatatgcaatttatgtcaggctacaaatcctgctcttctggtggggctataaattctttggaccacatcctgcagccctctcagagccaaagtgaccatttaccccacagagagttggatctccacagacctcctagatgagacatctcaacatctggaagccagcggcaggagtcaacttatgagaaacagttcacattgctactgacccttgaagagcaccatctcccctacctctcattcctattcttcatgttacatgagagactcagccatcctttgatattccagagaagttcccaggaggattaggaattggtcatcagttgctccttctctctctctctatcggtacgtggaatgacttcaaatagagatcaactttatgcattaagacatacaaagctactgtttttctgtggcagagccaaatatggctcttattctaagtacaaaggaaaagtctctctaaaagagactcaagtcatgtgctgatttcactcaggtcacttctcccttgagccctcctccataattgtgttcagttctggctttgtttggaaagtcagcacaatttacaaaaggttcagaatgcattaaaggtcaaaaaatagggctttgtaaagaaacctatgtccttttgcaatacattttaaacttatacataatcccaagcagtaatcaattttaattctagcatttttttgtttatggtactttgtagaaaatccagatttttatccctgccttctcccccaaccttaggggaatgtatttgaattatttttgcactcacaacctcccataagcccagtgcaatacattctcatttgtcttttattaatccttactgtgtaaataaatgatcattcttaagattgggatttatataccttttcctaaggggcaatcataagttagtgctaaacaaatcaagttgttagatattgaccttcatgcagtggacctagcttctgtgatatgaagatatcaattgagctctgagtaatagaattttaaaagacaattgaagcattactataataaagttatagatggaactgaatcggtactacctgagtgggaagcccttgtaggagttttattttctattttatacattcccagaattgatacattgaagtctcatgcatatgatactgagctaatcttagccagatgggaatatattgtggaaacacctagcagcttacccctaattcacttacctaccttcatttgaaaattcttaagatttcccagtccaatatgggaccctcctagtataggaatgtcctactgaatatgcctgatgaacccaatggggtacagaattgcagtaagaaatttatatcattgttgtcattgacagtgatgagtccaccatgtttagtgtttggccaggtgctgtgaggatgccgaaagttaccctccttacttttaaagtgcttataaatatcaggaccagaggagcttatggttcagagggtgcagtcttgcaactcttcatacaatggcttctgtcatacaatcaaatattaaagaaagcatataaaccaacagcatatttattcatagatcacaaatgtttttcagctttgtgatctcaagagtttttctagacaattacgaataccccatctttattatgagcaggggataaattacttgcaatccagatattgctccagagagacatatcaggaatttccaatttacataaaagttgttttccagaagtttactttcacatcatttattttaaacttgggttgcagtttcccagagaaaaagtggtatgtagtaataatagccaacattttaacaaacgttttttgtttactgagcactctatagagaatgatgtggcaccaggctttctgagccagccagcacttcacatccaggttctgcccttggacacattacttgacctcactaactgatggtgaattttttaaatggggataaccatccctgcctcctagggttggtgtgtgtctccagtgctaggcacgtgataagtgccctatggcttcgtgatgaggagaaggcggaggagcagtgctaaaaccagccatcttagctggtctcatgacagccccatctccagttccccatttgcccacctgccactgctgttcccctgccagccacttgcaatggacataggtgaagagaaacatcccctgcaataagtaaaacattgttcttgttttaaaagttctggtttgtaaagtaaccagaattgatttgattttattctgctatgaaagataatttattgagctcatactctgaaccaggcactgtgcccatttaattctcacaatgaccccacaagctagtagccggctgagctggggttccaagccagttcgatctaactgtgactctagccctttttgtcatgtaccattctgccacttgggacagtgtttttagtgtggttaactttttctgaacttgctttaatctagtggtaggagagatgactgaattagaaaataaattaggtcatacacctctccttatctctgtcaaatctaaatctttgccccatccaaccatctgtaaaattattcttgttgaaagctttctgcaaaccactggggtagaggagttattttctataatgtatgaggggaatctattgagttagcatgaaatcaagtttgaagtcagatattcttaaatatattcttaaatatgtatttaaaaccttaactgatgattcagatcctaaaggccctggatgttacagctgcagtaaggtataaaagtgaataaagtcctcagaaggaaaatatagccacagatttttttttttaagtcacattgaaggtcagggtccttttatgtgttacatgcctgaagtagtgtaaagagcagggacagacacaggttctaacctggctctgcaggtaacttgctctgtggccttgagtgttacttaaaaccagtcttcccatgtgtaagtggactgtgccaggtctagacggtcccctttccttcagtatcaaaacttttagaattgaaggatgggcaagagtggggaatcgcttagattttttgaattaggggtatggaggagagcggggaaaaaagaagctgggagaaatttgatggattacttgtgtaagaccaaagatttaaacacatgacactcaaagtacatttgcaactagggctatctagaacgcttaacttgtcatactatttggaaatacatagtatttccaaaatactatggaaatacatactatttggaaatacatagtatttccaaaatactatggaaatacatactagttggaaatacatagtatttccaaaaagttcagtttcatgttttcagagaaaagacagcagaaaaaaaaacggagaaactaaagaagtaatgaatttcttatgacaaataacttctaagtaatttccaaaagctataggcaaccttgcctttctggtacctttcattctttcggcctttttatctctgtgaaaatcaacttttctaaaaatagcttaatgaggaagaagaaaatggtaaaattgtgcatttcatcacatcacagtccagatatgaaatccatttaactcaagtatttaaaagattatcatttgcacagaaataaagtcagacactttaaaattcgaaataaatgtttttgcgctccttttccccacccctccagtccctgcatattatattcttgatgcctcactgaaccacttaaaaatggtgaagtcaaaacgctagtaaagttcttcactacagtatatactagcagccaaatcactagaatgcccattcatttcttgtgaaatgctacgttaataatttcttaaactgtcacttcatactaaagttagcgcttccacagctttaagcccacttgggttagcaaacatgatggttctttttaatgcccgaatgaataagctgacccatggagaagttgagaaccaatatagtcctggtctgggctttcctgccctggtttctgtgaatactggctctcaagagtcactccctaattctggggccagggaatcctcacatcaggtacagagcgtgatatgatgtctgtagctacttcagcagagccaccacacacagcaatttgctgatgccaggccaagccttaaatacttaaaacacagctgtggctttggccattgtgagcccaggtggggacagagtaggggagcagcgcctttgaggagagccacacagatggcttctaatccagatgcagaggtcagctgaagggtgtggaagagtgttgataaacatcctgggactgggatgcatgctgccctattgaggaaatgtaagagagacagcaaaggcagggagatgaagcatttggggactcggaatggagagtgctggataatggattttagagctagtgggtggtttttatgagttctattcctgggccagttctaaatgcatgaatgccagagcacatgtgctggacagtctacccaaaccacacagacatctggaacttcagggcagtggtgaatcccagcagtgacatgcctacttttaaaacactcaagttcaataggaccccacaaagttctttgctgttcaagtatttgatgctctgtacatattaagaacatagaaccatctcctcattacacctttcagttcccaagaaagtgtgtctttgtcttctcatggacttaagtgtaatcactttactggataattatagaagggaacagaagacacaggacagagtttagaacttgctgatgttcccacagctcatgatacttgagaaaagacctagatattttttcactttttattggccacttcaattctttgtattgctgagtctctgaaggcttgatttttgcctatggataagaaagttttggggtctgatttttagttttaaaacgtttattgtctattcatagataacttgttttatctgcttgttacagtgccgccttctgttgaagtttcttttgacagctattggtccctatgtttacctcatgtgaataaaggaaaacatcctggatgtacagcaaagtttttgagtaaaagagtgagatattagatcattgctagctgcttactcttatttcagaaataaaaatttgaactatctcttctcaatggtaaatatttggggaattaaatatacatcattacaaaatttttgctattgtttattgaacacctacctgttatagaagtcacttgtttacatgtgtttgaaataacatacaatatcaatgtgtattaaggtttgtgtaagaaattcgcaattcagtttactactaaaattttgcataaagactttcttaggggacaaatgtagagattaaagtaaattttttaaaaaatccacctgtggtatttattgaatgtagagttgacagcactgaaataggcaaattggactaacgtaaatctgccaaatataacttcaaccaagtgtttttttgcttttaactttctcatttgatagaattcttttaccaaaaattggctacgaatgagaggactgagaattgatgtcgaaacgtttttctcttaatatttcttgatccgttaaaaacaaattatggctcctggaagtcagacaaaatttccatcaggatttgtaaactggttgggatcaccttatgtgaaacttaaatgagagtgaaatgggcgagcatacttcactgacttagcgcttggtccagaatgaactgctggccccacacttgggcctgctaacgtgtgcccgttccctgggtgttctctgcagctggcctaagtgccaagcgatgtccacaagctgagctcactcctggaatacacgttcctggccgttccatctctgaaggtgtcacttctctttttccccccagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcgtgagtaaccgccgcggtcctccacttccctgcccctccgcctcgggtcgccctgggactcccacatctccatacacgcgctcccatcagcctgcaacccagagcgccccagtaacatttcacacatttctctccgtgcgatgtaaaaattcttaacggcaatttgactcagtgattcttgcgtagccacttaacattatcaaaatcagaactttttcctctgaattaatatgagattctcatcaggaactattcaaaatctatgcagtgccctctcttaatcattatgggggggggggtgcttagctatcatttattgagcactgtgctaagcaactcacatgtattatttcatttgatacaacattcctaagaggtagcattgccccagttaaagtactgaggagtctaggagttaaataaattgcccagggtcacatagccactaaaccgagacacgaatccatgctctcaccaccaaactatgtgttttattataatatttcatgccagcattacaatggatgtgaaggagtttggttattaagtatatacttagtgtttttgaaaaaccttaattaacagatttaagaaataagcctttgtgtaaatctagtgattgactggaagggggcaaaagcatgtaaatgtctttatgttttgatgtagataaatgagggtgtatgcaacctagtggagaaattatgatgccagttttgtccctggcctgtgacctcgagatacattacatgcctcctctatctctttctgtttgcaggtgatctaatatgtctctctttacatcacagtgatgatgtggcagccctatgaggtctttaaaatggaaaatctttgaggataaataacacctacagaagtacagtaaaatcctcaaaaaaatacagtacaggtgttaggcatgtttggttgaagagtaaaatgagtaaatgctagtacttactcattttactgaagatttcaaaaatgaggaagtgctcacaaaggttaagccagcacccatatctcaactcttccttctgaaatcctacttcagagtttgccagaagcatactattgttcagagagaaaaagaaggaactctactaaacagtaaaaaggagaagatcttagaattcaagttattttcattcatctataaaagtgttccattgctaggatacactaatgccaccttaaaggcaagcattgctatgtcgggcctcgacaaaggtgtaccaggcagcttcagttagcaatgcttcttttgttgggcacttcctaaatgttgattacattaatttgaaatgtggcttcttctcaaatccttattgggtgaaacacagtccaatgaatatataaagaaacaagtccaaaaaaggagccaaatatagtaatgatgtgataatggacttctgttgaaagttgtcagtcaacttgtctgaggagaacctttgtccttctcccttgttttttctctttgagcttttatttagctgttagaaaaggaagtgtattatcttggtacaaagaagctgttagagagacccaaagagccagagtttgttgcatgacactttttcatcctctctcattaaaagggtaccaagtcttgcttcccaggaagaggagtactgtgtaaataatctgttctaatatttctcttatagaatttgatcaaagattcgtttttcaaaggtggtgatgattgtgccatttatcatttgtagtagaaacagcagtttgtgctgatcagtgactttgaaaccttcttaagataagcaagttttaatggcttacctcaagtaacaggagcacttgcttcttgtcagcatctatcacagtgactcattttatggagtcaaaatagcttataattgttaccacaagagtccagtcgttcctgccatttcttaaaaattaatggagaagtcgtgccgattttgtggccatggaaaactgtacccaaagatagtgaagtgctgtgacatcaaagtggcaataccagactacagatttttagctccatgcctgctcagtaagccattattatgtggttaccgttttgtcctcaaggaattttcctgttgctaaatcacgcatacttgaagaattcattattttggtttgataaatgtgtcttttgaaacatgtttttcctctggcatactatgggatctgtcatttgcattctgaattaaaaacaaaaatgttactatttttgtttaccataataatccaaataatttgccaaagattgagtgtccctatcagggctgccatgactttggcatcctggaacttgcaggaactgccaagttatcataagatgtatatattcagtttcacttataagtgttatttctttagctggatagttttgccatatatatcaagtaccaacaaattggttgattatatgtaacacaatgaagtagaaattcattaggtttttttcacttgccttgttttaccaaaatcttaaatgtaaatttccaatatcttagttttcttttcttttcttttctttttttctgagacagtcttgttctgttgtccaggctggaatgcagtggtgcaattgcagctcactgccacctccgcctctgggttccaacaattcatgcctcagccacctaaatagctgggattacaggtgtgggccatcacgtccgtctagtttttgtatttttagtagagatggggtttcaccatgatggccaggctggtttcaaacttctgacctcaggtgatccgcctgccttggcctctcaaagtgctgggattacaggcctgagccactgtgtccagtctctcttagtttgcttaatcatacttgtatacttgctgttttattctgtttgtttcacactgttcttattttcatctgtagacaggaaggttagtaagtactaagtttctaaacagtctgtggagataaggttctgtttttcatatgtttgggtagcagaggtcaaagcagggaacaaaggtcatggatgtcagtgataaaccacaaagccgaggcaaaagacagtaaatctggggaagaaaggcatttgaggaactgtatgtatagaagttccccagaccgcagtcaaccaactgcatgctgttctgtgagccggagagaggttgactgcggtctggggaacttctatacatacagttcctcaaatgcctttcttcctttatgctacatcttccccaaatttactggggtcactggcaaaatattgccctgcacaaagctgtcaacagatacaaatattaagttgacaaactcttttagatggaggcagtaaggagagcatgccttagagagaaatctgtttgcacttttataaaattaatgtattctattcccctcactattgctggtaagttggtgttacagcctccattgctgtaaccatgtttctccacatagtaaatcagccctaagacacagaagaaacccagaagatttggcagtgccgacaggcatagtgtggcagttctgctctgctggtctctgagtggccatactaagtctgaagggtgaatcagatcagacccatccctggaaccagactggcactgtttcttttgccatcttcacattcttggaatctgtgctcataagggagtgccacatagccacagtgccacaatgttgtatgctcttaactacctcttttatataagcagggctttggtttgaaatgttgccccatgtttgtcacaaagaagagcatgtgtcaataagagcttttatacagatgtattaatgacagcttttattatataggcccacagctccttatggacattatctcattgtcgctctctttctccctcataggaaacgggtaggtggggacactatcatcgttactcaagaggtgacgggatttcccagggttctggaagaaatgcctgagcaaggagagcatagcgtgacttaggttcatctcaaataactctaatgtctaacatttcttgattaaagaaagctgttgtagaagcagcaaatcagaatccccgagtcaaggaaaactttgtaacaaatttaactgtactttaagattcatgacacagggcattttcaccagttttcaagtcaagactgtggttagatagtaaccagtgaaaaagaatccaacagatacaagccgcaatgtactttgcagacatctcatctacctatctttctcctatttttcaggaaacagatagtggggggcttttcattctctgacctgaaggggttggaggtgttattactgggctcattagggtccagtatcttatcaagttgtatccaatcctggacaagtatttaccaacaaattagtaggcaaggcctccaggatctgctgcgactgggttattctgttgaaatgtctctgcccctggggcagctcaaaatcagacctgtacggctgtgtaccaagttgtacagaatgaatgaacagaagtaacccgaagccagtggatcacgaggtcaggagatcgagatcatcctggccaacatggtgaaacaccatctctactaaaatacaaaaaattagccgggcatggtggtgtgcacctgtagtcccagctacttgggagggctgaggcaggggaatcgcttgaacacagtgggtgaggttgcagtgagctgagattgcgccattgcattccagcctggtgacagagcaaaactctgtctcaaaaaaaaaaaaaaaagtaacccacgtgcctttgtcattttcttttttaaagaacccaaaatataatatgaggagaatttgatattacaataaagttatctattttcctttaaatatgagcttaagttacccattttttgtactttaacagcctttgctttaccgtaaaattcagtaaaaggaaaacagaattgatatacaaaagctcagtttgtatatcttgggctcttttatatattaatacattacattcttgaatataagtgatatttaaatgccaacatgttaatgagtttgctcactctgaaattttgtggaatttagttaccatcagatttcactgaatgtgagaagagtagaataagaggacttgtaatagttaaattctctggttgattctggtaccttatctctttaatcaatattgtgctctggaaatttgagtttctgaaatctgctcacagaattgacctgcaatagcatatcaagggaaggatgctttcaagattattcagtagccaaaaaaagagacctcttgggatttggtggtgattgaatctggaaaattttaccttccagatgcttgtgtatatgtttgagatgtttttatcccaaccacatgaatattgtttttaaatgacaaatgacttactgttaaagccagagtaaacagatcagtaatgttttttgtacagttgggctgagtgtgtatacaatgaagtatttagtgcaggaggcctgttacaaattgtttattggttaaggtttgcctctgagtatggatttttgtgaagagttctggttttggtaactactaactttgaatactattttatttttttttaattgtgcaaaccatcaaaaaaaaaaaggagatcatgtctttgtcaccactctttttatttcctaatgagttgctactcttcatttatcaaaagaaggtgccacttcagggagcagaactacaaccatcttacattaaactctaacatagcattagttttataggaaaacaaactcagttgccaaatttttgcctcaaaacttataactgcttttctttcctcatgcctcccctttcaaaatactccacttttatttctaactctcaccttgcatgctacccctaaaccctgtcctcaacttttaatttcgtaaagtgtttctgaattacgttagtccagtgagatgctctgaaaaagagaagaggttccatattagaataagtgtgagaaaactgtattccatacctctttcctcagggttcacagtgcccatccgttggccctgccaggctggttctggtcacaggacctctgcactgccaagctctccctgtaggtctcacatagccagccacttcctatggtttaggccaccactgtagagtcacctcctcagaagtctgatggaccacactgtctgatacagtcatctgctcatacttctgtcctttcattgcgtttaccacctcctgatatgtcttgccttccattcttttctcttatctctttctgccatatccaccataaaaatacaatttttctaactattgtgacctagttcaacattgtatttctagcacctagaacagagttgaacactgagaaggcaatcagtaagggttatttgcacattcttgtaaattctggtcaagaattcttggcatctttttaaactccttcccctcttccattctgtttatctcagccaatcttgtctctgtgacttacttccatgctgaatattttctgtttgccacttcagatccactcttactacaccaggcgctgttctaagtgtttagtacacattagttcatgtagtttacccagtgatcgcatcagatacgagctgttaatacccacattttacaaaggaggaaactgagacatatggtcattaggtcactagcccaaaccacacagcttttaagtggttaaaacaaaacaaacaaacaaaaaaacaggttatcacgtctgtttctttattcacgctgactctgaatttcttcttcttctccactctacttgtctacatccttgtcatctttcaagggcttataacttgcctctttcatggagtcttctgcagtcattctagccagcactgttttctgtttcttttttattcccattgcatctagaattggtaccacatggtttgctccttaacttattccccaacttggttattagcctttgtgatcaaggaccatcctttaggatgtgggggggtctttgccatctcacttaaataatgttgagtgcttgctttggcagtgtgaatactaaaattgcaatgatacagagaagattagcatggcctctgtgcaaggatgacacacaaagtcatgaagtactctgtatttttaaaccatatagcctctatgaaactgccatttttgtaagttaaaaatgttcaaatattaatcgttgtaaataattgcccactggaatgttttcttattccccctcaagtttcaatttcaagcactgactgctaagattggcatgtctccagccacgtacatttgcaaaaagtcagatttgcaatgtaatatgtcatggagctcatgcttgttgaagagaatctttgataggctggacacattcattttagtaggaggcagaggtggcctaacagcaaactctaggttcaggatctaattttcatagccttcaaggatgaatgcaatataaactgtgtagtagattgtgatgctcattccaactagggaggcaagcatttgtacctgctatctacaaggcaccaaataatgcatgtgtcaccattgctataaattgtcctcttccaggacctaactatttgggtaaagaacctacagttcccatcaccacctatgtatgtatgtacaaacataaattagtccaaattctaattttctcttatttttctttgtggaaaaacagataagaaagctcagtaaaggaagatataagcaattaatgttacagttcttcaatataataatttgaattaaatgtactaagaagcaaaaactattagtgttgagactatcatgatgaagcttttggtttttttaatatattttcatttttatgcataaaatcttaatacatagaattccatgatgtcatcaggcattaacaatcacttaccttagaaaccaactctttttttctaggcttaacagggtttgtattaatgtattggcctagcactgggccctgctagatgctcaataaatatttgtctaatcactattagacattttaaaatatcttttggctgggaacagtggctcacacctgtaattccagctctttgaaaggccaaagcaggaagatcccttgagcccaggagtttgagaccagcctgggcaacatagggagaacctgtccctacaaaaaatggaaatttagccaggcacagtggtatgcacttatggtccctgctacttggaggatgactcaggaggattgcttgagcctcctaggatgtcaaggctgcagggagctgtgatcacaccactgcattccagcctgggtgacagagcaaaacccagtctataaaaagaaaaaacatatttcagtttatttttatttctgtgttaattgtttagaaccaagaaaatatgagtaccttaaattctgtaagtaaagaggaaaatgtctttaacattgtaggaaattaggaattaagtaactgcccttcatactggtaatcttgatatgttgaaggaagtgacttgttataagatagaggccaggtatggtggctcatgcctgtaatcccagcactttgggaggccgaggcgggcggatcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggtgccactgcactccagcctaggcaacagagtgagactctgtctcaaaaaaaaaaaaaaaagaaaaagaaaaagtagaataatcagtttttacttgagccaaagactaattgtaattataccctttgaaaggataaattacccttgtggcagggacacaaaccaaggtgacaactctatggaatgttccagagcagttgttctaagtccctttaagagtcaaatatactgagaaatgcttcccaaggaacaggacttattctacagtgaatagacaggtattttcttgtccaagggaacttgtggctgacttttaaaaaccagttctccgctcctccgattgagatgacctgttctgaccttgatggtctccctgtctcccctttctttttcatttgtgctgagaacacagctcttagtgtagtctacctgcagaaacacagtggtgccttctgtcattgaaggctgctcatcagcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatagtagagtgatagatgctatcaggaaaacaactaatgggacaagcttagtcagggacatcctttccaaggagtcattaagctgaagactgatgataacaaccccagataaaggagtaggaggggagagaggttccaggcttgggaaaactagcaaactatgcacgtgtttgttaaaggattccatggtactagaaattgaagttataaataattcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattcgatgcacagggtttactgacttatgaaacaagtctggggtagggtagttccatggtaggttaagacagtgcccccaaaacattatcagggcccaggtattctccatcttttcagtctatcatcattggcacatatgggttctcctcttacagttatggagtgaacaatgccgcttttgacattgcatttctgacacagtgatatccagtgaaagaagaggggcatttcttccttctgtttcttttcagagatgagagaattttaactagagcacctccaccctctgactaccccccactcctccagtctcattggcccaggctatatcgcatgcctttggccaaactaatcactctcgaggggattgagaccatttaaattggcgtacattaattaccccctgagtctggggagggggatcacatttctataagcacattgaagggtgaacactcagcaaaattaggaaaaaattcagcaaggaaacaaaggggagtggccaagaggaaagaacagctgttgggaagaccaggagcacaggcctcaggagtgcatggcatcatgacttaggagggacggtggcagagtctttacaggatcctcagagtttctgctgcatacttagtgactgttttgttcccagcactggtgggtgaaaccgtgaacccagtgtttaggtacattcttagccttacttgtgctttctactgtatcagtgaagtgacatgaggcacacagtgccttgacgctttggcagtaaagttttgtttgtttgctttattttgtgtgtgtgtgtgtgtgtgtgtgtgtggtttttttttttttttagacggagtcttgctctgtcgcccaggctggagtgcagtggtgcgacctcggctcactgcaacctctgcctccagtgttcaagcaattctcataccccaacctcccaagtagctgggactacaggcgcccaccaccacacccagctaatttttgtatttttagtagagacggggttttaccatgttggccaagctggtctccaactcctgacctcaggggattcacccaccttggtctcccaaagtgctgggaatacaggcgtgagccaccacacccggcctgcagtcaactttttaaactttgaaatatcttatcatgaactatgtaatataaataaggaagtatatacaatttatacgtatacctcaataaaatgaaattcttatccatttctagtacctttgaagcccccatttgaccctccccaattgcatccactactctccctgagaggtaactgctaccctgaatttctgagttaatgattctcttctcttcatggttttaccatgtatgtatgctcccctcagtttctttctaaaacttttgcatgtaacacctagagaacttgttaaaacacagattgctgggccccaactctgaatttgtgattcagtaggtctggagtgatgccaaaaatctgcatttctaacaacttcaggtcatgctaatgctgctggtccagggaccacaccttgagaaccactgctgtagcagggggctgttttgcttttgcctgtttataaatacaagtatatcatatatattcttctgtgacttgctttttttcaccggaactttgtttttgaagttcagctttgttgatatgggtagcgataggtcaattcatttccccattgcttagtattctatttctcattaatttttgtccactgccctatgagggaagaggaagaaaaataggaagcaacttgcttaaggcaccaacagaagtgattctgtacccctcaagcatccagcaccaatgacccttggctcacacagctcaggtcattgttgctgcctttggaaggaaagaggcagtgagatatcacctgtcctaagagccctggcctcaccagaagttcaggaggctttgagacaccaggcacagcaggacctgcagacctcccagagccctcttgtataaaatagacctcaaataacattggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaacaatcctgtgacctcaacctcctgggtagctggaaccacaggcacatgccaccatgcctggctaattttttatttttgtaaagacagagtctccctatgttgcttaggctggtttcaaactccagagctcaggcgatctgcccgccttggcctcccaaagtgctggaattacagatgtgagccactgcacacagccacattattttattacccttgaatctcaacatttctcttgatattaggatttgaatccaaagacaaaagagaaaacgaaaggccttccttctattcagtcttcactgctttctcctatgcaaaaaacctttctaagagtgaagagagtaagtgggaaagaaaggaagaaggaagggcagatatctggttgggagaggaacaaatgagcaatgccaatggtattaaaaaaaaaaaaaaaggaacacagggattccattctggctgatagggttggggagggatggagaaggtgcgctttggaatggtttgtatctacccagaaacagcgaactgcaatgaaagtatcaaaaagagaatttgttttccatggtatgtactacttacacacgcacacaaatctactagagaaaccattggggaagttctgttcttttctcccagactactactagatattaattcagcatctgaaagagtaaaggctgttccaaaatcttgttctggtttgttagagcaagataactaaactgtaggaaaaaataattattttacagctgcagaactgtagagtacctaaatagatttggtaaaatatatagataagatgttttctccactggatttaagtctttcctcatcagtttttgtttgttttttcatctcttttgttgatgctatccttttaaaatactcttttctttttaaaatactatttccagaatattttaaggggatgggaaaagcaaatctagaaaataagacttaccaggtaaaggagaggaaccttctgtagctttattaaggaattgtcactggaaaaatttgcctggctcttaagtacaagacaaggatctttttgtataaaatctccctttcagacacctttttcagagtagaaagctctctataattatgttttctgagaattttaattatcaaacattgataagtaaaactgtgagaacagaccacacttgaaagctggagagcagaggaggggtgctgaatgctgattttagtttattagggtatcttaatctgattaagaaagattaaaatttcaatgaagttttgtgttagttactcatttcactgagtatagaagattttcacaagaggaaaatattttctccctgaaataagtgattgcatgtgtaaatgtacatactctggaagttttccctggctctgtcaactaaatcttttaaaagattaaaataaatacatatgggaactttttcaagccaggtaaggcatcactccagcttttttttttttctttttggctgtctatgtcaatgttccttatgaactaagattctcttggttaaggtaagacttccttaagctattggtcaacccacattatatatattgtatgtatatttatattcatctgtttagcagtgaataacattcacagtaagttccacaggtatccacacttgagagcttaaaatgacaagtaaggtttccctttttagaaaatgggattctcaaccaactttttcctaatattatatatcattctctttcttatctttggtgtctgtagacacgggcttttatagccagatggcatagtgacttagaaaaaaaactgtgaagtatatttggcttctagtggtagcaggtgcattctggtgaaggaatagatatgaaattgatatttctgcttataaggaacagagtgaaaatcactccaggcctgcctttgatgtgttacaattctccgtgaaaagattagggaagctttttaagagatcaggtatttaagactctctttgaaaattgaattcactgattttttaataggtgtgagaaaattaatttaataacatagtggactcagatgcttcatgccgccctcagactcctacctctgcctcttcttgtcctctgacctttctttattaagtgaaataatttgaactgcaggactatttgtcatttggcacttgacttgtttcacttcccggtttcagctgggattgagatcagcaattactggaaattgtaaatttacccaacatattttcctgattagagagcttccaatcaaatttgcatttatatttagaagtttggaagtttatctgaaataatttctgtacattttttagattctgccttaccaattattctctatttctaatcaaacacttgcttataaaatgctcccgatgaggcaggtggtatctgaaagttccttccaaacctgtaagtctaaggcactttagaatgagtattcaagagcaggtatcaccccaacagtcacacaaaaatgccggcatttcttatgtataagaatggcataggtaaaacggtttgggccaattccaaagtgctagctgcgagatgcaagaacactaccactttctttgcctgatgggcaagcagtctgcttctgggtcaagtcaattgaggctgttagctttggcaagtgtcttgtgtaatcctgttgctaattcagccatgtgcatcattctctgtggattataatagttgccgccaatcccctacattacacagcagcctgggaaatgctcttagaggtaagaaccccatcactgccagctcatccacatcttcctttagctaaacatttactgagcacatactgttaaatgactgatagaattatttccattagcgatacctgttctttttttagtcagtttattctccttttgagtatctttgttttttctttcagtcagtattagagctgacttgggtgttctgaagctgatggatggctataaaaataacatttcttttaaattgtattttgctgtttaaatatctttttttccatgtttttcattaaggacatgacaaatcttttctgtgtggtttcttccttgtcgcttattgctcactttaaatttgtgctgtaccaattggtggctctctggattaggccattagtactagaaagggaggtaaaaaggtagaacaactgaagcaagaaaaagaaatatgcaggtatctgaagctggagagagaacacttacagaaaatcatgaaagtgtgttgttttttactctttttcatagggcagtacatatttgtgatttttttctaattttgtattttttgtgacttacgttgtttagaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctgtggaaagtagagggcaagtcacagaaaagcagtattaatatcatcagtcaacctcacagctaatttttattgagcacatactatgttaagtgactgacagaattctttccatcagtgatacctgttctttttattcttcttcttgattattctcctttccagtacatttccattttcctatcctaagttttatgcaaaataattttgtgtggagaaacacattttcgccgacattgtctgaaataactagtgaatatttcccattagagttggaccttgaacaacacgggagttagggggaccaaccccaagcacagttaaaaacccacatatggccgggcacagtggctcatgcctgtaattgtagcactttgggaggctgaggtgggtggatcacgaggtcaggagatcgagaccatcgtggccaacatggtgaaaccccgtctctactaaaaatacaaaaattagccaggtgtggtgacgcacacctgtagtcccagctactcgggaagctgaggcaggagaattgcttgaacccgggaggtggaggttgcagtgagctgaggttgtaccactgcactccagcctggcagcagagtgagacttcgtctccaaaacaaaacaaaactaaaaacacatatacgacttttgactcttcaaaaacttaactaacagcctactgttgaccagaagccttactgataacaaagagttgattaacacgtattctgtatgttatatgtattatagactgtagtcttaaagtaagctagagaaaagaaaatgttacaaagaacatcttaaggaatagaagatacatttacaattcattaagtggaagtgggtcatcataaaggtcttcatcctcattgtcttaaattagagtggtctgaagagaagaagacaaggggttggtcttgcttatctcaggggttgcagaagcggaagaaaatccatatataagtggacccatgcagttcaaacctgtgttgttcaaagatcaactgtttagtcttaatatctagtcaaaataaaatagaaaatattatctctttatcttctttcacatatatacagatgttcttcaacttagtatggggttatgtcctgataaactcattataagttgaaaatattgtaagttgaaagtgcatttaaggcggggcgcagtggcttacgcctgtgatcccagcactttgggaggccaagaccgggtggattacctgaggtcaggagttcaagaccagcctgaccaacatggtgaaaccccgtctctactgaaaatacaaaaattagccgggtgtggtggcgtgcgcctgtagtcccagctacgcgggaggctgagacatgagaatcgcttgaacccaggagacagaggttacagtgagccaagatcgtgccactgcactccagccaggtgacagagcgagactccatctcaaaaaaaaaaaaaaaagtgcatttaatacacctaacctactgaacatcttaggttagcctagtctatcttaaatgtgctcacaacacttacattagcttacagttgggcaaaatcatctaacacaaagcctatttaaaataaagtattgaatatctcatgtgatttatggagtcctgtaccaaaagtgagaagcagaatggttgtgtgagtactcacagcaccgttactaccaaacgcatattgctagcacaaaagtttcacttaaggaaaattagaaatcttgctgcattcttattatttctattattagtcttcacatctttttttctaccattacaggacattggttctcctcatgcttctgtagggagtcctctggatggtcaaaaggttaagcttttcacctttcttctccttccagtctttctctgtgtctgttttcttctgttcttcctgttttacgtgtgtttctatcttttctgccatatattaattataaatgctatgaccagtgtctgtttcatttaatatcagatacacaaaattactgcaacatgagttttcttgtcatgtatttaccagcttgaatttatttatttatttttactttatgtatttatttatttatttatttattttgagatggagtttcgctcttgttgcccaggctggagtgcaatggtgtgatcttggctcactgcaacctctgtctcctgggttcaagcgattctcctgcctcagcctcccaagtagctgggattacaagtgcatgccaacatgcctggctaattttgtatttttagcagagatggggtttcaccatgttggtcaggctggtctcgaacttctgacctcaggtgatccacccgccttggcttcccaaagcgctgggaatacggcatgagccacagtgcctggcctctgacttgaatttaattctgtcattagtggatactctgaacattaaatcaagaaaaatttttcatttgttatatatacctttctatggggaacaaaagtgctaattcttcaagggattaatttgatagtaattagatgaagcaaaacaacttgtggtataactcttgcagttttattcatactgttgtatttcttccctcaaaccaacaaacttgttttttaaacactgagtaacttctttaagagaaaacatagttaaagttatctttcatttaatattaaatagggaatatttacatagactcccttgtcttcattgcacttttttgttttggagacagggtctcactcttttgcccaggcttgagtgcagtggcacaatcacggcccactgcagcctcgacttcccaggctcaagtgatcctcccacctcagcctcccaagtagctgggacaacaggcatgtaccaccatgcccagctactgttctttttaaattttttgtagagatggggtctcactttgttgcccaagctggtctcaaactcctggccagaagcaatcctcccacctcggccttccaaagtgttgggaattacaggcatgagccactgtacctggcctttaatgcactttgtaggcaaggaaattgtaggatccaccgtaatcaccacaggaatgttgatgggttgttttttttttttaaagcaaaattttggctagactgtcagtcctattttttcttctaaagatggtgggttcctaacagctgcagagctgaggaggcggcccttgcaaggcagggattgttagaggtgggggaaaaaaaacaaacatttttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactttccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaaggtgagctgggagatggaggctttttaagagtcattctctgaggaaaggtttagcttccaaaacatagcatgccagtaggagaaagagatacaaatgatctttctcaatacccacgatataaagggttttaaatattcttaagttctgggccatcttcaggaggcattagaaaccaaaaaaggtggtggggggagtggagtttgggtttgaagaatagagaataactaacagggagctcttcacacacctatatcatttattcctcgttgttattcccaaatcacaaataactaaactgagttctgtgaagtgagtttccaaggtcagagagctggtgagtggccaggcctgcatatgaacccagtgctctgtaccatacagacaagtaatgctcaccactggttgtaaaaacttccaatctttaatcaaaaaaccaaggctgcttatattaatatttacagagggaggtggggtgaagaatattgtttagaacggataatgacaaattctgataccatgcaggactaggatgacctggatgggagctctctccatacaaacatatggaaatgctggataaggagctgccctatctttaaaggaaggactagaataactgtttactagcccagcaaggcagtaaacaggagtacacttttccctagagcttgagtgaaaagaataaaaaaaagggaaaaaattaaaacccctaaactacactatcacatgatagggagccaaaagctgagaaatgtgaaatttagtgctggatgattaaaattcttagaagcaagcaaaaagttgccttatataaaggtaataatatgtgaagaaataaccatgaggagagttgtgttaggccgtttttgcataaagggattcctgagactgggtaatttataaagaaaataggttttattggccaagcatggtggctcacgcctgtaatcccagcattttgcgaggccgagatgggtggatcacctgagctcaggagttcgagaccagcctggccaacatggtgaaaccccatctctactaaaaatacaaaaattagctgggcatggtggtgggcgcctgtaatctcagctacttgggaggctgaggcaggagaattgctggaacccaggaggtggaggttgcagtgaccaagatcgcgccattgcactccagctcagggcaacaacagtgagactccgtctcaaaaaaaaaaaaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgagatttggaggggacagacatccaaaccatattaagagtcatagtacaagaaacagaaaaacagaaggccaagtattgcacaatattgaacaatcttaagtaacctctaaaataactttaaaaagattgaaacaattttaaaaagaatggaaactataatgaaagaacaagatagtaccaaaaaatacaaatttataaaataagcatagagcaatgtactcaatgaaataaaaagcttaatagtggcataaaatgaaagagggaaaagtgataaaaaaatacctgacacttttaggtgttaatttcctatagctccatggcattgttttgttttcccaccatggcaagttttaccatcatgttcttttcttaaaactgaatcgcaacgccaaagtcaaagatcaaagaaaagagccttgaattttcaaaccctatatacttcctaataaaatgggatttttaaaataaactccattgttatagaaaactttttacaatattcttggcataatctgcattaacaactgtgtattcacaacatgttatcaaacgcatgtattaaaaataaatttgtagtttatgaacgaaattcaataaggaattatatcttgaacttccaagatattcacaagaagattccatattactttcaaaccttacacaaggcttaagatcactgatcaaattctaagattattgattcttatagaatactacattaacatgaaagatgggcttttgtttttaatatgactgtacttttttcctaatataaatttaaatgtttcacagctagaagggacttaattgtttaaacttttcattgttaaatgttattctttcatccctccttcctctccctcaaccttcattctccttctcattgttttcttccctctctcatttattaaaggtctactttggcatatgccatataaattacattaggattgttaaagtatggaatattcatgtttaaagaaatacatgtttttttaggcttatgttttaaaaatattttattcctcccttgacatgcttgttctagttgagccataggaagactgaaaataatttctgatttaccctgttctcgtgcttgtgccctcccgaatttctccctccattagtacgcttggtaaaattttggaaatatttcttagatcttatttgaaagttgtatgccaagtataatggaggtgaaaaatatgattaaagaaataactcaagaactggcattgtggcaagaatgcaaaagggaagaaattgtatacttattacagcttcttttttccatcagaaatagtcaaccatagccaggcacagtggctcacacctggaatcccagcactttgggaggctgaggcaggcagatctcttgaggtcaggagtttaagaacagcctggccaatattgtgaaaccccatctctactaaaaatacaaacattagctgagcatggaggcgcacacctgtaatcccagctactcaggaggctgaggcaagagattcacttgaacccgggaggcagaaattgcagtgagccaagatcacaccactgcactctctagcctgggggacagagctagactcatctaaaaaaagaaagtcaactactaaaaagtaaaataattatgaagtatgatactttacataatttaagttttacaactcaaagttattagtctagttggtgattactttttagattctagagtttaatacgtaatatagtttctgtaaatttggagctacctgaaaaatacgagtttgaaaagttagagcagtcatatcctgataattcatccatttatttagtgctatatatttctggtcttttcctttcttagaatgcaggtttcaaaaagatttttcagattcaaatactttgacagacagttgaatttgaatgtcagtttatgttaccaatttacatactgatttatattaaggaagaagtttgttttaacaactaaagggtctaaagtatatttgttttgttaggaatcaggaatacttttggctgcaaggaacaaaaaatgacaacaaataacttgctgtggcttaaaaaaggaaaggtttatttgcttatctagtaagtctgcaggtggggtgatgtagctattaattcagcatctcagccatgttagggctgttggcactgtgattcattatgatgggcctatctttcaactgtgttgttcataacttaaatcgaaaataataatgaacttagccaggcatggtggctcacacttgtaatcccagctactctggaggctgaggcacgagaattgtttgaacctgggaggcggaggttacagtgagccaagactgcaccaccgcactctgcactccagcctgggcaacggagcgagaccctgtctccaaaacaaaacaaaaccttagaactcggacatccatggacaactggttttgtttaaaagtgagggaaggaaggaggaccctttggactacttaaaaatattgtatttaatcaaaatttacttttattttttacattgtttcttttgagacagggcctcagtcacctaggctggagtgcaatggcatgatcatggctcactacagcctcaacctcctgggctcaagcaatcctcctgactcagccttccaaatagctagggctatagacatgcaccaccacacccagataatttttttattttttgggtcttactatgttgcccaggctggtcttgaattcctgggcttgagcaatcctcctcagcctcccaaagtgctgggattataggtaggcatgagccactgtacctggcccacatttaattttttatcaacccaagttacatatctgaaaattattatacttttcaatactactgtgttttctttaacataatggggataggtgacaaacatttaacctttgatcatatgcttcctggcccagaaataaagcagtagtattccacccatcaccaacccttagtcatcacctccctccctaccaacctcttttatttgtcaaacacaattcagtgaaatgattagagtttggggtctgcttttgttctccaaaacaacctttttacctttattttataaacaatacattttaattgctggtacatttgaaaaaagaaaaatggccttcatagaaggccacttcatagaaataatggcattctatgaatgccatgaagtaatgccacttcatagaaataatcattgccaaaattcaatatatcccttcatataaataatatatgaatgtaagtgcaatatttttaaaaacaaaaggaagatatataatttaaaaactcaaatagaatttaaattgttacctgccttttttcagtgaaaaatcaattccttagtcaggtatttggtttaacattttaacatgaaaactcagatcagctctgcaaaccacactgttactattttcagttctccaaatagagtaggaatacacaaactcctaatctttaatctttgtttctattcacagatctattggtttaaagatgggaagcagatctctccaaagagtgatcactacaccattcaaagagatctcgatgggacctgctccctccataccacagcctccaccctagatgatgatgggaattatacaattatggctgcaaaccctcaggtaaagaagggtataggtctgggctcagttctgtgtctagtgcttacaggcatttgattagacaaaggaactatttaaaaggtgaagttaagaagtttctttgatttatgaaactatttttccaaattctacatccatcttggtttcagaggatagaaaaattctttgtttcatgaatacttatttattccatcaggtgttattctactccttccacaaatattattaagggtctaatatgtacacactttctatgtgggtgatggggttgcagtggtagactggacaaagtcctatggtaaaaaataagcaattaacaaataatataacttcaggtaggattacatgaagaaaataaaggagaaaaagagtgagtggcatgcataggctgtataagaaaaactcaacaaagtaaaatattttaaaagaaacacatcagtgggatttaatgtgcaaatgtagacaaatgataattttgatagcattcaggtttatcagttttcatcaaaatgttttctcttgtatttgcctttagacttagggtcaaaaaatcagttgccttcttagaatttaataggaggctgctgggtatcatgttgccagttcgagcctgcaaattcttttttattatgttatacattttagtcactatgctggatataggggatacaaaaatgagtaaaaagttattttgtaccttaagagctcaatgtatgacaggtagttttactaaagtctgcaaaagtagtataaataacacacttttaaaaagaaaaaaaaaggcatggtaaaatgagcagttttctctagaagtcatctttttagaatctctgatctacttatatcattccatattatttcttttgaagaaaatatttagcattagaaactatataaataattttaatgacactacaaacttttaattaaagtttctggcccaggtgcagtggctcacatctgtagtcccagcactttgggaggctgaggcaggtggattgcctcagccccggagtttgagaccagcctggccaacatggcgaaaccctgtctctactaaaaatacaaaaattagccaggtgtggtggtaggcacctgtaatcccagctactcaggaggttgaagcatgagaatcacttgaacctgggatgcggaggtttcagtgagccaagactgcaccactgcactccagcctggttgacagagtgagactttgttttttgttttgttggttttttttttttttttttttttttttttttgagatggaatctcactctgtcgcccaggctggaatgcagtggcgcgatctcggctcactgcaagctccgcctcctgcgttcacaccattctcctgcctcagcctccctagtagctgggactacaggcacccaccatgcccggctaatttttttttatttttagtagagatggggtttcaccatgttagccaggatggtctcgatctcctgacctcgtgatccgcccgcctcggcctcccaaagtgttagcattacaggtgtgaggcactgcacccggcctgagactctgtttctaaataaataaataaataaagtttattcaaggtttattatattctaatattccatggtcatataaatatatttttctgcaataatattaagatcagaatgaaaacagattatccagctaatcaggttgtgatagagcacagcaaactcttcactgttaatgaaaagcttctatattaatgcacattcttaaagttctaaatgttttaatcaatgaatacatgaccatcaccctgaaaaagtctaaatcactattaagaagttgcattttaatgtttgtgttcatatttgatatatatgaagaaacaaaagcggaacttgcttttttttcttttttttttttttttttttcttttttgagacggaatcttgctctgttgcccaggctggagtgcagtggcatgatcttagcccactgcagtctccacctcctgggttcaagcaattcttctgcctcagcaccaccacgctcagctaattttttgtatttttaatagagacggggtttcacctcaggtgatccacctgcctcggcctcttttttccttattatattttcagtgcatttccttgacattaacaaattctagcttttagtttagttttctgcctgtttaagaaaatggtggagaactgacaaaatccaaaatttttcttcgtgttgggtcatttattcctcttttgccctagaaaggctggggtatattatgggatggaattatctgtggtccttacgtatttgccaacactgggaacctgctattaatttcaagacatttttcttagcatgttttaaattgttattggaataagccattttatagaacaaaagaacataaacgtaaaactgcaattgtgagtccgcttagtgtcttcctcaaattataataatgcatttttacatgtggaaaagttctcagtgaggaaggactgactcagtgctcatggccaatggcagtgtgcagagtttaagacagcaggccagccttgggggtcagtagtctccagtcatttaaactctcttgacaaattattatgaagtcactagatgaaggtgagctgctgaaaatctcccttggatcattccatattacatacatataatatcacattgtaccccacaaatatatacaattataatttatcaattagaataaaaaagaaatttttgtttattcatttagagacaaggtcttcctcagtcacccaggctggagtacagtggcataatcatggctcactgcagcttagaactcttgggctcaagcagtcctcccatctcagcctcccaaagcactggaattacaagcgtgagccactgccattagccaaaaataaatttttagaaaataaatgtaatcttacccaaagcccaatatataatgccaaaaaaaagaaacccttgttaacataggaaaaaaaggaaaggaaggaaataaaaaagaaatgttactacaaataccaagattgtagggcaacaccgatgatactgaaaaaacctaggatgaggccggcaggccatgcagtacaggggttatgagcatgaactttggcatcaggcaatctcagctggaattctagctctgccactcactacctgtgtgaccttagcaagtcacttaacttctctgtgcctgtttcctccctcgtaaaatgaggatgataataataataataataatacagatttaaatagtacatgtaaaaagcattcagtttacctggcacatactatgctttcaataaatgctagttactgtcattattttaattcagagacagtaactaccccatcttaaagcaacaggcctacaacagaagcctgtggaaccagatgtaaaggatcagttctgtgtctaggtactccgttcccacagtactgtcagaaagtaagcaagtcaatttgggatggaatttctacccagtatgttgttgctgtgtggtcttctgacctcctggcttttccattttatcacctccatgggaaaggacttaggcagcagatgtggctgtgccacaactgccacagctgtgggcttgggtggaggagctgtgagctagaggacggccacacccatagcacagctgacatcagccacacatgaagctgggaagctgctctctactctcagcaccctcagggccaagagaagccccaaaagagagtggttactgcccttattccaggccccagaattctctgctttgcaaatcccaggctgagccccatggttaaccctctctggttctttgctctaccctttggagagaagacaaagcaatgagaagtggaccaagaacagccctcctaatagaatatcctatccaacctgtgatttcagccaagggtaaaataactactctgggtctatcaaaaggagaaaaaaaaaagattcaaagaacccagagcatcacagtaaacagaccagtttctaacactacctattatagtattccaaccaactccaaagatcagttgacactcccagcatcttaaggggtagggctaagagtcttctttacctaaataacccaagacaggcaaaaggaagggaaactcatgaagtctaggcctcagtgtgtaaatgtatatatcccactgaaattgctgtgagagaattttgatatttatgccacttagcagtagtagtatttgttccaagtttctgagcatgttgcctagttgattttaattccaagagtaaaaccccttcttttctgtcttgggggcttcagtaactggtatgtccaaatatggcagatataagttctgtgagtcatcacttaaaaattggagtgaacttcactatccattagcaaaacaaagtggcatttaaaccatgaccagtgacacaccatttttctacctaactcttggcataagttaccatttgttgctgtaaggatgccattctggaaatgtttaatgctcttagaatctcagctttacaacatctattaccgtatattaaaacttttttcttataatttatgaattaagacatgagtttaaatagtcatgtcataaaaggtggtgaaaaaaaaattcaaaatagctaaatctttcaagatatagtaatcccaaaagcataaagtgtagttgacagaaaactgaagttgactccttacttccttaatgccctttagttaccttaaattttgaaattttaaagttatttgagtttagaaaaaaaagtatttgggtttgaaagggagaatacatgtatgttttctagtacactgtagcccagatgaaatgaaataaccaaggaaaagaggaagactagagtggaaaaattagttcagtaatgaaacacagacggtagagctctcctgagcagtggaaaataattacagaaagcagccaagagaagggtgagaaccaaggagggaggaaaatattaaagttcagcagaatattttatagaatatgatatttttccacctgggttaatcttttgggaataagaaaaacattagatattgttgactgcatccaaattctacttgggatagaacacacagctctaaacatatactgggctgtgtatcacactcgatgtgtgtagctcaagcaattcataagagaccaaagcaatcacatagtttagcaaaataatgagtgactgtgcagttacaccaaagagaatgccaaaatgaggatcacaaatacagtttattttagactctaatcctatctttaagaacaacgacatctaaacacgaatgttttactttgttttgttgtgttgctaagttactttgtattgcacttggattttggaatggctattttgcagtctgatgtttcctcaaactgcattatgtatacaagtggcaagcttttatgaagacctgtgtgccacaagttaaatttcataaactatgaaatataaatgttatttccatattacataaataattggccttgcacaaggtatgaaataatctttacaagctggatgtttaatacagaatcacttttagaattcaaacttatttgtaatataagctttaaactctgtggatttgtttggaatggaaaagtaacacacaactgagttaaatataaaatgttagtttgttgcttgtgttttgttttagcattataaggtttcctggctcatttcaagcttcactctaaacattcccttccattattcttatgttcatagtaaagcagatagaaatgagaaaattaataaaagcaaatgcagcagcattaatgtgcatcagagcctactaactatgattaccagggttaataggcatattattattaaaatcacttattgctaattctatatgacctttgtcaaaaatagtatgttcagacttaaaaacctgaattttctattatgcacatggaaggcatcttttcaaaaaagcttcactgaactctgggggttttttcccccaaacaaaaatgacaaaattatacaacttcttagtttggatgctctctaaatgctcctggttatgtattggttagtaatatatttagccaataacactgtataaatcaaactaataattctgcctcctgaagaccacaccttcccctttcatgttcagaagtgcaggttggtatcagaatagagagattacaaatgataactattcctttttcttaaatttgggaagttaaggaaatattctgtggcaatatttgtatatatggttctaagcagtagcagcaaaaaccctgaaaacagtgtagaaatgtgtgacctttccagagtagtatgccaacctgtttactttttttttttttttttttttgagaggggaggaagaggcaggctaagcatatcaaggatctgtttagagctgaatagggcatatttttcctcctccacatcaaatgcagccatcacactaacaagtacatttcagtatgattgtgcttagcacctttcaagcaccagcagaagttaaaaaggttaatctgcttcccacatagtctgcctcctgtgccaaaggtattttgtttttcctttggagtaaattacattctaataccaagaaaaataaaattccattacataaacaattctaaaggatgcctcaaaactggttattataattatatccatagtgagtgctacaataatttaacattttgagcattggcttcatgcaaaacacaatgctgcccggtgctttacaagtattaatgcctttaatcttcataagaacccattaggtattaactatatggccttgttttacagagaaggaaacttagaaagattaagttacctgcctaaagtcactcacctgtaagggacagcagaactggtttacaaacttagactgattccagagctactgaatgcaatacgaaggtatttaaggctcattccaggattaagagcactaagtggcaggggagatagtggttaaatatgaaagaattttagaaggaggtaagcatatacctcatgtaaagtatattcacatggaaattcttgctggggtccgccaagctgctggggctcctaaaaaccatcttgatgcatgtccatgcataatgtctcagacccatgataacacagtaccagctatgaggaatttaataatgataatttatgatgtcacataccatttgatatttatgagagcatttaggttacatcatttaacccttaaaacatccttgtgagagatatatgtagcatccctatttgtacagaaaaagaaacaaaggcttgaacaaattcagtgatttgctcaaagttttaggaaaagtcagcactcaaatccaggttagtgaggtgtgtttgtttgactgtttgtaacaacccatacctccttttccaaattcaagtttaagtctgaatttaacttacattatatctttttctaaccgcataaatgattagttcattttaacttaccatggatcttctgagcttcatatcacaaggaaggatatatccaaattataagcatttcatcatggaagccgcaaagcacataataaggaagccatatcccacatcaggacaattggaagctatttgtgtaaaacaatacacacacttccttgtcctcaacctccaaaaagaatcattaattttaagtgttcatgtgttatcttgtatgatgcatcagttggatagttcatgatggaggtcttctaagcaagttacatctagattttctacagcaagtacagatctggagaacttggatgaaattaatttttagatttcaggctagtttagggaatcccaaatgtttgccaagagtttagcataagaatctgtatcaagtggcctgtgcttcaggtacagttaatctgagctagaaataattctccttcataatgttagacttcatgtctccttggaaattttcaggaaacacagtgttttaactatgacctcaatagcaaacaccgtgaatgccagacggagtcacatatgtagtggtataaaactagttatgtttgtttctttgtgatgacctctctttggtaattcctcattcttctcctgtctgtattacattcctatgtgtctttgccttttctgggtggttatagccctaaagaagtccaggttttaggagacctagagaacccccccagttagagtcctgcccttcagtgaatcttgctatgggatttttctctgcattccctccactagtgccctcaccctgacccccactccagtctactcacagttggaaagcagttcttcaaaacacacagaacactgcagcttctgttacctgtctctataggcagcttgcaataaaaatgacagccaatgggagaattttattctgagtgtaagtgcatgagggcttctcatcaactctgagctagaactcactaagtctaatcattgatggtacatctgcttcttgtttttcctctcttgctgttacctttggcagtcatcacaatttagaagcacatcttctcattcttctgagagagtgaaggagaaaaatcatcttttttgctactctgctggtaacagtgaaaaaaacaaattaagagaaagggctgaaacaaaaaccaaagtaacaatgtgtggcttatccatgtcatctgggtgccctgagtattacttgtctgttcacatatgacagcgtttatcaaactctttttttgcttttattatttttagttgacacaatgattatacatatttatgaggtacagtgtgatatttcaaagcatgtatacaacgtataatgttcaaatcatggtaattagcatatctgtcacctcacttatcatttgtgttggaaatactcaaaatccactcttccagctatatgaaaatacacaataaattattgttatcctacagtgctgtgaaacactaaaactttttcctcctatgtagctgtaattttgtatccattaaccaacttctggctatctccccgaccccaccaccccgtcaaaatttcaattgacaaatttaagagaacaaaatataggtttttttaattacataggcccttatcatatgacccacatattttaggtatttaactgcttctagtttttaaatctcaaatatgttcatttcatgagaacatggcttcatttagtcatgaagctctccttatcatcccacgcatacttcttacataacactcattttatcatgctcattttaatgtatggtttggggaagggatgccactaacttttttttttttttttttgagacagagtcttgctctgtcacccaggctggagtgcagtggcaccatctcagctcactgcaacctccgcctcccgggttcaatagattcttctgcctcagcctcccaagtagctgggactataggtgcatgccaccacgcccggctaatttttgtatttttttagtagagacggggtttcaccatattggccaggctgggctcgaactcctgacctcgtgatccacctgcgtcagcctcccaaagtgctggcattacaggcatgagccatcgtgcccggccagccactaacatttaattagtatattactataattagtatattactaaaaagagaaaactgaaatcatctaggtttgatttcagaattggctacagctggtagatgaccatgaaaatggaatcttcacaagagactgatgtcctcctgctatattttacaattcaacatcatgtgttacggagacctttgcaggttacaattaatcaagggttgtcattttaaataccatcctagataaaacagtaaagcttatttaagagttccaaaaaaagaccttgtcaccttcaagttcttcaagtaaaaatagttttactgaggcacttaactcacagggaaagtgtttttctgaaaagggttagtcattactcaaatggcatactgaattttttatgaaataatgtcttatagagaataggacagtaggcatgatagtgcttagtggttaatagttttaaatagcaaatcatttatttcctgatatttctacagggccgcatcagttgtactggacggctaatggtacaggctgtcaaccaaagaggtcgaagtccccggtctccctcaggccatcctcatgtcagaaggtatttaacatgttccttcccagaagtgttacattattttatttattactataaatgtagtactattagaatcatcatatgaccacaaaagtaaacataactggaagatagaataggaatgcaaacctgaagcctgtggctccttgattattatgctcccttgtgatgcagaaagggaatgggaacaaacattcgctaatgtgtgctaagcccattcacatatactattagtttgttaaataagacatattttatagacaaataaatcaagactcagcacttttaaatggcatatgaaaatactactaaatggtacacaaatgttggaaaccaaacttctgtaaccaacagctgtgtgagtggacgcacacattaaaagctattaccactgggtttcttaaaatcagctcatttgttaatgttcatttttcagccacttagttcaaaacataagaccattagactacaaatcttgtaggtaagatctgtcacattttaaatactcagatatctgctagcaatagagatgctttccattcctagtagttctgagtctatgcaaggacactgatggaacaatggtaggcagagatagagaaaggattattacttcttagtaacacatttgcacttaaaaaaaattcagtaagtcaaccatcctgtcaacttggcctgtttagatattttatagacagaatatcctcaaatagtcctgagtctaaattacaggccataggtgcaaactcctttagtgaagagaatacatagttagctcacagagagtaggcaggaaaactgagtaaacatcaaacaagtggtgtgtgactgcatccacacagacttttgttcaacatttggaagacagttctggcaccagagcatgtgtagatttaattctaacttcatcatggcaatacctattcacaggatgctagcctgtatctttgggtataaacatagcatatacaggattaggtccattgtcttgcattattctctttgcttctcttgttgtctgcaacacatttttaagcctttccttatatcagtgggtcctggaaagctttttttcccataaattagatctatacttagagaagggtaaactatattaaaaagctaataattattagcctagtatgcttctttcatttgttccactcttgcttttcctagttaagtgtttttaaacttatcttctagtcactactgacagaatttgtattcaacatcttttaagtcttccctgcgattactttcaactgtattcctcttaaaggtttctctggcaacctttaaaagtgacagagatgcacagaatctgggagatttgtacaatctcattttttaaagcaaaaaataatgcctctaggcatatggataactaatgcaaaagaaaacttgcctaaaaatgtaatttgttttcctgcttaatatgaaaaggaattttaattaaaaatatattgaatttttatcagaacttttaatttcctacaaatttaaaaatcacagtgtaaagttctagtaacttctgttgaaaaagatttggtaataaatgagcaataatgctacttttcataaatatttaaaaatatttaggaaaaatatgttaatatgtaataccccatttttttccatttccccttttatgatttatagtagcctgcaattggcagacaattaaatttatagtaaacttccaaactaaacaagagtttgcttttctgattttttaatgtgtaaatcttagctgtagggatcagataaggaaatcatattattaccccatgtattttaagaaaacagatgactaaaagtctggaagtaactactatctatatttctatctatctgtcatctttcttgtttcaaggcctcgttctagatcaagggacagtggagacgaaaatgaaccaattcaggagcgattcttcagacctcacttcttgcaggctcctggagatctgactgttcaagaaggaaaactctgcagaatggactgcaaagtaagattttgttattgcttgcatatcctattgccccacttctccctcacttgccatttctctatagttccttttggggaaattacataaagtataaaatgagagctgggcacagtggctcacacctataatcccagcactttagagtccaaagccgggcagatcgcttgatcccaggagttcaagaccagcctgggtaatatggagaaacccatctctaccaaaaatacaaaagttagccaggcgtggtggcgtgtgcctatagtcccatctacttgggaggctgagttggaaggactgcttgagcctaggagctgaagctatgtgagctatgatcgagccactgaattccagcctgggtgacagagcaagaccctgtctcaaaaaatgaaatgattctagcttaagggggggaaaaagtgaaatacgtcggatatttatatattgtttactatgattctttaaatctaaattaaatatgttctttactcagaaccctacatgacattactctagaaagtcatcaggaggttttatttatccctttaaatgttgaaataataaatatgataaatctaccatgtcttcattcttttttcatacaaattttgtatccatatatctactctgacttttattcctcccattttctaattctttttttttttttttgagacagagtctcactctgtcaccaggctggagtgcagtggtgcaatctcggctcgctgcaacctctgcctcctgggtctcctgcctcagcctcctgagtagctgcgattacaggcatgtgccaccaggcccagctaatttttgtatttttagtagagatggggtttcaccatgttggtcaggctggtctcaaactcctgacttcatgatccgcccacctcagcctcccaaagtgctgggattacaggtgtgagccacagtgccccgcccccattttctaattctaagataagttagagggacatctttctttcatctgttttgcagcagggctttttgtttttttggggtttttttttttttttttgagacggagtctccctctgttgcccaggctggagtgcagtggtgtgatctcagctcactgcagcttccacctcccaggttcaagtgattctcctgcctctgcctcctgagtagctggaagtacaggcacgcaccaccacgcccagttaattttttgtatctttagtacagacggggtttcaccatattggccaggctggtctcaaactcctgacctcgtgatccgccctcctcggccttccaaagtgctgggattacaggcatgagccaccacacccggcctacagcaaggctttttaacccaaggtccttgggtaggcaggcttcattaggtgtttgaactctgaaattacctacaaaattatgtgtgtaagataacgttcatccatttctcaaaggagtttagggaaaaaatatttaagaaacactgctctaaaattttttgtttgatttcttttttgccccctgtttactgatcttaaatttagtttaactcttaaatatggataaggttttaaaaagttatttgggctccctctgctggttctgtatggaatatgagaacacaaatataggctgcttagaggatttgggcattgtttcttcagaaagtaaatctgggattatagaaatgtataaaaagaataaatataacaaaaatattttatttcttaggatcattatttattttttacagtataaatacacaaattgtgtttcagtctgtatatattttatatatatatgagtgtgtattcatttttggtctataattaagaattatacagtacagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctggaatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcacgtgggtcacgcctgtaatcctaaaactttgggaggccgaggcaggtggatcacctgaggtcaggaatccgagaccagcctggccaacatggtgaaaccccgtctctactaaaatacaaaaaaatcagccaggcatggtggcaggcgcctgtaatcccagctactcaggaggctgaggcaagagaattgcttgaacccgggaggcggaggttgcagtaagctgagattgtgcccactgcactccagcctgggcaaggagcaagactgtcttaaaaaaaaaaaaaaagtgaaaaaccttgccacatgtacagatagatcaggaaaaaaaaaaagttagtgtatttaagctttgaaaggggaaaaaatcctgacgataagccaaacactaaagcagcagcttgcttttcctccaaaaagccccctccccttttagcccctgaggaacattcctagacactgattatccttaactggtactaaattttcaggaaaataactaattccactcccatagcaacaagcatcactattttcatgtgtgctgagagtacagatctagttacattgtgacctgctggtggtgaccttcagctcctgagatcatgctgtctttacttagccaggagaactggggttagaaaaaaggtacaaggggcattctctttgccctagcatgagtaactatccactgggtaggttcactgtgaatcacgtggtttgagagtacgcgtgctttgggcatctctcctactaaacatactgtggcttcagtcagtagatggcttatctaggatctaacctggtaaagtaggaacaagcagtgccgctttgtttctagatgtgggaacaacaaggagcctgaccaaagatgtccactccctcttcctccacaccacttctgatgacctccaaacaggtcaggcagtgtacatggagagctggggacagcaagtggatagataggagaacacagagcctgagtgtctcagaagccaagctgcctaactactgctgtttgtttccaaaacctcttcatccttttaaccagtcatttaagtttactttaaatgctgtagccctttgctacatgtgtggtgggaggcatcttgcaggtaatatcagttgagtatcacgtagcaggaatggaatttgtgagtcctctggctgatgctggcaaagctagttcttcaaaagaactgttttacagtctaagtgacatctttttgtatataacttcgtactagtaaagttgggggtagggggtaaaaaggccttccttaacagtgcatttcttccattcaaaatcaagggcaaaactaaaaagctggcagatggcgaccatcctgaccctttgcggcacaacatgttattagcaattaaatgcttttatctgatctctggtccacacaactgtcaaggtctcaagattttatgatgtttccattgtgatggtaatttgttgagatggctttctgggtaatttcgtattgctcttgttattcagtttcaaggattataaaataataatagcagccctgtgtgctgacgaatgcattctccataactatggctgctccttgatgagaagctttacagtactatatataaatgccagctgagtatttgttattattgttggacatcttttttcaaagaagcccagagcctggtgctgatatcatcccattaatctccatagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaacccgggaggcagaggttgcagtgagctgagattgtgccactgcactccagcctgggcaataagagtgaaactctgtccaaaaaaaaaaaaaaaaaaaagccacctcttgtactactgaaggaggaatttatgcagacttcttagctaccagtgatttcactctgttttaatacaaaaatttacatgtatttcttttatgatttaggtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctggtaggctcatctgtgaatccttgctctctgacagaatgaacatcagacttacaaatgtaaactaattctacattactaaccaatacggaaaataaagtattgaaaaaatagattgtatcatcaaaatagccaatgaggacatggttataaggcctagcaaaacagaaacagaaatctttcatttctcccactaacctggcaaagagagaaaaagattttattagctcttttgggtcattcgacctcctgtgtgtatagtggcccctagtgttacatagagaaatagtaacagcagcatggactccaagaaccaaagaatttgcttatatataaagttttatatttatatatatatatatatacacacacacacacacacacacacacacacacacacacacacctggtttttaaaacaacactgtcatctaccctcatagtcattgtcaaactacactcagatttgctttttcactgattattgtgtaggtaaattctgtaaaagtgctgttacatgaagtcttatgctttgagaagcctaaaaggaaaacacatttatggaaaggtttttataccatccttaagagttaggtgttgagtacctgatctcttttaagaaagaacataacaaaacatttatttcttctacctctttatgcaaagtgcttcatgtacattatgtatcagttggccctcacatgagccttatgagataatcagagcaaatcttctctgaattttccagggtcccacttagtaagctgatgattagatttaacacaagactcctagtgctcttctaaacacactacgtcactgagctctttcaagaaatagagtagcaatgagaataaaacccaagaagtcttgacaaaactcttggattatgattctgataatggtaccaagatgttttcacataaaaatgtggtaaatatgtggactgtggtgctacaggttagccatgctttcaagttttgtacaaagtactctatattcttacatgctacaattgatttcattcctctaacctcaaactaaaacttcacttttctgctgttaaatatgccttttgatcacatagatacctcagtgcgcatcagctggcactcctgtcagaagacggtgatgcacagtaattggaagcaaagtctttggggtcagatctgctccagtcccggctcttgtcgattttactagtgtgacatttggcaaatagctatctctgcgacttagtttctccatatataaaatgggaatataatgcctcacagtgctttcctaaggattaaatcataaaaatgtgtatgaagctctgcataactagtaccctgcacagcaatgctgcaaagtggtagatgttattcttactgatgagttgctatgacattaagacttgttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtcttttttttttaatgggttccttccttcaaggttataataaagcttttttataaccttcaaagaatacaaagtggaatttgtaatttataggatatacattcctagtttacaggtaactatttaaagctgccaaatttagataaagatgcctcccctttaaattgccccctttaaattctatggcatgtctcacttaagagttacaaatattcagaatattcatggcaaacatggcaaacggcagtgagggaatctaagtggtcaaattcctagaaatacttgtcctcagcaccactaggtggcagtagttggttgaggctgtgaatgatcggtaacataatcactagtagtgaagccatcacagatgctagcaatgacttaggagtctcccacagctggtcagacaggcattctgtgaagcagatggccagtggacagtgtgagcctatcagacttgaattaattgaggaaataaatgagcggaatgaagtatacagacctttgcttggtaaaagaataatttggagaggggactagcatcttaccacctggagtaaaaaatggtatcataaaagatctattcaagcaatattccaaaagccttctgaattctttctagtgctccttttgtatatcattgatagagaattcatctcatgttttcttagctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgaggtaagactgcacaatgagaacctgatccttaactgttcagtcctaatgatgtatcaaaagatacattttatatagcatggaaatctatgtgtaaaagccacatagatgttttgatttttgatgaaatcaatcaaagacaaaaaccatgcgttacccaatgtaggattaagcttttagaaggaagctatgggtgtttgatctaatggtgatttcttaaaagtgtttatcattctatctaaaagaaaagatgaattcatttgctttagtgataaaagactattcagtggtttttgtaaaggcagatcctcaactaggaattaagcacacagatgtattcaactcttgacgtctgttctttctcccattaactttaatggagctagtaatctctacagaataagtatgaccctattatcagctacttgcacaattctgtttctaatgatctaattaaaaatgatgcttcatgtccaaagccacttttaaaaaatttagaaccctaatgactttatccttttctccagcatgcaccaggacaaccacggctacatctgcctgctcattcagggagccacaaaagaagatgctgggtggtatactgtgtcagccaagaatgaagcagggattgtgtcctgtactgccaggctggacgtttacagtgagtgccacttcatctcatttcattgcgtttactcattaaattatgaaaaattagacatctggacagcaaatcacattactctttataaacaactattgtgttttatttgtcaaaaaaattcatattgctctctctctctttctatttgtagtttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaaggcataaccatgtttttcacatgttcttgttactgtgttctgcaaatgactgccttttaacatttcttcctatattctatcgcagtgtcctaatgcactctaaacgtgtgttccattgatcctggaatgcgtacttttgtggcttagtgcttttctcattaatatatcttaagcagccagcagtagacttgtgtttgtatatttgtgtacatgcatcccaaatttaaagaaaattattcctattgaatttacagtctagtacaatcagcattatgttatccattgacataaaaaaaacactagaaaaaaattaagaatttatttaagaatttatttcagattttgcctcttcttgaaataactatgtgagggtcatcaagaaatgtgtggcctcaaccttccctactgtacgattcctttcagttgattagtgttaaagcatccacatccagcagaattcctaagtgctataattattttagagaaaatattttttaaaaggagaggggggatgagaattaggaagcttatcagctattccaaaggattccctgtgctgcagtgtttacttaaaaaaaaaaaagataaactacacttgacctttgtaatctagctgctttattcccactatcctgtatagacagtaaatctgcaacatgtgagtaaaatgcaaaagtgttcctaaattttccatgtttctaccatggatgtgttcaggtgccttgcatctatctagacattctgtatttatttgaaatatctaaaggctttccaagtatatcttgattaaaaatcttaatttactctttttctttgtagcccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagttttagttttctgttgctgccataacaattagcataaactttgagtgatgtttgaggcttcagcatcactcatttattactcacagttctgtaaatcaagttcgggcaggatgtagctgggttctctgttcaggatcttataaagctaaaatcattgtatcagctggactgtattctcatctggagctcaagatcctcttcaaaattcaagtggttgtgatagctctgtgcaattgtagaagagacgtctcctttagtccctcagccaggagctctctctctcagctcctgaaggccgcctgtattccttgccatgtagcccgctccatcttcagggttagtggtgagaatctccttcacctcagatccctctcacactttctctttgtcaaaggcccagtcccttttaaattacgtcaggcccatccagataatctccctttcttaaagtcacctgactttgggaaccttaattacatctgcaaatcccttcaaagcagcagctaaatcgccatttgattggaataactgagagaaggtgtgtatacaccagaggatggggatattaggggccatcttacagttctgcctgccacagcaatgtactgtaggtatgcatgtaaatacacaccagtgccatgacgtacaaggatacataaaatacagcaagatgatataaattaaaagtgaggggaaaaggaagaaagtaagtataaatggaacaaggaatgagatattacacacacacacacacccatattcatatacacatatagcattaatatctacatagttacaacagacggacaacatatttgggcctaggctttcctactacgggaaagagaaagctggtcatttatctaattcacagcctccataaggtgaaaatatttcatcttttacatatgcaatataatggagctttgaggatacatttgaattagactagaattgtgtatttcacattgtcttctataccccatgacttgctatgtagtttacaagattcattatatattttaatgctgaatttgtccttgattttcccttttatgaacatgcataacatgacaatccccttggcttgctcagtagctacaacctcctttatcatcatgtaaatttagtttgacccctttaaattatagaaatacaacttctatattatggtggtgaggaacttgagtgttggagttggccaaccaggatttgaatcctagctcttttgatcatgtgtgacccataagcaagttactttacctccccaagcctcagtttccttatttggaaaatggagattaaaatagcacccctctctttgtgctgctgtgaagattatatgggatgataattttgacatggtacctggcacatagtaagagctcaataaatttcagctattattttagtgtagttggaaactaaagtaaaatttcaattacaaaatgtgtacacacctaacaaaattccacagatggttaaaatttgtgaacttggatgggaaaaacattaccccctagctgaaatttagaatttccttcaattatgaatgtaggcaacaaaacacaacagtataaaatacctgggactgtcctagtaaaaattatattacaaatattgaaatatcttaaaatccatctaaattcagcattacttcaaaattatggcagttgttagagttaccaatagatgtaatttataggcatttgtattataaatttgtttttaatactttgataattacttaaaaataatttgttttatgtattttatgcctccatgaacattattttgagaagggatccagaagatttaccagagggtcaaaaaggcatatggcaccaaaaaaattaagaaccaggccctacagaagcttaaatacgtagaaaaggataaaaaatttgaggaaagcctaatttgtcattagtagaagaaggaacaaaactaattaattcatacaatgaaatattacttactattcagagttaaaggtaaagaaatggatttacttctattggcagggataaatatgaaaaacagcatttgacgaggaagggaagttacataagagtgatgtcagcaagatggctgactagaggttcctggcattcatccccccaagaaaggatcaacaaatgaacaaacagttaacattcaactgaagtgtcaaaggaagagcactggagtgcagtgggggtagctgcggtcactgaaagtccagaaggcagcatggagacaccttgtctctgctgcccatgcccctgcatcccccaactctgactggcctggagtcaagaggagaaactttcctttgctgggaaaacgtaagcagagccccatcagcccccattaccactgcaaacacctacaatccttactacaggagaattccacagtcctcacaagccctgaaccgactttagagagccactgtcgattgcacagctgcattcctctggattaggaacatgagatatgtactctccaccccttaggtgcctgctgtggggcccagtagcaaatgcacctctccagcccagcggctctgtcattccaccaagcacacatgggtggctgcaatgccacaaccctggaggctcagaacctgggcccaggattggctgtgactctggttctgcacagcaggaaaaccaaccatcattgcctgaacttccaggcagagaaacagtctagcaaattctcccaaagcatacatacctacccttgagctggccaaactgggcccctgagctgctaagcacctgacatgccctcaggccagaaccagtaccagcctatctcctaagcctgagaaacagcccaatgccccctacctccatggacatgcctccaggcctacccagtggaactgtgcccaggctagggtatgagaaacagtccagtgggcccaatcccagcatacatgtccctagaccttcccagcagccctgtgcccatgcccagggcctgagaaacagcttgggagattaacttccagtagacacacccctgggccaggtgagctgtcacatgaccatgcccagggcctaagaaagagccccatggggtcaacccccatggacacaccccctggctggctgagaggcacaccactgtcccaagcccaagaaacagcccacttggcccacctctggcagacacacccccaggccaaatgagcatgcctgtacccagggcctgagaaacatccctgtggccccaatcccagcaagcaagaccccaagttggttgacaccgttcacacacatgcccccaatttgagaaacaatccagtgagcccaccccagcaaagctgcaccaccactgctacaaattctcacagcctaggccactgggcacttacaaacatcagcagactggattacagctgaagaatctgcacagacactacagtactgcatccacctagaaccaaagccaacacaccccccctaactgacactataagatcctccaatacaaatacgtctttccctacaaaacctttcatcaaattagaagaggtgactgttctaccagatgcatagaaatcaacatcaaggaacatatcaaacatgaaaaaacaagaaaccatgatacctccaaaagaacacaataatgctccagtaacacaccttaatcataaggaaatatgtgaaatgccataaaaagaattgaaaataataatcttaaggaagctcagtgaggtaaagagaatatagctaaactgttccctcaaatcaggaaagtaattcatgatttgaatgagaaattcaacaaagaacataaaaaaaaaaaacccaacagaaatcttagagttgaagaattcaatgaataaaataaaaaatgcaatcaagagcttcaacaacagattagacaaagcaggggaaagaatttctgaacttggaggtaggccttttgaaataactcatgcagacaaaaaaaaaagaataaagaaagcctacagaatgtatgggacactgttaagtgaacaaatatttgcattttggaactccagatggagaagagaaggaaaaaggtatagaaaacagatttaatgaaatcacagcaaaaaacttcccaagttttggaaaagagatgaacatctagctctaagaagcttaaagtccccaaagagattcaacctaaacagttcctctctgaggcacattatagtcaaattgtcaaaagtcaaatacaaagaaagaattctaacaacagcaagagaaaaacgtcaagtcacatataagggaatacccattaggccaacagcagatagcagaaaccttacaggccgggaaaaaaagaaataatatattcaatgtactaaaagaaaaatattgccagtaaagaatattgctttaatattctttattaaatataagcaaagctattcctcagaaatgaaagaaaataaagtctttttcagatatgcaaaagctaagggaagactagccttacaagaaacactcaagagagttttagatctggaagtgaaaagacaataaccaccaccatgatgaaaacaaatgaaattataaaattcacttgtagagctgatatacaaaagagaaagagaaaggaatcaaaccttatcactacagaaaaccactaagccacaaaaataaacaataaggaggattaaagagaaaggaatatacaaccggaaaaccatcaataaaacgacaagagttaagtcctcacctaccaataaataaccttgaatgtaaataaattaaattccccaattaaaagacgttgaatgaatgaatgaataaaaaaaccatgcaactatatgctgccaaataaaaactcacctcacctgtaaaagacacacaaagactgaaagtgaagggatggaaaaaaataatcaatgcaaacagaaacaaaaagtgagcagaagtagctattcttatgtcagataatacaggctatttaagtaaaaagtgatagagacaaagaaggacattatataataataaaggtatcaattcagcaagaagacataacaatggtaaatatatatgcacccaacactgaagcacccagatatataaagcaaatattattagatctaaaaggagagatagacctcaataaaataacagttgggaactttaacaccccactttcagcactggacagatcatctagacagaaaatcaacaaagaaacattggatttaaactgtactacagactaaatggacctaacagacacctacagaacatttcacccaacagcaatagaatacacattctttttatcagcacatggaacattctacaggattgaccatatattaggacacaaaccaagctcaaaaaatttttaaacactgaaatcatatcaagtgtcctatctgaccacaatggaataaaactggaaatcaataacaagaagaatattcaaaactgtacaaatacatggaaattaaacaacatgctcctgactgaccaatggatgaaggaagaaattaagaagtaaattttaaaattccttgaaacaaatgaaaacagaaacacaacataccaaaccctgtgtgatacagcaaaagcatgattaagagaagtttacagcaataaacatctatatcaaaaaagtaaaaagagttctaataaccgaatgattcatcttaagaatctaggaaaaaactgggcatagtggtgcacacctatagccccagccactcagaaggctcgggccaggttgctttgaggccaggaatttgagactacagcacactccaatttggcctgtgaaaagccactggcaagacccagtctccaaaacaagttttaaaagaaactagaaaagcaaaaaaaacaaaaaaaaaaaaaaaaaaaaaagcaagccaaacccaaaattagcagaaggaaagaaataataaagattagagtagaattaaacaaaattgagatttaaaaatacaaaagatcaacaaaaagttggttttttgaaaaaataaacaaaatcaactagccactagactaagaatacagagagaagacccaaataaacaaaatcaaaaacaaaaaaggagctgtcacaactgatactacagaaacacacaggatcattagaatctatcatgaacaaccatatgccaataaatttaaaaacctagaggaaatggataaattcctggacacacaagctaccaagactgaaccaaaaagaaacagcctgaacagatcaataaaaagtaatgataataaatcagtaataaaaagcctcccaacaaggaaaaaaccaggactggatggcttctcagctaaattctaccaaacattaaaaaagaaagaaaaaaaactgccaattcttctcaaactattccaaaaattgaagagaagggaattcttccaaacttattttacagggccagcataattttgacaccaaaaccagataaggacataacaaaaaaacaaaactacagaccaatatccctaatgaacatacatgcaaaaatcctcaatataatattagtaaattcaatctaacatcacatcagaaagatcatacaccgaagatggccaaatgggaacagctccggtctgcaacccccagcaagatcaatgcagaaggcaggtgatttcttcatttccagctgaggtacccagctcatctcattgggactggttagatagtgggtgcagcccatggagggcgagcagaagcagggtggggtgtcacctcacatgggaagtgcaaggggtggaggaactccctcccctagccaagggaagccgtgagggactgtgccatgagggacggtgcattccaggccagataccacgcttttcccacggtttttgcaaccatagaccagatgcctgtgccaccaaggccctgagttttaagcacaaaactgggcagccatttggccagacactgagctagctgcaggagtttcttttcgtaccccagtgactcctggaacaccagcgagacagaaccattcactccctggaaagggggctcaagctagggagccaagtggtctagctcagtggatctgaccccctatggagcccagcaagctaagatccactggcttgaaattctcactgccaccaagcattctgaagtcgacctgggacaccccagcttggtgagggaggggtgtctgccattactgaggcttgagtaggcagttatcccctcacggtataaaaaaaagcctccaggaaatttgaaatgggcagagcccaccacagcttggcaaagccactgtagccagactgcctctctagattcctcctctctgggcagggaatctctgaaagaaaggcagcagtcccagtcaggggctcatagggaaaactcccatctccctgagacacagcacctgggggaaggggtggcggtgggtgcagcttcagcagacttaaacattcctgcctgccagctctgaagagagcagcagatcttgcagcacagtgctcaagctctgctaagggacagactgcctcctcaagtgggtccctgacccccatgcctcctgactgggagacacctcctgactgggagacgcctcccagcaggggtcgacagacatctcatacaggacagctccagctggcatctggtgggtgcccctctgggacaaagcttccagaggaaagaacaggcagcaatctttgctgttctgcagcctccgctggtgatacccaggtaaacagggtctggagtggacctccagcaaactccagcagacctgcagtagagggccctgactgttagaaggaaaactaacaaacagaaaggaatagattcaacatcaacaaaaaggatgtccacaccaaaaccccatttgaaagtcaccaacatcaaataccaaaggtagataaatccacgaagatggggagaaaccaatgcaaaagggctgaaaattgcaaaaatgagaatgcctcttctcctccaaaggatcacaactcctcaccagcaagggaacaaaactggacagagaatgagtttgacgaactgacagaagtaggcttcagaaggtggataataacaaactcctccgagctgaaggagcacgttctaacccaatgcaaggaagctaagaagcttgaaaaaaggttagatgcattgctaactagaataaccagtttagagaagaacataaatgacctgatggagctgaaaaacacagcacgagaacttcgtgaagtatacaaaagtatcaacagctgaatcgatcaagtggaagacaggatatcagagattgaagatcaacttaacgaaataaagcatgaagacaagattagagaaaaaagaatgaaaaggaatgaacaaagcctccaagaattagggaactaatgtgaaaagtccaaacctacgtttgactagtgcacctgaaagtgacggggagaatggaaccaagttggaaaacactcttcaggatattatcaaggagaacttccccaacctagcaagataggccaacattcaaattcaggaaatacagagaaaacaaagatactcctcgagaagagcaaccccaagattcataatcatcaaattcaccaaggttgaagaaatgaaggaaaaaatgttatcggcagccagagagaaagatcctcctttggaggatcacaaaaggtcaggttacccacaagaggaagcccatcagactaacagcagatctctctgcagaaaccctacaagccagaaaagagtggggaccaatattcaacattcttaaagagaagacttttcaacccagaatttcatatccaaccaaactaagcttcataagcgaaggagaaataaaatcctttacacacaagcaaatgctaagagattttgtcatcaccaggcctgacttacaagagctcctgaaggaagcactaaacatggaaaggaacaattggtcccagcaactgcaaaaacataccaaactgtaaagaccatcaacactatgaagaaactgcatcaactaacgggcaaaataaccagctagcatcataatgacaggatcaaattcacacataataatattaaccttaaatgtaaatggactaaatgccccaattaaaagacacagactggcaaactggataaagaatcaagacccatcggtgtcctatattcaggagacccatctcacgtgcaaagacacacataggctcaaaataaatggaagaatatttaccaagcaaataaaaaaagcaaaaaaaaaaaaaagtggttgcaatcctagtctctgataaaacagactttaaaccaacaaagatcaaaagagacaaagaacggcattacataatggtaaagggatcaatgcaacaagaagagctaactatcctaaatatatatgcacccaatacaggaacatccagattcataaagcaagttcttagagacctacaaagagacttagactcccacacaataatagtgggagactttaacaccccactgtcaataccagacagatcaacaagacagaaaattaacaaggatattcaggactggagctcagctctgcaccaagtaaacctaacagacatctacagaactctccaccccaaatcaacagaatatacattcttctcagcaccatatcacagttattctaaaatttatcacataattggaagtaaaacactcttaggcaaatgcaaaagaatggaaatcataacaaacagtctgtcagaccacagtgcaatctaattagaatttaggattaagaaactcactcaaaaccacgtaattacatagaaactgaacaacctgctcctgaatgactactgggtaaataacaaaattaaggcagaaataaataagttctttgaaactaacgagaacaaagacacaatgtaccagaatctctgggacacagctaaagcagtatttagagggaaatttatagcactaaatgcccacaagagaaagcaggaaagatctaaaatcaacactctaacatccctatgaaaagaactacagaagcaagcacaaataaattcaaaagctagcagaagacaagaaataact

SEQ ID NO: 1303 - DNA, 82467 bp, Homo sapiens
ctctctttcctggaaacatcttttattcccacatggtagctttttttttgttctgttttgttttgtttttgtttgtttgcttgtttgtttttgagacagagtctcgctctgtcgcccaggctggagtgcagtggcacaatcttggctcactgcaagctctgcctcctggcctcacgccattctcctgcctcagccttgcaaggagctgggactataggcacctgccaccacgcctggctaatttttttgtgttttcagtagagacggggtttcaccgtgttagccagcctggtctgaatctcctgacctcgtgatccgcccacctcagcctcccaaagtgctgggattacaggcgtgagtcactgcgccgggaccccatatggtagctttgtaaagggcagggtcaaggcccagttctcacactcacagaagctctgggttgggaaggatattaaaggtcacttctggtccaagctctacctctccatccagtgccaggtcagaacttgtgaaagttcaatgcaggttaataatttggcaccttttttactgatattctccaaatagttgttcaacatttatttagaagtttaaaaattagaataatagcaaaaagtgtaattttcacttctcaaacttggtaggtttattttgggagtggccttgaacctattttgcaactactccttagtaattaaaatgaacttctcctgagttgaaatgcaagatgcagttaatgcttccaaagtctcttctgcaggactggatcaatgaataaaaactgacactaaaacataagtagcaattattcaataattaatactaatgaattactaaatctctacatcttaaaagtttgaataccagtgtatttagaatttgtttggcttccaaaaactatgcatgccatggtgttttattttaaaacttcaaatcctaacactatataccttttttaaagtgttaatttctcatttctttttcttttttttcttttttctgagacggagtcttgctctgtcacccaggctggagtgcagtggtgcgatctcagctcactgctcctgggttcacgccattctcctgtctcagcctcctgagtagctgggactacaggcacccgccaccacacctggctaatttttttttgtatttttagttagagatggggtttcaccgtgttagccaggatggtctcaatctcccgacctcgtgatcctcccgcctcggcctcccaaagtgctgggattacaggcgtgagccaccgcgccaggcagttaatttctaagtgtggctatatcttcataaaatctctctctatggccattaaaatggattatgccatagatgaaatggtccttaacattccatggacaaagacccctacagcttgattttgctgagataatcttcatagttaattaaggaccacagaagactaccatgagcagctgaggtcagacagggactgtagaaacacaggctaaaggacacgaagaattgtgtaattgactaaatgttcagggcacagccaacaaaactcaattgttctggacaaccacaccattttctctagagttgctgaaagttgtgtgggtgggatctacagataattgccccacttctccatttcattttgcctgtctaaacattgtataaataactacttgataaattcaatgttgatgttggcacatgaacagacagacagaaaagtgactgctcattttaaaatgtataaagccaatataaatagtaaacaaatctcaaaggagaatgcctaaaaatgtttaaaattcacaataatgtttaatttaccaaatttcaacccacttatggagcttaattcaaaaatacttttggcttatatttaaaataaagtgacatttgacaaactgttcaaatattaagcttaaaaatgtactcttcctaaataataattttaatacaaactctagatccacaacttgcaggattaactatctcttccccaatatgccaaaaacacgtacacatccaaatatgcatagagaatatgaatgctagaaaagtttaagaatatatcatgaaaatatatttcatatgtcaggataaataagcttgagtagttaatgaaaaataattattttaaagtttaagttgtctttaaaattaaattttacatatattttcaagatatatgagaagacatacaccacctacctcactatggaatgtggtaaaacaaacataatttatatctgtgtcatggcagccaaatggcataaattctttagatgttgaactttgctaaaatagcaacagcaaatttcatgaacaaagtgaagtggaagagaaaagagaagaacaatccaatacaaaaactgtctaattctttctggttgccttatagcctaaaagaaaattttaaactctccttaagccataactgcaaaaaatttaaaaagaaaatccatctgttaaaacaaattacgcaaatggtattgaggctacttgaatttatgtcacagtgcccttagtattaaccacaccaactgtgggccacacacgtttgactaaatgtgcttagtggttgattccagaaatgtcataattcaagaaatgtacaaggaaaaaaactagtggaaaagcaaaagtaacaagtggaatattttacaaaattgaaaataataccacacaggtcaaaaaaaaaacatccaattaacatatataatttcagttttgtgctatattccaatggttcttttcagtcttctaatttacattgctttttatatatttcattaatatataggcatatgttggagaaattgcaactttgttttcagacccaggcaatcaagtcacatgaatttgtttcccagcagatgtacatgttatgtttagaatatactatagtctgttaagtttgcaatagcattgtgttaaaaaatatagataccttaatttcaaaaatactttactgccaaaaaatgctaataatcatctgagcctttagccagtactaattatttgctggtagagggtctcatctcaatgtatttggctgctgacatcaaggtggtggttgctgaaggttgtggcaatttcttaaaataggacaaaaatgaagtttgccacatttgttgactctttctttcacaaaagatttatctgcagcatgtgatgtcatgtgatggcattttacccacaacaggactttcaaaattgaggtcaatcctttccaaccctgccgatgctttatcacctgaatttatgcaatattctaaatcctttgttgtcatttcaacaatgtttacagtgtcttcaccaggggtagattccatctcgagaaaccactttctttgcttgtccgtgagaagcaactcctcatcctttcaagttctatcatgagactgcagaaattcagtcatctcttcaggttccacttctaattctagttctcttgctatttctacctcatcttcagtgactttctccactgaagtcttgaacccctcaaattcatccgtgagggttggaatccacttcttccaaactccagttagtgttggcattttgacctccatccatggatcacatatattcttaacggcatccagaatagtaaaacatttccagacagttttcaacttattttgcctagacccataagaggaatcagtatctatggcagccatagccttacaaaatgtatttcttaaataataaaacttgaacattgaaattactccctgatctgtgggctgtagaatggatattggattagcaagtaggaaaacattaatctctttgtacatttacatcagagttcctgagtgactaggtgcattgtcaatgaaagaaatcttttgaaaggaatcttttttctgagaagcaggtctcaacaatgagcttaaaatattcaggaaaccatgctataaatagatgtgctgttatccaagctttgttgttccgtttatagagcacaggcagaggagataagtcttaagggccctagcattttcagaatggttaataagcattggcttcaccttcaagtcaccagctgcataagcctctaaaaagagagtcggcctgtcttttgaaattttgaaactacacattgacttctcatgtctagttaggaaagtccgaggtcgtcttttcttctaatagaaagctgttttgtgtacattgagaatctgttgtttagtgttaccaccttcatcaatgatctttgctacattttctggataacttactgcttcaccttgtacttttatgttatggagacaacttctgctcttaaacttcatgaaccaacctctgctaacttccaacttttctactgccactttctcacctctctcagacttcaaagaactgaagagaattagagcttggctttggattaggctttggcttaagggaatgttgtgcctggtttgatcttttatccagacataaaacttaatatcagccacaaggctgttttgctttcttatgatttgtgtgttcactagagtgtacttttaatttccttcaggaacttttccttgtattcacaacttagctaactggcacaagaggcctagattttagcctatttcagctttcaacatgccttcctcactaagcttaatcatttctagtttctaataaatgagagatgtgtgattttttcctttcacttggacacttagaggccattgtagggtttgtaagtgggctaatttcatcatttttgtgtctcagggaatagggaggcctgaggagagggagagagataggagaactgcaggtcagtggaacagtcaaaacgcaacacataccgattaagttcagtgtcttacatttgtggcaccagaaaacaatcactgatcacagatcaccgatcacaaatcaccataacaattataataataaagaaaaagtctgaaatattgtaagaattatcaaaatgcgacaaacagacatgaaatgggcacaatctgggaaaacagtatcaatagatttgctcaaggcagagttgtcacaaccttcaatttgtagaaaacacagtatcagcaaagcacaataaaacaacatatgcctataattcacataccattcaattaatccattcaaagtgtacaattcaatgacttttagttgaattatgcaaccatcattacaatcaattttagtatattttcatcaccacaaaagaaacctcatacatattagcagtactcctcatttctaccaaattctcagccctaggagaccactaatctacttgctgtctctgtagacttggctattttggagaccccatataaatggaatcatacaatacgtagtcttttgtgactagtttctttcacttagcataatactttcaaggttcatttgtgttgtaattcctttttatggccaaatattatttcattgtatagaagtacacattttatttatacattcatctgttgatagacgttagggaaattttaattttttagttattatgagtaacattactaagaatatgctcgaacaagtcatatgtgcatgtatatctccatttcctttgcgtatatacatatctgagaatggaattgctagatcatatggtaattctatatttaactttttgaacaactgacagactgtttctcaaagtgagtgtattattttgaaatcccaacactaatgtatgaaggttcctatttctctattattgccaaaataatagaaccatgccttcaaaattctgaagaaaaatggcatctaacataaagttctgtagtctgccaaactatcaactaggcatgacaatagaataaaaatttttctaaaaatttttagatatgcaaatactcaaaaatttttatctccatcaccttacccttgggaaaccaccgtgttcacaatgataaaataaaataagaaaaaagaaaacttgtgtgctgctgttttccatagtcttgtgcaagtatttgacttttaaaactatatgcatgtaaaatgttgaatttttttaaaaaatacttaaatttaaaaagatgaactcttcttatggactgattgaaaactgtttagtgaaaacattaactgaaatcacctcaattaattctagtttggaatgtttatttacttgataatttaaaaaaacaggcaaagacttttatacaaaattcctttttatttttgtattgcaagtgacgaatacttgtaaactagccttttgaagttgactttgcaaggcttgacatacatggttacactgaagagacaccttttggaatgtgaaataattgagctcatcatgggaataggtgtttgtggctgggttttttaaaaacccagtggtcaacacatcacaaatttaaaaagtattaaatttcaaacttgtgctgtggaaactattaaatgactctggtcatgacaaaatcattaacaataaagattcaagtaaacagttcaaataatattttttcattaaatgagcaggggaaaaaaggtgcattactaaatcaatatattattttacgtgataactttattttaaatacatattatctaaatcaaatattctaagaaaaagaaaattagctatcagtttcccaaaaacatctttcattttcattgaggaggtggcaagaatgaaagcaaggtgagcccatcattccttaaaagttgaggccatgacttaatcatacttgcattttatgatcatctgactgaagaagtctctctcctccctctctatcctatcaccctgtttctttccttaatagcaattgtcactccctgatattttcttgtttatttattggtttatatgcttcaagtttatctccattaaccaaatgtaagcctaatgaaagcagagctcctgaagtcttgttcacatcggattgcatcctcagtgctacccaatgcctctcagatcattgatatttattaaaaattaaacagatgagcaaaagaatgggcagctggtagacctaataaacgatgtacactaatgaaatctttttcacaaatgtggcgtcatcttctgatcactgggaggaaaactgctttctaacaattcttgtgagtgatagtttacgatgctcccagtattgaaaccttcttgctcaatgaatagactcatagtggggctgtagctattagtagcctgtgtcctctgagaaagttctcaataatttttatagccatcctacttacagcgaaagcatggttcactctgtagctactgcatgaggtctggcacaatagggaaaaaaatggaataatgttaggtattcaaaagtacgtaacttgtttactcatttacttcaacagagcattttgctttaccactttgaaacctgattatttctagtttcactttccttgaaactctttgatggctccacagtgactacggaaaagtccgcaatgttagcatggaagacaagtccttccacagttgggccagcttcctctttctcactacctggtttctgtctcatgaaccaggctccagctatagcaaagagcttccagtccctgaataagccaagtggtttcttccctcagcgcttctgctcacccagctccctctgcttggaaagccctcccttcctctccacttagtgattcctattctttggttaagacttcacaaaaccttctctagcaccttctggaagacaaatgaccaacctctcttctgggtagaggccactaccctcacagatttcttataggacctggctcaagtttactcccaacactgcatctcccaccactttctatttttaactccagacactggcctctttgcagttcctcaaatccctattttcatttgccaggagtgaaaaatattttctcagacatttacacaatgtgttctcacctccattcaactctctgctcaaaggtcacttcctaggaaaggctgtcttagaccaccctgagatattcctccccttctcatttttctgaatagaactaccccttatttagcctttacaccagcttactttttctttgtagtactgatctaacattatatatttagtaatgtacctgtcttcccttctagaatataagctctgtgatggtggatctttgttctgtttactgctgtgaatgtgaatgaataaatgattgaatggcacttgtggcacttgatgactgatgttggcttgagattttgctgtctttctctgcaggggctgtatcctatgcatcttagtctccagttccttcctggcacagagtaacttcttaatattccttctatgactgaacgacatcaagtatacattacctataacaattgttcccaacaaagagactctgaatccatgtatactgcataaggtgaagaacacaactatatttccacaatccctttgtctaaaactcgggatcagatgtgtttcaaaattcagaatcatttatttatttatttattttatttttttgagacagtctcactctgtctcccaggctggagtgcattggtgtgatctcggctcaccgcaagctctgcctcccaggttcacgccattctcccgcctcagcctcccaagtagctgggactacaggtgcccaccaccatgcctagctttttgtattttcagtagagacggggtttcaccgtattagccaggatggtctcgatctcctgacctcatgatccgcctgcctcggcctcccaaagtgctgggattacaggcgtgagccaccacacccagccaattcaaaatcgtttattacttaacacccctgtcagagtcagtatcctgttatctaactcatgacgagctttgcaacaaaacatgtgaagagccctactacatgtgagaaataatgctcaagtcagcttttgctgccaagtgagctgtcaagatagatttcttaagtatgggattttggaagtgtggacaaggagctgtggatatgtattagcatacggagattggtgaaacatctccatactaacatgggtttcccacaatccagaaagttaagaattactgatttaataaattagtttaaataatttattttttcattgtagctatcattaatgaagcatttactttgtgtcaacccctgtgctgagctctttaaatatgtatgtaaaacaattatttgtcccattttataggtgaggaaactatggtttagaaagaggcttagcatatctttgaactggtaactgactaagctggacccagactgaagctgcctcacgataaaaagccatgctcttacttcatattgcacaaggtcaaaattctttagtcttcccagtttctttgtgatgttgattctaagaaaagtttctgtaattcaagtgaatgtgaaaatcctcaggctacaagatctcttttgtaaaaaacaggctggctatatgtagtcaacatttaactgatatttgtataatggaataatgtattttctcagctacaccaatattttaaatgtttgtaatgagagatcaagtgatttcagataattaaaaaaaatacagtcacactaacttgccctgatttcctttgtagaaccatgatctgcggaatcaaggtctgctgttacctgatagatgagaataggaatagaagaggccatcaaaaggcactaattataaataatatgtagatttttaacttatccttttcaagaacactttagctgtctgaatttttttaaagccagatagaagttggtaaaatgtatctgtgatgaccaaattttgaaactcctttggaattaccaaatatagcagaggtagttggcattaaggagtcacttgtatagaaacaataaagctctattttaaaaatctatgcatagggctacagcttcacctgaagacagtgttttggaccataccacactcatgggaaagcctccaattttgaaatgtagagtagcaaaaacacaacagacagtcatttcatggtacaaagcagatactataaacatgagaattaagaaatgaaaataacatatacactaaaaacatcacaacagaaacaggctttatttcaaccagacaagtgaattcttcaattaacatcaacttcttcaagacttgaagatatggaaattaaagacggtgctcagaaggcagagaaaggaagattcatcatggagtaattgttctgtccttcaaaaatccctttcaacaataagctcaatacacaagatcatgggatctcatgcatcccaatatttgtacatgaccctcatttgaaagttacccatcagtcttaatgaaatctttcaaaaagaaaaaatatatagatcagtataaattatttttaattttagaaactgagattgaagtacagtttttagtttaaaatattaaaaatgaaaaaacctttaacattattaaagatgtgttgttacaaagttcctagatatatacatgtacaaaacaaatagatattactatctgacacctcaacccatgacttaccctaaatctcctgatatgaacaattaatctactgggaggcttttcccaataagtttcaaatttcttgcacaaagatttgctgccattcatattctgtgcatggatgaggacatttaatcacagactatttcaacttaatataacctagcataaaataaatccaatgaaacactacatttataagcgataggacaaacttgcatataatttgcaacttttgccagactcattaaattcattaacacattcagtcttctcttcacgggcattttcaagagctttagatcttgtgcttaactttgtattgagctggtcagcaccttcattgatatgaacaattatgtcaaagaaaggttacaggtagggggagggacatcatctgaggacagaaacagagggaacgactcttttttcagaagacaactaaaacagaaaaacaagacaaaaaagggtacaaaacaaataacaaaagtgttcacagtaaaacatgccagatttgtagtttcatttgaaaccaacagcaaatcatgaaacgtcatgaaaaatataagtcaaggtaaaatctcctagagtaattactaaatgaagttaaaatcaccacactgatcagtaaaccccagaagaaaaatgaccagcgcttacatatcaggtccttcttaaacatcaaacaacttttcaaagttaatgcatacaattggtaggtttggccacgctgcaccatttttttaaaaaaatacagtatacagaaaaaaaaccttttatattcccccgttttgaatcattagctcaaaacctaagagtaaaagatcatctggaaggattttaaattatttacaaatccagcaggttcatctgccataatggcttggcttccgtcccaaagcgactttcaccttctccagcagcaattttttagttctctgtccttttgggaggctgtttcctccactgctcgtctctacttgtcatcagtcattttgaacagttccaacagtgccccaacggctccaaaataaccctacgaaaacaatacaaaacgatgatctctgaaccttagccaaatatgtattgtttttaataattctaggaatgccactaatatcgataaaagagaaatttaaaacctaaattgtgtgtcacaaaacatggcagaataataacaactataatttattggacacctacttatatatattaaatacattcacatatgtaaatgcttagaactatgtctggtacatgtgtgctaagtgtgtgccagggttgttagtattataactatttcatctttatctttgtcatggcaaaacactgactattatttcacatatgagaaatggaaggtaataaagtaaattacccttgcagggtcacaggtcttgtaccagggctcaataccaaatctgtctgactttaaagctatatttcatgagagaaaaccctaaacttccctcagtagctcttgcaaaggcacttaaattagtccaagccttactttgcccatctgtaaaataaaagaccatacgtctatgaaaatgaaaggaactaaaaaatataaatttttagagaactatgtgttagtttgttcaggctgctatatataacaaagtaccctagactgggtggcttataaacaatagaaatttgtttctcacagttctagaggctgggaagtctaaaatcaaggtgtctggtgaggacccattcctcacagatagctgtcttcacattgtaatctcacatggctggattacgtggtggaaggggcaagggagctcccttagacctttttataaggatgctaatcccattcatgaaggctcagccctcatgacttaatcacctcccaaaggccacctcccaataccatcactttgtagattaggatttcaacatagacatttgaagttggtcacggcacaaataatcagtccacagcaatctgtttccaaaaggcaggaggctccattcttctggcacttgctgaactcaatagttataactgcagcagtaggtgtgagtgtggcaggatgtggatggatctttgctgctgctgctgctgctgtctgcttacatttattgaggccccactaatgctagaagttgttctaagcactttacatggatttactcatttacccatcacaataactctatgagacaaatataattgccccattttacaaatgctaaaacagaaatggagagacagagtcattgtctaagatctcacagtcagtaaaacgcagtgttcttaactacctggctagatgacttctcttaagagatgttcagtaacattagttgaatgaatgagaaatttagtgaggactcctaaggccagggcaggtgaccagaaagccaccatacccgtgcttctcaaaagttgtctctccataatattctctagtaaggcccgcgtaagccagagggaatttaagaatgtagagaattttctgaggaacacattatgagggttacaagaatactccattttcactggccatagagactgagttatgatatagggtaacaaaccaaagccagagtccacagaggcttaggattgtacagggtgatataggcgactacatttttacctacagaagtgagtttccccaaaatgttggcttttatttcctatcttaccacctaacttcccacctgatgttatagaagactttttatccctgacagtttccaggctttgttgtctgcattaggccaagaagatctggacttatggttaccagataagacacagataaatggcagataaaataactgggcaccctgtattttttattgctaaaaatggcaactctatctggactagaacaggagttttctttttcctttttcattattttttttaaaggctgagatgtttttttctttttcaaacaaaaccttacatggaaactccataaataatcaggtattctggctgtggggggtagggagtggaggttctgggacctcattccccctcactcaatgcctaaagtctgctttaaaaacaagagctttctttagtatgaatttctatcattgggccttaactattttgtatttaagtacctgtttcatatactttaataaaacaaaatgcaggcatagagagttctaaataactctaaatgcattggtaacttcttaaataaatagctcagcttaaaaatgagaaaaaaatggcacagtagttattcattacaattgaaattgacaataccagctctctcaatgtttttctgctgcagtgtatacaagagattagatacctccagtgatagctcattgcagcactgcagcattgattttaaaggaggtgacagaggaggtggaagagagaagggcccccactttttggtttatattatggtagaaactccaagtaagggggccggggtggctcacgcctgtaatcccagcactttaggaggctgaggcgggtggattacctgaggtcaggagttcgagaccatcctggccaacatggtgaaaccctctactaaaaatatgaaaattagccaggtgtggtggcgcacgtctgtaatcccagctacttgggaggctgaggctcgagaattgcttgaacctgggaggtggaggtagcagtgagccaagattgcgccactgcactccagcctgggtgacagagggagactctgtctcaaaaaaaaaaaagaaactccaataagggactctgaatttactgacactctccatttcctttgtaaagaggttcactaatggtcaggtacactgacctctcaaggccaataagctactcttagtagcccaagcacttctgttcttaccagctgaattgcttacttgccaagagtcagctgtgtttatccttaaatttgtttatgacaggttgattgtaatgtaataatctagtttaactatataccacctaaatcaataaaaagagcacaaattaatggtcagttctatgaaaattcagttaaattcttgagaaatattgaaaaaggtagtcagaaataattgctgtctacttaggtggatgccacaacgtgaaagagagagagaaaaacctgtaaacattctgcaaccaatttacttcataagtatctttatcttcttaatccactttaaggaaacaaactggaaatcaaaggaggtgcataatattgtagattatgaaagaaagataactacaggactccaatcggagaaaccatgctcaaaaataggcgttggtctcacatcaaaagattggtaagtaagtgcacatttacacattttaaggtataataaaatggttgaagaaagctttcattaatgattactcattttatctgactttaaaactttttaaaaatgttattataaattgacaacttataatcgtatatatttatggggtacaaagtgaggttatgatttatgaatacaatgtgaaataattaaagcaagctaattaacatgtatataacttcaaatacttagatttctttggtgagaacatttgaaatttacaagtttgaaatgtatgttcccatttcctctacccgccagcctctgtaaccaccattctactctctgcttctatgagtttgattgttttagattccacaaataagtgaggacatgtagtatttgtctttctgtgcctggcttatcttagcattttttccaattccatccatgttgttgcatattacagaatttctttttaagtgctgaatagtattccattgtgtatatgtaccacattaaaaaaaaaatccattcatctgctgatagacacttaggataattccataacctagttattgtgagtagtgctgcaataaacatgggagtgcaggcatctcttcgacatactgattttaaatcttttgggtaagtattcagaggtggaactgctggatcatatggtaattttatttttagtttttttgaaacttccatgcagttttctataatgactgtcctaatttacatttccagtgactttttaaaaaattaaattaaccaactaccagtcctggttgttggataagaacgcttccattttatatatgcttttttcttatcctttgtgtaaatgcaaagtgtaaatggcaacttttctacttgaccaatttaaaaagctaagagacctgctgatatgttagccaaaccaaaatatactccacatatgacagtaagtctatgcaagctcaacctacctcatgttccaaaaacagagctttcagttgtcctttggaccaaaaatccatggcatatgccagcagcttcatggagaccatattgattctgagaaaatttccaacaaacacaactctgtctatgttctggaaaaaatattaaagaaaacaattgaatcatggcataaaaatagcatttggcaaagacccaatgttctgtatgtctctgtacagaaccttgaagagtgaatattccttgtttttttggtggaattatttcaacatcgccaaaatgaagttaaaccaaccttatagtgcattccacaagaacaagaggctgagatttttgttgggcaaggcagaaactgatattggacttatttgcaggtgttatgtcagactgccttacgtctgacattaagctctcaaaacatacgtatatatacaattttaactggagttcaagttcagctaaattttcatgtgtaatacctcaatcccccaacttctaggtataaaatactcttataaccaactcacaaataaaacggctatggtatggtttatttgtgtaatgaataatgctcaatttgttctgtgctggacactagaaatacaaagaagaaagaatactcagtctctgccctcaggatatgtggtggaatatcctgtttggccaacacatgagttaaaatatggtaacaaaaaataattctatttttgtcatcatggatgtggctttgcattctgaacatacacttatgaacattcctctcctatccggttcatgcagacatgcttcaaatcccgtaagcttctagctccagtgcactcgttatacttcccactccccgagatatttcttaagctcaaactggagctcaacctgtctaccatgcagagactgctcaccactcactcactcacttagagccagttgctatggtcactcatatcaaaggcaagagagtctttgaagctggtattattttctgcttagtctatcaagagtaatcagggtctgggaacatcaccttttaactgcctcaagttttaacaatgaatgttcattaacccattagccactgaaaattttccgtgggtggaggagtggaggtagttttaataaattttcattaaaaaaaaaaacaaaaaactagccacaaatcacccaaactaagaggtagcaaggaacactctaagaaactcagactaaaaagaaatttaattaaattgaggagttttgccctttctcccaaaacaggggagtccaagggaggatttgctcaaagcccagtcctgcattaccctaatagaaagtcagaaggagtagaagtggcattaaaactggaagagcattccatgtttcaaataaattccaggtgggtcaaagatgttaaaaaagaaaaaaaaaaaaagaaagaaagaaaagaaaaagagatagggaaaaatatggaagaattggaaaaaaaagttgaagtagaaaatgcataataaaggaaatcatctcaaaataattgctacatttactttaaaaagttaaatttattcggggaaaaacatcaccacaaacaaatccaaacgggaagcaataaatggaaaatattatcagtacatttcacataaaatggatttgttaattaataaagagttccataaatcaacaagaaaaaaagtccaacaacccaatagagtaatgagtaaataatattaatagttaatcccaaaataaggtataatttttaacctattacattgaaaaaaatcaaaaagtttgataactctgtggagaaacttgtaccgttataaccctgcttggtgggaatgtaaattagaaccacctttatggagggaactttatatctgttaatattacaatcaacatatccgatgactcagcaagttcccttctaggaatttatcctattgatatactcacatgtaggcaaaataatatacatgtgtgtacatatatgtgtgtataccgtatacaaatacactgaatttttaaataatagtaaaagactggaaaaacctaaatatcattaggaaattgaacaaatcaataacagcatatctatatgttaaaatgctatatggccattaaaaatgaagcaatttaaaatatactgatatgatcaatttcaagatgcgttattacgtcaaaaagcaaaaggcagtatttttagagatgcttattaaaatatatagggtagattgatataatatctgggatttgttttctagtattttagcaaaaaagagggaagaaggagagaggaccagagggaggaggaagaagaaaatatagagaaagcatgtgttgtgaagccttaatgattgcagaatctgcactgatggattaatggaggttctttatactgttctctctcctttacatatgtttatgaattttcttaataaaaagctgataaagcaagatatagaatagtatatggagggtgaattgtatagcatataattatatttcaataaagctattattttgtaaaaagaatgctatatagagtttgctacctttggaaagataaatgtatcctacattacatacaatataaacaaagatatattgtaatacgtacaataaaaacaaacaaaaaaaccctaaaaaaaatggcagcctctactgaggttaacactgagagacagaagtggaaatggtgactcacttccttgtgtatccttctaatgtcttagaagtctgtattatgtgtttgtattatctatccaaaaatttgaatcagaaaatttataactgatggggaagcatttcacagcatctcaagaatcacagcaaaaatgttttagatttggtaaacgtggtgtccctcaatgaaatggctgcaatcaaaggttctcaaatcagtgactccagagagcaaagcaaggactgagggacttggtggctgctctcatgggaaatgcaacactgccagtcactggtgcggccactgggagtctgcactgactggacaccctctggtagagccttggccccaaggcgactggtgattcccttcactcattcagccccacagaaacatataaaatagttgctcaaaccagtgtataacatggctacattttcaaattggcactcgctctactccaccaatcaacaatattgaaattgaaatcaaaagtgaaaagtaaagtcagttgctctctcccaaagggattctgatgcctgtgaaaagacctgctgacctgctggctcactccagcaaaaagcacaagaagccagctctgcggaaagtaggggaaagggcatctattgctctgtggggcaagggttgttaccagctgacctttgagagcccatgagtacagccaactacacacatattggtcttggggcttgtttcattacttggaaaaattccctttaaaggttaatgtcaagaaataaactctgttacattgagtcccatgactcaagtggactttgaaaaaacatctctggaatgctcttttctctgagtatcagcctcccatttaaactccgtctgaactgagggcttccaaaaaggtatatcgctgatctgcaggccagtaacatactctgttcagtgttatgcaaggagagtatgttttttgtcaacccagaactcaaaggcagggctaacacccatgtatcataaagactgcctcatacactaacattcaactattcaactgagagggggctcaaggggctttctgagtacctataatgttctatttcttgatctgggtgatggctatacagggttgcttgtgtgtgtaaattaaactgtaagcttataatttgagccttcttctgtatgtatgtcacctctattaaaagctgtatttataaaaactccattacagatctactgtggttctttaatactctcctatgacctgttccatgcctcaactcctctttcctgtctttctaatatacctcagtgtgaagagttctactttatacaccttgtatttcagaaaaggttcaattttttccaaacgaatcttgcaatgcttcaaaacatgttaatacaactttgtatgtcaccagctccacccctttttgtgcctgggactctggctggccttggctgtagcaagctctctgtgctttgatagccctgtacaatgctgcttgaactccatgccacaaggcaacactgtaaagaagctgaaagcagagagaatatcgaatattgcaagtcgagcattttacctgcagttatgtgcaaggatgctcagaccttttcctcacatttcagtggacacatggcaataatgatggttagagagactatgacatgggttgtaattgtatcctgtttccacaggtgaatggtttatcattcattatcatccagtgccttcttaaaaataaagcatatattcctccccctcccccaacacacacccctcctgttctgtaaagtgtgactagagtaaagggaagctttcctaaggatatgtagttgtgtaagagtcaacaggtgttgcactgccaagatgatgtatatgaatgacacacagctttcaccgggttgagtaaggccttacctcattcaacgcgcacatccgagcaatggagccaatgttgttggtgatggtgaccaatgtggcccgggcgaggtcttccttgctgatggaatctcgcttttctttactcatcatgttgccaaagctatgttggaaatatcagcgagagtgttcaaaatcgtcctcaggcagggcccatccttccaccaaagtattgtggaaggctctacgagtaactgttcaaactcaagtgatccaattttgctactatggtttataagcagacagaattatagtatgcatggctgaccgcccttttcttaatagggacaaagtagcatgtccattaatggggggggaaaattaatgcctctagatatctggacaagaatggaacaggtgaaactattgcagttttctagaaccttctttcaaagttgccttattttaagaacaagcatcaagagctaaacatctcagtgcttcatcaagggcaggagatcaagtctgagctctgatacaacaggtatctgcaccaggctggtggactgacattttaaaacaacttagtgaatggccagggtggagaggctgccttgtgtttaatcactactgctcctagctacttaatctctaccttgatgctacagcagatccttgaaggccaaatcgttcatagtctcctccgtaaatgtccttcaccagtttatcaacattggtgctgtcgcctttagctgccatttccagagcttcttcaaaggtctcacaaccagtcagcaagcaacataggcctaggaatgttccacctccaagactgaaggaataataaggtttatttttaaattttactttaagatatgcccatccaagtccccaactacgtcaagactattaatatgggtgaataaaagcagacgaacaaaggggcacttgaattaaagtgctagggtgcaacagagctttagggtagactggatatgaaaagagggcagagactaaaaataaacatcaaggaaaatttgcccctaaatttgagaacaaaaccaaagaaagactctcactgatttctgttgtgagaccttcaactagccactaacctgagtgctttgttcagccttcccacctatgaaatggggccaaatcatgatctcttctatttgggtggtctgaaagcagcaaataaccaagaaataactcctattaaaaaaccatatgcagctgaatataaatacctagaaaaagaatttgtgtgtacataaagcatagttcaaagctatgaagccaaaccctctgatgacaaaactgacccaggattgtgccaggagtggcctgtcttaaaagctgtgttttacctgaccttgcttctctagcagagataatctcatttagcctccttgaatatttctagaaaggaaccactgatctgatactgaattttttcctagtagactctccagaaggtttttagtatattacttaccactccatagtaaaaaacagtaacaaaggtcataaagtggttccaatggttgaactacatttaaaaagctttgacttgtttagagggaaagttcctctaaaacagcctagacaaaattagaaagtaattacagtagccaagaatgaactcaattgtgtattaatatcaaagttacctaatggaaagaaaagcagattcagagtaaagtatcgccagtgaactcccagcaggaaaaggagtattgattcctaaagctaatggacataggttttcctatttctttaccatgtagaagagtaaatgaagaagagctgctcacatccatctgttctgaagccccaaagagctactagctttggaaattcaatttgtgtttgagcactggcttttacttctaagaataaaatcaatttgggattaaggttatgtttaataatgtcaataactgttaacaagaaggtacaaaactgtagataggtacatagttcttgaagatgcatctaaaacgaaactgaccgggcgtggtggctcatgcctgtaataccagcactttgggaggctgagacaggcaaattacttgaggtcaggagtttgagaccagcctggccaacaaggtgaaactctgtctccattaaaaatacaaaaattagccaggtgtggtggctgacacctgtaatccaagctactcagaaaactgaggaaggagaattgcttgaacccaggaggtggaggttgcagtgagccgggattgtgccattgcactccagcctgggcgacagacacagcgagactccatctcaaaaaataataaaataaaatgaaatagtgaaactatgtgtaatattcttaaattgtcatttgtataaaagtatacttgattgaggccaggcgtggtggcttatgcctgtaatcccagcacttttgcaggccaaggtgggtggatcacctgaggtcaggagtttgagaccagcctggtcaacacggtgaaaccctgtctctattaaaaatacaaaaattagccagccttggtggcacgcgcctgtaatcctagctactctggatgctgaggtgcggggattacttgtaccctggtggaggctgtagtgagccgagattgcaccactgcactccagcctgggtgacagagccggactccatcttaaaaaaaaaaaaaaaaaatatatatatatatatatatatatatatatatatatatataacttcatttactaatatatatatgtacacacacacatatatatatgattgaaattatgggttttcatggaaaattatgtagctaggtaccaccagtagcagatacccaaactgtagatgcagttccatgagtaaaggaagaggtccatgtacattattaccttcacaacttagtcacagtacaaactttggatttcctctaagaaagtttatctttattcacatttaatgcagtatgtcattctacattgctggtttcagcctacctacaaaactacggtgggaacatgttttggtttgtgtgctatttggatttgttttgttttctccctgtgtgtttttagaaagatgtctttgcttccatttctagcttctaaatatctgtcatccccatgaataatctttctttggacattaaggatttgtatcaatcgaggcattcaacaacccactccaaaggtaggcaactgaagacactggctaacttagaaagaaggtaacccattggctgatgtgttggtataaatgaaaaagggcaagtgccttgtatgactggaaaatgacagacaactccacataaagaattggagcaaatgaggtaaagcgagcatgcatttgcacagtgagtgcactgcagataggaggaaagaatgcatggctgcagaagagccaaatgtctcccagcactttattaatatccttaacctgctaaccattatttaatcaagtgattttcttgctcacaatcagatgcatctgtttgtttcagtaggcatacagtaaaaactctcagtatatcagagagaaaaacaatgcaagaaaaagctgtagaatattatcatcatttaaaaataaaacaaacaacatcatagtgggggatgttaggaaacagcagaagaaaccttcaattaagtgctcatgcccttaaaacagattccaaaataatgagatgagatgtactgctactttcaccaaagtttcaaaattatctgcattcctcttttaacagattacacattctactgtcagctatgaagtactatttcttccattgacttctataattcgagttgtgtcactaggaaaaaaatgttgctacccaatctgggatgcaacaaaattatatataacactgaaataaaccatttgaaatcatgtttaaaaggaaactgacatcctgtgtagcttcttaaaaataaacatctttaatgtttaatgggaaaatcaggtataatacaataagaaaaaacctggagtgacagctatcagttcacaataggagtagcaaaacttaaagctaagccatttgctaaaacagtggttcccaaaatgtgttttacacactcatactaaccatagatactaacttcactgctaactgtaatcgtttatgtcagaggtttcctaacttgaattaaaagaaacctttggcaaaacaactctggatcaggatcacagccccacagacttgatgtttcattcccctcccttctcgtggtagcccctgaaagggttctctattaacctgcaggcttcggtagcacctttccaaaactactgattgaagagagagtttatagggaagcttgaacatccagacagaatttgttgatgactggagaatactggacattaatgggcatttaccaatatttatagacattattacacacataatagaagccaaacaccacagtttgcttctttgcagctatccaagatgacccagatctgcggagcctccaagtttaagaaagtgtacctgtgatgtaattcattaaattgttaagtgttaataaaactagatatctctaatggtgaacaatgtatagcttgctgttaccttgggactagctttaccaattcaattactccttctgggaggcggtctgtagttgtttaaaaattatgtttatcaaatcactctctaatgtaaaaccaactcagctgaaatattcatgtctctgatattcctgacagtcctcatgaggtcacggagtcagttttgtttcttgtgtgagcaagcaaacttctatattctcaatgagaaaatgtatacttggtagcaattaacttacaaaacaaagcctatactctggacacaagtaggtttcaattagaatgtgtgtgtgtgtttgtgtgtgtacatgcatgccagggtttctcaacagcagcattagtgatatttgaggctcaataattttttgttaccttatgtactataggattttggcagcacccctgacctctacccactagatgccagttgtaacaaccaaagaaaaaaagatgtcaaacatgtcctgggggacactgttaaatcttcccctcttcagtggggaaccactcatttatcacaagtcatggaaatgtactgcaaaagcaatgttctcctcctaatgggtgagtagtcctgcagaatttcagtactggaaaaagtctgtagaagcgatctaagaaacagcacccttcatggcagaaatgaggatactgagacccagagaagtgacacgatatctgcatctatcaaaaacactggtttcaacatcaagtcccaaagcacattctacatggcactaatctcctaagttgttcctctaaaaatgggttctatggttccacatgctggagaaatgcttcatatcaaatcctcctcctagaattaaggaaaacctatttagttttgtttacactgtgatgtcttagagagatctgaccctagatgtttttcccatgttgaatacccgttaacaggaagctgagccccttggctcttacatgggccttggggtgtgtgcactgaaaaacaaggccctctgccccaccatggccatggggctgtttccctgtctactccactccaaaattccctaggaggtatgctgactattccagttttcaggtggagcatttggctgagggtaaaaaaacattctttgtagacatagtttggtttgctgtttggaatggtatattatttcaagcaagtcactccgagctaggcatcaatgagggtccaaaagaaggttccttctgaagtcatctgtgaccatcccaagtatccttccatctgaattctactgaccctgccaatcatttggcacttaatgtatgcctccttcttggcaaatttctggtgtgtgcgatccttcttccctcaacctgaccaaagtttctatcaaggcaagaactgttttattaacatttatataaatcacccacataccactttaacacaccatttgataaattctttttggttggccaaggaggccaagatatttcttttaaaaatgtattcaatataaataaccttttactataaactggtcatcaagaaagaggtctgggttcaagcacaagcagaaacatgtttacctggtccctgtaactcttttatagttgtccttggagtacacggctagaatgctgacacctgagcccatgttaaccagcaacatagggtatgggttatcaaggcagtacggctttttttgacacaattcaggatttgtgggattttcaaaatagtaacattctggcttgccgttgaagccaacagagtcgacataaagcaggccctgaatcagacagtccagttcatccagtttatgcagctgcaggtcagcaatctaaaacaaaacacacaacaaaataaaaccttgtgagataggcgaccatctaaggggaagccccagaggttttatttaagatggggtcattcacatgaaaagcatggagacacccttaaaacaagttgtaaaatcttgcagataatcagccactgcactggaaaagtagccttggctagatgtcatacctgcccacagtgcatgctaaaggacaagagcttgcctgattgtttgaaatgcacccatcagcgtgtgttgtgggttgaatggtggtccctgaaagatggcactatgtcctaattctgagcacttgtgaatgtgactttatttggaaaaagggtctttgcagatctaattaagtatcttgagaagaagtgaccatcctgggttattggggtgggccctgagtccaatggcaagcatatagacacacaggagagatttaaaagatgcaaaggagaaggccatgtgaagacaaaggcagagactggagtgctgctcaacaggccaatgaatgctgacagccaccagaagctggaagaggcaaagaatggcatctccccaagagccactgaaggaagtacggtcctgctaatgctttgaatttgaacctctggcattaagaactacaaacgaataaatttctgttgtttgaaccattaagtttatttgttatagcagtgacaggaatctaatagggaatgctgccaagaaagaggtgcttacacagggtgagcagactgagaatattcagaaagcaacaaaaatgctatacttccttggtagagcatgaagtcccgagggactgggaactggggtgaatcacctttgagcccacaaagccctactcccctttttccaggcttgggctctgtagttagatctggctttgaattctagctctaaaatttacttaactgaatgatttctcaaacctcagtgccctcatgtgtaaaatggggaagataataataacattcattgcacactgttgctgtgaagattacctaaaaatataggtaaagtgcttacataagccttggcaaatacaaagcattcaaaaaatgttggctcttttattaatgtctggggtggtccccaagtgccctattatgttcctgtgagacaaaaatgtacaggggcaaaaaggtaaaggggaatgacctggctgagggctaggcttagggtctggtagccattttgccttctcaaaagtttaatttatgatcctcaaatatattactactggcccagagatctggaaacatcattttccatggaccaaagaaagaaaaaaatctaacaatcaccaacatgaaactgaacaaatgaagataatttaagagacccaatataaatttttaaaaaatctctttaaaaatataatagcaagtatttactgtttactacatgctaaacccttgtaccagattatttaattctccctaaaaccctaaaagttggtactatcaaccttattctatggttaagattcacagaacttaaataactttccctaagtgacacaactagcaaatatctcccaatgacttgctgtacttctcgtgtcttcattgtcataatgggtactgcttctggagtctggaaacagcctacacaagtactagactcagatattttgtcaaaaagatattatcttcattataaaagttaagaggtaaaacgggctggggtgtggtagttcacacctgtaattccagcattttggggcgccgaggtgagaggatcacttgagccacggattttgagaccaacctgggcaatatacggagacccatctcttaaaaaaaaaaaaaaaaaaaaaaaaaagcctggtgtggggtacatgctgctggtcctagctgcttgggaggctgaggtgggaggatcactcaggcttgggaagtcaaggctgcagcgagccatggtcgtgtcactgcactccagcctggacaacagattgagattctgtctaaacaaacaaacaaaaaaagagctaaaacaaaatttttgacttcatgttactcatttgaatttcctatttgacaacatttttgacttcacattactcatttgaatttcttatttaacaaaatcctctgattgtatacctgcagaacggaattagttagaataggttaccaaccagatagtggatgtattcttgattattcttgaaataaacattctaaatgacccatggtgctaagtaaatctacctcataaatggttctaaacatttctttttttaccaagtgaaacttctgtatgagatgtatgtaattatacatgttttaagaagcaaaattacaggtataaaactatctggagacctgaaagactatagcagggcatagcagtgtaaacactatttcctctgttctccctgattccacagccttccattgcacttacagcacaggtcacattctggcttgttttctaggtctcttgctgccccttagcactatgctcaaaggcctgcacataataattgcttaataaacatttattatgtggaacagggagttattatctcttggatcaccccaaactgaaaagtagcaatttcatcagccagtcttggaagtataggttaactgcttaaaaattaatcagaggttcatcaacaatattgacagccaattccagagccaacataacaaacacaaagtctgtcctgctggacctcctgaaactatactaggaaaaaagaaaaacctgccaaggcaaataatctacgtacgtactagaaaagaaacatcattatttcaccttttccctaaaaattattttctaacaaagtgctagcagcaaacatctcttctacacatttcactgaggggtggatatctctgaagcttgaggtcatgcatccccagacagggaaacaaaaatatgtgtcactttcactgagccctacagagacctccctcaaaagtcttcaccatctgggaaaaatgacagggtcccaaatgcaggcagtgagtcatactgctacttggatttttcaaacaggacatctgaaattcaggacaagttgggaattaattatcagactttgcagtccattagtacaactgaatgaactttgtggaaagcttaaaacagcatgttgagatttcagctagtgagaaacactctttctcggggcttagtttcctttacatcaagggccacagactcaaatgcttaaaggagactgtaagaaaacaaaggagcaaaggccttgactagatgtagagtcacagaatgataaggactgtagcaaacaagtcaacctgcatatatttaaaattcacctgctgtccactgttgccatgtgatgttgagggcccagtgttaccagatgaccctatttttcaagagccagaaatccaaatttttatgttaaatcttccaatttttaagggctgacaggtaatttaacattaaaaaaatacattgcagaccaacaaaacatgtctgtgggctgaatctgattcccatattaccaattttatctatatatatcctaatgctgatcctataatgagccttaaatgatcagaaatctgaactgctagatccagcaaatatgcaaatgaagcttcaggtcatttgaacatactttgtaactaagatatgctggtaaatgtttaacaaccagctctctgaaactaaaagccctagtttatagcatttactaatttccatcgtataatcacccccgaccatgaccaatttcaagctaccaatgtgatgtcaataaacacataattgggaagagatgcatacatggactcttttaacccagtaggtgctggctgtagcatccctctgcttgtaactctccttagcacttttggagagtatcagttctgccaattcctaaattattaggttaaatttaagccactcctcaaacttaaaaacaacaaaacaaagcttgtcctaagactcaaactctgtaaataatggaagctaatcaaagactgtatagatcctggctgtgggactttaagcaaggaagctatcactattacctattttgcagataaaatgcatcactgtgggtcagtgggttaagttacctactcctgttcctaagactaacaagtaggggaagaggtaaagtagagaaaattttccaactacaactctgaaaaactagcaatgttatttctaataccaaagttacttaagtaagtaggggtacagtggggttctcaaactttaagtgcatcagaatcacctggagggttggttaaaatgcaggctgctgggccccaaccccagatagctttttccaccctccatcaaatgacgaaaggggccatctatgagtggtcaaagtctcaagcaagaatgaaattgagaatgatagtgtctaccaaatcttatgctcctgcaatatcacaaatcagtcctcagattaataatagggaccaaggtaacaggtgttcctaaatgatgctcttaggtttagacattccacagattcataggtgtcctacccgctcctgatgcttttccatcattatatgctttttaagactggtcccttggagatttctggcataagaaaagccaattcttaagtcctcacacattgaaaaaaagtgatgaaagcaatcagaaacctctttctgttgccctaaatttaatgtcaaccgaataagactgttgttatatcctatttgttcaaagggtaggtaatttttttacttttaaagtaactaaaagagttacttctgacttctaatcaatgttagctttggactggacaaaactcacaagtgtctacatgcatacttccaagatgttgcaggttgatttccagaccacctcagtaaagtgaatattgcaataaagcaagtcacatgagtattttggtttcttagtgcatataaaagttgtttacactgacggggcggtggcttatgcctgtaatcccagcactttgggaggcctaggcaggcggatcacttgaggtcaggagcttgagaccagcctggccaacatggtaagaccctcgtttctactaaaaatacaaaaattagccaggcatggtcacgatgtgtctgtaattccagctacttgggaggctggggtaggagaatcgcctgaacccaggaggcaggtgttgcagtgagccgagatcgcatcactgcactccagcctgggcacagactgaaactccgtctcaaaaaaaaaaaaaaaaaaaaagttgtttacactatactgtagtctatcaagtgtgcaatagcattatgtcttttttgagacagagtctttctctgtctcccagactggagtgcagtggcagtatctcggctcgctgcaagctccgtctcccaggttcatgccattctcctgcttcagcctcccgagtagctgggactacaggtgcctgccaccacacctggctatttttttgtattttttagtagagacggggtttcaccatgttagccaggatggtctcgatctcctgaccttgtgatttgcccacctcggcctcccaaagtgctgggattacaggtgtgagccaccaagcccagcctagcattatgtctaaaaaaaaaaaaaaaggacatacctgaattttaaaatatatttattgctaaaaaatgcgaatcatctgagccttcagattagtaatctttttgctggtggagggtctcccctcaatgttgagagctgctgactaatcaaagcagggtttgctgagggttggggtggctgtggaaaagttcttaaaataaacaaaaatgaagtttgccgcattggttgactcttcttttcacaaaagatttctccacagcatggaatgctgtttcatagcattttacccaccatagaacttctttcaaaattggagtccatcctctcaaactctgccactgctttatcaactaagtttatgtaatattctaaatcctttgttgtcatttcaacaacgttcacagcatcttcaccagaaggagattccatctcaagaaaccattttctttgcccatccataagaggtaactcttcattctttcaagttttatcatgagattgtagcaattcactcatatcttcaggatctacttctgattctagttctctggctagttctaccatatctgcggttactttcttcactgacatcttgaactctgtccatgaggctgaaattcacttcttccaaactcctcctaaagctattttattcccccaacttgaatctgaaatgttcttaatggcatctagaatagtgaatcttttccagaggtttctaattgattttacccagatccatcaaaggaattgtaatctatggcagctatggcctatgaaaagtatttctttaaaaaaaaaaagtattccttaaataataaaactagaaacttgtaattattccttgatttatgggctgcagaatggatattgtattaataggcatgaaaacattaatttccttttacatctccattagaactcttgggtgactagttgtgttgtcaatgagcagtaaaactttgaaaagatttttttttctgagcagtaggtctaaatagtgggcttaaatatttagtaaaccatgttataaacagatgtactatcatccatgccttattgttacattcgtaaagcacaggtagagtagatgtagcataattcttaagggccacacgattttcagaatggtccatgagcgtcggcttcaacttcaagtcaccggctgcattagcccttaacaagagagttaccctgtcccttgaagctttgaagccaggcattgacttctgttctgtactatgaaagtcttaggtggcctcttcttccaaaacaatataaggctatttcatctatactggaaatctgttgtttaatgcatcaccttcattagtgactttaactatatttcctgattagcttgctgcagcttctacattgcacttagtactttatcttgcactttaatgttatggacatggcttctttccttaaacctcacaaaccaacaacctctgctaccttcccacttttcttttcatgtttttttgagacagggtatcactctgtcacccaggctggagtgcagtggcacaatcatagctcactgcaacctctgcctcctgggctcaagcgatcctcccatctcagcctcctgagtcactgggactataggggtgcaccaccacatctggctaatttttgtattttgtgtagagacagggttttaccatgttgcccaggtgggtcttgaactactgggttcaagcgatccacccaccttagcctcccaaagtgatgggattacaggcatgagccacaggaccccgcctacctttcaacttttcttctgcagcttcctcccctctctcagactctagagaattgaagagttagggccttgctctggattagactttggcttaagggaatgttgtggctggtttgatctttaatccagatgactaaaagtctgtatcagccataaatctgtttttctctcttattatttgtgtgttcactggagtagcacttttaatttccttcaagaacttttcctttgcattcacagcttggctaaccatatggcacaagaggcctaggctttggtctgtctcggttttcaccatgcctttctcactaagcgtaatgatttctagcttttgatttaaagtgtgggacatgggactcttcctttgacttgaatatttagaggccaattagaccaacagtagtactattaattggcctaatttcaatattgctgtgtctcagggaatagggaggcctgaggtagggagagagatggggggacagcctgtcaatggagcagtcagaacacacaacatttatcaattaagtttgccatcttatatgggcataatgtggtgggtgccccaaaacaattacaatagtgacatcactgatcacagatcaccataacagatacaataataattaaaaagtttgaaatacagcaagaattacctacatgtgacacagagaaatgtgcgtacaagccattggaaaagtggtgccaatagacttgctcaatgcagggttaacacaaaccttcaatctgtaaaaaatgcaatacaacaaggtatgcctgtattgcaatgaaaagctatatgggcagaattaatgactttttaaaaataaattttctgatgttaaaaataccttgcattcttgagaatacggttgttgaagttaggaagtgtggttgggaataaaaatactagaatctgtacataaaatattctgcttggttatttaaaacaaaacccacagaatatagacactgggaataaacacaaaattcactgaaacctacagagccttggtgcacagccatgcagagttctccatcttgaaagccactttttaaatggtgggagttcctcattggcttatcaacatcttagtctatttgaagttaggctaagtttttcttctgtgttccattttgataactcattgattttgaaggctagtttttgccagtcaaaaatttggttatgacaatgatcctaaactttttttttttttttttttgaggtggagtctggcctcgtcgccccggctggagtgcagtgttgccatctcagcttactgcaagctctgcctcctgggttcacgccattctcctgcctcagcctcccaagcagctgggactacaggcgcccgcgaccacgcccggctgattttttgtatttttagtagaggcggggtttcaccgtgttagccaggatggtctcgatctcctgacctcgtgatccacccacctcggccccccaaagtgctgggattacaggcgtgagccaccgcgtctggccaatcctaaaatgttaaaaaagaaaacaagaaaggaaagaaggaggggagggatggtgggaagaaaaaaagaaggaaagaaaaaggaggaacaaagtgcagacctgttcaactgagagtattctacacaggtctaatttaatgattgtgtcatggtttatagttctttcttgtacattttaaatggaatgaagaatagttacattatctaaggattcaagtacatatactatatattttttaaaaatactattcaaatataacaagtgcttactattcggggtctgttgtacatcttttacctagccctaatcgctcaaataaatcacacagatggatttttcaaactcctatctgcaaagttgtgttataccaaaaacagtgattttatacaataacaataacaggactttataggtatgtagatgtacttctgtatgatttgtcaaattgttttaatacgtacagtagtatatattgatcctttacaattaagttagcatcttcgattttctattctagaaatgaggagagcttggattattaggacactaagggccttagcactcactgctccatctgcctaacacactctttctttgcatgatttgctgtcttcttcaggtctctgctccaacattgcctagtcacacaaagaccctgccagcactccctatcttctttgccctggttttttccctccattcatagtaattatcaccatctgatatattccatattcactttcttttttgagacagagtcttactctgtcacccaggctggagtgcaatggcacgatctcggctcactgtaaccttgatctcctgggttcaagaggttctcgtgcctcagcctcctgagtagctgggattacaggcgtgcgccacctcacctggcttatttttgtatttttagtagagacagggttacaccatgttggccaggctggttcaaacccctggcctcaagcaatccacccgcctcaaccttccaaagtgctgggattacaggtgtgagccactttcgcctgactctatattcactttttaaattgattattgattgtcttcccccactagaatacaagctcatggtgagcaggggatttattttgttcataacagtacttggtgcactgaaagtgcctgagtgagtgaatgaatgcttaggaaggaggataacacctattcatcctcataactttggaaagactcaggcacatcactaacataacatcaaatgggctataggaaaagatctatctgtttcaattctgtcttcactttggctgagactcagcctggatacagaaggcagttcatagactcttctttcacagatggatgcccaacctggccagactatttagcaaatgttacatacttgctccctactccagtctattcattaggcttcaaaagcctgtccaaaggaggaaaggcttctttatcttggttgtaatgagatgtgacttttctcaacttagaaccttgagaaatacacctgctcatggccaacacatattgagtaactttctcccagggtatacgttaccccaggggagagatggaggcattgacagaggttgcatcaatcctctgggtcaccttggttcacttcaggctctccagtggaaatggacagatagggcatccttgagggacctgaggagctcagagcaatgagagtggatcagcatttccttctgaatcagaattgagtccaagtcccagctcttacctaggtgacactgctagaagcttttgatctctctggcagctttagtttcttatctacgtagcacaagaaggctatactttctcacctccagaggtcactttcagttctgaagtcttactcccacctctttgcagatgacaaaatgaggcccagagaagggacaggtcttgcctagtcacccagctgatgaaatgtagaaacaggactggagttcaggttcaatggtttttccattatggactgaaacttagttctcaagcccatggatctcaaacatctcagttttaaaactctttgatcatgagcctctttggtgagaaaaggattctgtgggtcatttaagtaagtggcaagtcaaactctactgctgggtaataggaggggacatagaagaaaaaaaaaaacaaaaactgaagataattagtctcacttaggatactattctaggactctgttgcctgcccttacagaaacttactataatcaatgaggtaaatggggttacttttgatggcacaagtaaaatttgcatttatagctttattaaataccatgaatgtgcactgattgattaatgtattcattaatgacagactttatagcaagactggattatgttagttctgcacaaaatggcagtaatttgtactacaggctttgagaatacgtattttatgacttacctcactatatgttcaactttctagtaaaactaatcctaaaatctcccaacccttccttcttccatgttcaatcacttttgtttatctagcttcccttcctttccaagatatatctacatctattgtttcactttcttctcactttataaaatgaagactacacagtacagagattattatattgactgtagaaaatgaagaaattggaatgcacagatgttaagggaatgctaaaaaaaaaagagagaaacattggactgcatgttacttatccgtatcttccatttagcttcatttgttaaatctaaatgagcaacgtacagtttgtaagtactgccagtcaggatacagcattatccttactatataaaattatactccctaaatggtattcattaatgaaggaattcactgataagtaatattacagatttcatttttgtttgtgagcaaaacttctgaatggcattcatatgctgaaaaaaggcacttgagagcaaatgggtagatagaagtaatcatttttggtaggattcatagaagccttcccatgggtctctgtttatatatgcataaagttggcatcacgattatatagtaaaagtctgtggtcaattctaactgaaatacttcagaagggattttagcatcttgtctttagcgtattacccagcaataattgtaattgaaatgatgatgataactatattgagcacttactaagtgccaggtacatattatctcatttaatcctacatgtaacaaccctatgaggtagaagctgtttttattcttgtataggtgagaaaactgaggcacagagcggtgacataagcttgtccagagtcccaaggctagtagtatggttcttcggtatgagtggccatgattatggacatgtgagaggttttgatgttttaacaaagacaaacccgacctaccattctgaagtcctcttcgaatttgaaagccccgcctcctgtggcacagagggtggtgtgaaggctagagaagttcttctcgctgcccatctgaatgaacctgtgcatagcacagctgggaaagcggatgaagtgcaggttccctttgcgtccacacatggtcaggtttttcagttccaggtggacgtctcggatcccagttttcccataagcagtattagaagtcaaatacttccggatgctcttcaggttctccacttcctcttgctcctcttcggctgtaatatccttcggctcgaaatacaccaatttaaccagcgttccaccgatgtccatgccaaaccatgggaatgctaaaggacagaaagaaagagtgctgctgaatgctatgcgtgcaaagaagtgttcagtttttgaatattaaataagcaaaagcagtggtatcatatctacatgtgcatttaacattcaatttatttgaattcaactatatgtgcctaaaaggtggcacagacagagaaaattttacaatcaaaagagtgcccaaggctctgctcacacaccactgcactccactcagaattgagtgagatgagaaataggattctgcagttccctaaggcagtctcaattcctgtgtgcttcctagggctcaagtatctcaccaagctgagtgttatactaatatttaaagatagatatatatatttttgcatacatcctggatcccaattgctaactatttttgtcagaatctttaccaaagaaacggatctgcttcaatcctagaggaaaaactgaccatgctgggtgtaccaagagatggtatgtcggtctctaacctagggcgcatttcaatgattccatttttgctttatgaactgactttagaagatgtgattccactgttttaatctatacagtgtatagaaaggggaaagagagaggaagtagactatgagagatgatgagcagacatgaaattctaaaaagaacaactcgcattatatctaatttatttctgcattaaacagagacatcctctctattccaaatagcctgctcagaagttctcaatccggctgccttttagaatcagctgagaagcttttaatattcaatttctggcctcctctcgcacatattctgtttaattcaggcatggcatccagacatgaatatcttttaaaagttccctagtggttgcaatctgcaggcttggaaactactaaaccagaggaaccatggccaggtctgaaacacaaaggcatgcctctaggtgaaagtatacttaatgtgcttgtgatgcttatctatgacaaaatgaatctccatcatgatgatttttttagttatataagctctttattgttaagagctgaaaagagcagaggtgagctacctaaacagtctgactttatttagagacagcctggaaagttaatgccatgctgtcaaatgctctgcaatgaacacagagcaaacccaaatgggaacccaaaggttagagtcttcctttttatttccctcacagaatccattggcaaaacccaaaactgtaatattaaaactgaatttaaagactcagggtgcaaaaatggcttccttccaagtttcttttatttcagccctagagaacatcaatatgaacccttgtcaaattgtccacactgccagaaacatcagtgggccctgcagaaggtcttttttctaggcacccctactagtacttagctttcaattcaggagggctgagggaggagtgcctagcaggaaaccatttctgtaaacaaaatcttctttcctctgcctcactattgttattttggttatgacccaagatagctgcttctcacttgttgagcaggaactctagcattatagaaataaaattccaggccctcaaaagattaagagcaacaaatttcactgacaagaccaagttaacaaatgtcttgttttctttgcagacgtttacaaagcaaattctgcaaccagtgtaggttgggaaactcgcttgtcctagcaggagatgaaaaaactggaaactggtcatcctcatttgttgattcagatcacagatgaagtctgttggtttattctctaaaactcactgtcagcatgggccacagtgtaggagcagcatgttgtaataggtaaagccccagactgggattcggaacatctgcttccctgaagcagcagacagtaagtagctcactgtagctccttctacctctttggattttaatttccttatctgtaaaaggaatgggttgcattaaaattatctcgaatttcttccctactatcaactttccatgaattccttaagaaatacaaaagaaaaattgcaagtaaccccaatcataaagtctgaccagagtctttttcagtggagttttaaactccctggaaatatactatggcatgttaacaagtgcctgggctatgcaaccagtgctgcagttgccatccattctcatcagagaggcgaagatgcctacactggataggatgggagaagggtattttggaacattgctgggaaatattttgacaacatctattacaattgaaagtacacatgcatttttaactcagcaaagccctttcctgggccataaaaaaagcacaagtattccaggataggcataagaatgttcaccgcagcatcttttaccatgctcaaatcaaaaaacaaaaacaaaaccaaggcaaattggaaacaagatgagtgccctttaacaggaaaactgtccaataaaatggatgacttccaaactgtagaatattaggcagctattaaaaagagagtgaggccaggtgtggtggctcacacctgtaatcctagcactttgggaggctgaggcaggcagatcgcttgagtccaggagtttgagaccagcctgggcaacatgacgaaaccccatctctaccaaaatacaaaaattagccaggtgtggtggtgcacgcctgtagtcccagctacttgagaggctgaggtgggaggatcacatgatccagggaggcagaggttgcagcgagccgagattgcaccactgcactccagcctgggtgacagagtgagaccccctatctcaaaaaaaaaagagtgaaatgtattccagcaggctagaaatatttccccaatcttctgttaataagaaaagcaagaaatgcctagaagtgtaaacaactttttaagcctatttggtttagggagaggaagggaggaaggaaggaagaaggaaggaagggagaagagaagaaaggtaggaagcacaatttctaatatgttcatgattatatgagcctgtagaaaagcatagaaggcccccagttgttaatatttacaggagtggcagaatgagcaggttgtatagttggtggctagagatccaggaaaagggatggagaaaattctacacttagagctttcagtaaaagcagataataaaaaaataagaattacataataatggaaaataggagatacttccgcacaacaagacccaaacaagctacgtaaaccccagaaaacaatctagttctgtaccagaaatgcagaattcacccaggtacagctgctatcagatttctggaaggaagagcctgcacataaccttttatgtggttggatgttggtaaatacaggtaactgaaaagaggtctcacttttaaaaacactgtaggtgacgcctgaagattttttgttattcagaaccctggttccttcctcctgcttcatctcctgctctttctgaagccatttcaaagtttttcttggcaactcaacagaacaattggaaaaagtatagagttttgaaatttcagctaaatgttatatcattagtttgggttaaggtaggagagataagaattatcttatctctggggtttcaccacgttgcccaagctggtctcgaactcctggactcaagtgatccacccacctcagcttctcaaaggaactacagtattagtttaagtggcaaaagaaattggcttttctttacctatgtttatatcttacctccatgaaaaatctaatgctcttctagtcacatttattgctttttcagtacactgtcttatattaaatgtacaattttattcatcttcctgatatcaagatctgcctaaacctaagcttcccatgcacaagctgtggatggagacagaagagaaggggaaggaagaacatcctagtgcagctatgatccatgactcatgttttctttactccagcatacccagatgctttgatcaattcagttgaactactaataagagcttattctgtgtttgccaagaggagtgatgttggttttaggtacaggaagtctgtattcaccccttactcctccttaaaccagatgtcattttaaaatatttctagagtattcatcaacaacgtacagcaggaaaccaggctcaaacttcacaggaagacttttgcaaacaaataaactgacccactcattcaaaatggttttcactctggtgaaactgatgttcataaaaccaagtgctacagataaaatggctgtacatccatctttgagcaacaagttttaaagaataaaaggaattcctagataaatttctatacattgcatgaggagacatacacaaaaatgttcactgcagtgatttgtaataataaaaaatggtaacaaactagatgttcatccatatgtaaataaaatatgacagatttatatgatagaatgctacacagttatgagaatcaattatatttatatgcctcaaaaggcattttagagctgtttgcctgtagtcccagattctgaagcagctgaggcaggagaatctcttgaactcaggaggtcaaggttgtagtgtactacgactatgcctgtgaatagttgctgcactctggcctgggcagcaaagcgaaaatccatctcttaaaaaaaaaagacaggcgcggtggttcacgcctgtaatcccagcactttgggaggcccaggcaggcggattttgatgtcaggagttcgagaccagcctggccatcatagtgaaaccctatctctactaaaaatacgaaaattggccaggcgtgctggtgggcacctgtagttccagctacttgggaggctgaggaaggagaatcgcttgaactcaggaggcggaggttgcagtgagccgagatcactccactgcactccagcctgggggacacagtgagactccatctcaaaaaaagagtatcttactggataggaactgaaaaacaatgttgaaggaaaactttagggttgaaaaaggtgatagatacattgttacttccaggacagggcatttaattacaggcatgagaccctccagagctttccctctgctatggtgatgggaagcattccaggtaacccacaatgaacatagagcataagcacaaaagaaacctttgttcttttcaaccattgagatttggatgttgtttgttactgcaaaagatgttgcttgttactgcaaaagaacctggcctattccaactgataaagtgaagtgctgctgcacaacaacaaaatgtggcagtggcttagaagccaggcagcagggagtgaagaaatggattctggagactggcacagcatttggtaaaatgatcatgtatgataacttggaaggcagataatacacctaaagaatgagcagatctagtgaaagactttgaaagtctaatgttagtagcatgtattcattactattgactgcattttaaaaggtgtaatgaaaaaagagagagatgagctctctctggtttatagattaaagaaaagggaatagagtccattaagttgcacttgtatggctggaaaaagcagctgcttctccttcccaacaaatagaatggctaccacacccactgttaacactctgaaagggttaagatgtctccaataaagatacagttgacactgtggcttcttggttaaatctttcaattagaatagcttaagggaaaacatgctaaacttgtagcagtctcaacaaagccattaataaataaaggcatggaagcacaaatacaaaggaataagcaaatacaagtatgcctagaaggaattgagggcttaattcttggtatatggaaataaattggaataaaatagatgagaaaccgattttcttttgaaaaataattgtactgccaaagaaactgcaatctcacacctaaaacagctgggaaaactgttcaagacctaaaaaacctctggagccctcaactctctaaagtcaggaagcagctgagaaggctgttcaggctccaacgcaggcatattctcagtgttcactttagatgcaatcagagagtctactaggaaataaaagatatctctcaaggggtggagccaagggctgaagagaacaatggactgggaaggctcttccagggagaagaatcaggaccctaaaggacccttctccacctacaaggcagggggcccagagggatttcagaattgcttcagcattttagaatgactgagcaccagtgactgctgggtatctcccattcaccccctttctgaatgggagtatagattaagttttccaatctttgtttcaccattatatactaatatacaatgtgtgggggggtggtgatgaagagcagataacttgccacttttagttcagaagtctctagatcaagaggaaccacatccagagttgatgtagaaatgactttatatcatcacctgagtaacagcctaaattaggcatcatccagatactgtgctgggtgagactttggggcagtctcctttggggaaggaatgaatgtattttgcctgtaagagggagagtgagacaaatatccggtaaccagaagagcaacctgtgtcactagtgcagctggccaaatatttctggtctctttcttccaggcccatggggtcagaatgcaactcttggccattttatacttgagctgggcaatgttcctaacctggctggtaagttgtgaatggaaatggtgtacgtcactttcaggcaagaatacttgcctagaatgagaatacttggctagtgtgagacccttccagattctttctgttaccttaaccagcaaaaattaagacaattgttctatcacctgggtctcaaagtaaagatgaatcagaatggagcttccagccacctttcaatgaacttgtgttgtaagaaataaacttttgttgttttaagccagagagatttgagggttatttgttactacagaataaccttgcctatgctgactaatatacccctaaatcaaaatccttcgcggtttttaaagctggaaaaattccctctctagcagaactatatataggaactgtcatgatcacagacaaacatgtggtagctgagtgttaaaaaggtatataggtcctgttatatttatttctgtctaaaaatttcttaaaatacaaaccaagattgtctatctggtagtagttaaaactgaaataaatctgcatttcaaatattgtggcaaaaacattttaaaactttattggcagttgatgttttaaacaaagcctatttcttgaaggctttttcagaattctagaatactctctgggggtcatttaggcttcctgcagtagctatcaagtatacacagtgaactccaaatagcctaaatgagcaaagacatgaggtgaaaaaaactgaaaagattttctatcaatcgaggaaacaattttaaaaagctaagggagcatggcatgagaaaatcaacctcctcttgatttcacagtataaactaaatgtaaaatctgagtttctctataaccagctgcagagccttaagaagtgttcctggtgaggcacaagtgttcctggcgagtgttcctggtgagattccctaatgccaatgtcttcctgaatgtaaatcaggcacccaagggctcaagatgagcttctgtgggcatggatctgactcagcagccagttgctgccatggagagtaacaattctctcaaggttctaccaagttggagttaggtgtaattactatgaatagggtgcagcaggactgaaatttctttttccaatatttgtaaagatttgttaagcaaatcaacaagggggaaaatgtttaaagatcatgtgagcaacagaaaaaaagctttaaacacttctgttgcgggaagtcagggaccctgaatggagggaccctgcagcagaagaacataaattgggaagatttcatggacatttattagttcctgaaattagtacttttataatttcttatgcttgtctttactgcaatctctgaacataaattgtgaagatttcatggacatttatcacttccccaatcaatactcttataatttcctatgcgtctttaatctcttaatctcgtcatcttcgtaaactgaggatgtatatcccctcaggaccctgtgttgattgcgttaactgcacaaattgtttataaaacatgtgtgtttgaacaatatgaaatctggacatcctaaaaaggaacaggataacagcgattttcagggaacaagggagataaccgtaaggccaaactgcctgcagggctgggcagaacagagtcatatttctcttcttgcagaaagcaaataggagaaatatcactgaattattttcccagcaaggaataaccctgggaaaggaatgcattcccagggggaggtctctaaaatggccgctctgggagtgtctgccttatgcagttgaagataagggatgaaatacaccgtggtctcctgcagcgccctcaggcttgctaggattaggaaattccagcctggcgaattctagtcagacctgttgtctgctctcgaaccctatttcctgttaagatgtttaccaatgacaatgcatgcccagcaggacatggaacctcatcagtaattctaatttcgccctggccttgtgatcttgctttgcctctctgcccttgtgatcttttattgccctttcaagcatgtgatctttgtgaattactccctgttcgtacccccttccccttttgaaacccctaataaaaacttgctggttttgtagctcagggggcatcacagaacctgccaatatgtgatgtcactgccagaggcccagctgtaaaatttgtctctttgtactctttctctttatttctcagaccggccaacacttagggaaaacagaaaagaacttacattgaaatattggggctggtttccccgatacacttcaaagatattttacaccaaatgaatattaattatgttcaagttgcctaaggacgtccacaagttttaaaaaattccttgttaaggccgggtgcggtggttcacgcctgtaatcccagcactttgggaggctgagatgggtggatcatctgaggtcagaagttcgagaccaacctgaccaacactgagaaaccctgtctctactaaaaatacaaaattagcctggtgttgtggcacatgcctgtaatcctagctacacaggaggctgaggcaggagaattgcttgaacccgggaggtggaggttgcagtgagccgagatcgtgccattgcactccagcctgggcaataagagcacaaactctgtctcataaaaaaaaaaaaaatccttgttaaatccaattgtgtaatgaattatctctttaaaaatttcctgtctctgagaactaaccttcctttcacaatgtacaaatttggttgatagtataacaaaattatttgataatatattcacagaaacatttaatgttaagaggtggaaggaacgttaggttgagtctaacatcctgtttacaaataagaaaaccaagacttagaaagatcaaggaattgtccaaggttagtcacaataggtatctgagcccattttcagtttcatgaaccaataaatccccattttggtaggctggtctgaggtgaggtgtctgttgcttacaaccgagaatgtcccaacagtcagaatttgtgtgggcaagtttcttacttgagctatttacttgtctttatttttacttttagggggatggagcctcactctgctgctcaggctagagtgcagtggcacaatctcggctcactgcaacctcaacctcctgtattcaagcaattctcctgtctcagcctcctgagtagctgggattacaggggtgtgtcaccacgccttgctaatttttgtagttttagtagagacgggattttgccatgttggccagactggtcttgaactcctgacctcaagtgatccacctgccttggcctcccaaagtgctgggattacaggcatgagccgctgcatctggcccatttactagtctttaaatggaggtagattaacctatcactaaagttctgtctagttctcacattctatcatcctaaataatcatatgcaaagacctccaaaaccatacttttaatagcatgaaacacagttgaaaacttaatgactatttaaggaccttgaagaaagtagtgaatataaaatttaataaaagtgtttccctaatactgtaaagaaacccataattatcacacacagagcaatctgttgaacattactctatgaaaagaaatttgagtcatgggttctttcaaattaatgtgtaccagatttccttagtttgaattttagttataaggtaattacccagtgttggcaagggtacaagctcatatgctaccactgggaatgtaaactggtataatctttctatgggtttatttggaaatacatattaaaaagctccagattcctataccctttgatatgttggttctattttaccctaaaagaaattatgtgtgcatccaaaaatttagctttaaaaaaatacttaaaataggccagacgtggttgctcatgcctgtaatcccagcactttaggaggccgaggtgggcggatcacgaggtcaggagattgagaccagcctggccaacatggtgaaaccccgtctctactaaaaatacaaaaaacatttgccgggcatggtggctggtgcctgtaatcccagctactcaggaggctgaggcaggagaatggtgtgaacctgggaggcggagcttgcagtgagctgaggtcgtgccactgcaatctagcctgggtgacagagcgagactccattccaaaaaaaaaaaaaacttaaaacattgaagttgtatttataataagaaaactaatttattgtacaacaacagagggctaattaaacaaataatcaaataattattcattaacacaaagtgatttaatttaaccattaaaatcactttgtaggacatcatttaatgatgtgagacaaatgttcattatctatcgttaggtgaaaagggcagggattaaatggtacatttcaggcggttataattttgtctaaaaattaaatggctatttggacacacacacacaaaactagaaactttaggccaaaatgttaatagctggatcatggattggggtgatgtttttttcttcctctggcttttctgacacttttcttatttttttgttttgttttgtttttgtttttgagatgcagacttgctctgtggcccaggctggagtgcagtggcgcaatctcggctcactgcaagctccgcctcctgggttaacgccattctcctgccttagcctcccgagtagctgggactacaggcacccaccaccatgcctggctaatttttttttgtatttttagtggagacgaggtttcaccatgttagccaggatggtctcgatcttctgacctcgcgattctcccatcctggcctcccaaaatgctggattacaggcatgagccaccgtgcctggcccaatttttttttttttaaataatcaacacacttgaacttcataatcagagctatttttaaattcttaaaaacttctctgtaatgatgcaaaagaaaatgaaattattttaactttgcttcagtgaacagatagcaggtctgtggtcctgcccatagaaaataatatgctttcattccctaactcaacaacagttccttctcttctcatgcaacagcctgcccatatcaaaccaattatcaaaatccactgaacgcaagccatcaagaatggcaggagtaagcccaactcccaagagcaaagttattcagcctgttagacgcttgataccacaagggttccctcagggtgggaagaggctgattcactcacctgcaccacggccagggcaaaaactgtatgttaaacttagcaattgaaaatacgctgaagaggacacatgtatgtttgtgggatggaatcgctgtgggacagtgtactgtcacaaccttgtgtgacaataatctttcttccactggcacagccccagattcctatcagctttctcctctcgcccagacacgggctgatcatattctaatatttgagagggaaaaagagaacagcaagaattcctttcagaacttctgaggcatgtagaagtattatcaccggagtcacatagagactcaagtctgaatttcatcacctctgctgctcggggttaacccatctgttaggtgcaagaggcacagtggctaggacctgccatacttttaggcacccatgaaaataatttattttaaaatcagaagaaaatatatgaacatttaggttaaggaaaatacaatttactatataatattaatacattcatctttacaccaacaataataaaatataacttttatttattttttatggaggaagggggcccatgaaggcaaaagtacctaggcccataaaaggtatcctctacattttgctctacacccatcttcaggttaaaactgacatgataccataccaccatccactttgcatttgcaatgtgaacctggtctctgtgacttgtttacaatcacatttccataaagcaacttaaattttactatttagtgcaactaaattttaaagtcaaagttttagttatatttattttttttagtgactggccacatttaacaacatggtttctcaaatttgcctaatcataaaaatcacctaaggcacttgttaaaaatacagactcccaggacatcacctagagattctgattcagtgggataggagtcacgtcccagaaaatgttttcaacaaggggtccctgtaattctcactagtcaagttcagaactactattctagttgaatcaaaatgaatactgtaagtagctggactacatttctttgttttcttgagatggggcctcactgttgcccaggctggagtgtagtggtgtcatcacagctcactgcagcctcaacttcccaggctcaagtgatcctcccacctcagtatcctgagtagctaggactataagtgtgcactctaccacttctggctaatttttacattttttggtagagatggggtttagccatgttgcccaggctggccttgaactcctgggctcaagagattctcctcctcagcctcccaaagtgctggaattacaggcatgagccaccacggccagcttggactatgttttaaaagtgagaaactggagtttgtaggagtggctcttgcttgaaactgagcacagaactctgaggcagacagctgagggcaatgcacagccaccaactggcaggtgttgccattcccagacacatctaattgcttgttaatgaaattatttattggcaatttataacatgagtgtaataggtgattttcaaattttaaatgcagcttttgaagtactaggtattatccagccatgactaaaccccatggctgtggtttagaaacattccacatataattaaattccctagatgggctcctctctccccctgactgccatcttaaaagtaagcatacattcctccataaagaggttagctctagcaacagtactcatgtatttaggtcacgcagacagacattctttgatttgcaacccacgcggctgaccttgacacagacaaccatgtgaaattagaacaacaaatagaaacaccaacatgaaagctctgttgcttttattttattttgtaggttaagataaaaaaaaagaaaaaaaaaaagctcttgcaggggcaaaggaagccatgtcattctggtagcaccatgaagtgtattcttagcttggatctgggccaggaggaagcaggaataagatgaagctagagatgaggagacccaaaaatgtcaaatccatgaggttaataaaattttttttccttcagtcttttcgttaagtccctgagtagctcagtgagagtggtttctttcccaaggtcctgaaacctctccatgtcacccttacaagaaaatcagagagaaagatgagcgtcactctagggaccagtgagctcaccttctccccttcatgcctacagtcaagctgtgtatttctgcttcaggggttaaggagaggaaatggtaggcagatgaaatttgtttcccattccacagttaagttctcacgctgtgcagaggaggtgggaggaaaatacacttacagacagctatggtcatcactcctatttctcaccaagaagctgtcagttctgcccaatctagaggcaatagaagatgagtataagtatcaactttctgtgtggtcctcagcatttttttttttttttttttgagacggagtcttgctctgtcgcccaggctggagtgcagctgcgtgatctcggctcactgcaagctccgcctcccaggttaatgccattctcttgcttcagcctcccaagtagctgggactacaggcacccactaccatgcctggctaatattttgtatttttagtaaagacggggtttcaccgtgttagccaggatggtctcgatctcctgacctcgtgatccacccgcctcagcctcccaaagtggcgggattacaggcgtgaggtcctcagctttaattatgccactttcttcatcagaagtagtccctggacaaaaaagaagagtccacagttttgaccatgcaggtgtgccaagggacatgaccaccacgcatctgtgtggctgtctccaatgtgatcatttcagcaaccagagctgagcacagcatccacccaggaatggctccttcaaccttctaatgcccggcactaaggctcaagatggtaatcttattacctgcttaaacaaatccccatttaaaccaccaagaggtttagctttctgtcttgacaagtcaccagagcgtgcttgcatactctaaggatactgttatcaatttaataccagagcatggttaattaaagaggcttcagggagaacagcattgctgggtgacataaccaggcggaacaacaggtctaccagaaatgggccttgttcatttatttcttaactatgaaagtctggcaaatctttgaagttgagctggggggcagaggactgaggaaaggtatgccaactgctcacatggcaacacaagctgaaataaacacttgctttaaataatctgagaccaactacagtcactccttcatatctgtggttccaatcacggattgaaccaactgcagactgaaaatatttgaaaaaaaaaaaaaaattccacgaagttccaaaaagcaaaacttaaatttgccacgtgctggtgctataaagaatccatgtgaataaagtgatgtgtaggtattgtattaggtattaaatcatctagagatgatttaaagtatatgggatgatatgcgtagattacatgcaaatactacgccattttatacagggacttgggcaactgaggattttggtacccatgggggtcctggaaccaatacaatggatactgaaggaaaatcgtacaggcttattcattcactgattgaacaggtatttattttgttcctagacggtgtgaggcactctgctaaacagtcaggatgcggcaatgagccagcccccttggcacttaaattctagtacacaaaaactggtcagtaattaagagcagtctgggaaggagtgaaaactctgctgtgagtgaaatccacattgtcctaaaatcagacatgacttaattaaaacaatcctttaatatttactaatggtagctctatgtagggcaccctcctaagcatagtaactatcacaaagtcaagtctgacattccctagccatcaaagaaacttataatttcactagatatgagactaaaacttatacaagttttaaaataataagatattagtgttggaggatataagagctctggcccataacaggcaaatgaaaagatgctcaacatcattggctattagggaaatgcacatcaaaaccacaatgagatacgacttaaaacccactaagatggttacaagttttaaaaaattgaaaacaagtattatgaggaagtggagaaataggaaacctcacaccactagtggaaatgctaaatagtacagtcactttggaaaactggcagttctgcaagaggttaaacaaagagttactatatgatctagcaattctagtactaggtgtatatacccaagagaagtgaaaactcatgtccacacaaaaaccttacatgaatgtttatagctgcattattcacaatagccaaaaagtagaaacgacccaaatgttaatcaactgatgaacatggataaataatgtgataaatccacccaataaaatattatctggccacaaaaaaggacaaaatactaatacatactacaacatggatgaatcctgaaaacactatgctaagtaaagccgccaatcagaaaagatcacgtatgatatgatttcactcatttgaaatgtccagaataagcaaaactctagagacagaaaatagattagttgcctagggttggggattgtgggggaaaaagaggagtgactgctaataattttctgggaggggataaaatattataaagttaattgtgatagttgtacaactctatgaatacactaaaaaccatagaattgcatactctaaatggatgaaatacatggtgaatgtgaattatatcttaattttctcatttcaagatacatttttaaaacataaatgccaattataccagttcttaaagataatctttctaaaatgcacaacccacttctccatactcttaaacaaaacagactgaatgaaatttgaggtcttcttgatgattcacagtcaaatgacaatcaattattgtgctcactgtacattgatgtcctcaggaatcatgtaaacatgcgcttcccaggctgctatggtttgaatcttcttttgtctctattatagttttctatgtcttgcttttgggctaaagctgttaatttctcactgctgtcagtgttactgcaatatatctatccagaacctgctgtgtccgaatgcagagaaaccaggaaagcaagtctgttaaaactgcatgtatagttattatttgtcaatttaaaaaataaaattaaaaaagaagagtacatagattctgagggagatcacaggaagtactctcaagtgtaagatgcatgagcacctctgactttatctacttcccaacactgattttgattgctcagaagtgtttgcttccttccagtgctcagctgccttcggggttatcactggcatcccctgaggttataggcattgtagttagaagtgacaggcattgtagttacaagtgaatttttttttactataataatttttatcaaaggcacagctagatgtaatatctgactgagaaaagggattaaaactttataaaatataaatatgaacattcaaaatattttattcgcctgggatcatttagttttggggcatagtgttcttccacaccatgaagagtgagattttttcaaattctttagcattggaacttttaaaagttccatcttaattctgaatcccagatatgaaagagataaaagtgacgtcttatttgcactgtctcattttacaaatcacatcacatctaatgtaaagttaattaatgagaacagtgatgcttgttcaacataaaggctggaaactgtcccttacggatgatagctgcagcttcacgaacttcacccatttatttctgtactttatttggattacacaatttgaagaaaagtttgattcagagacagcagctgcaaatcataactgttcttttgaacagcttcccttgcaaactcagggatttcctgaatcaaaactgattcagtagtttgaaaagatttactgaaaatgtttcagcttcttgctgaatactaaaaatacctaacaactcactttgcttgcaacacatataaaaatcaaacaaaaaacatccaaaccttttgattagtgctaaaactctaagacagcattaccaggacttgacaggttacccatttacttgttatgtaactgacctaagccagggtgagggtgagagggtttgccaagaaaatatgtctaagccttgactaaaatttaattgagtgtggtacacgtgtgctgaagtggtatatattatcttatgcaatctgatgtggacagatatataccggccaaacgttaagactttagagctacaaacttgccaataaatagtttatttataagaattcagaagaagtttattccaacgactgtgaaaaatgagttaatccagcagcagcagcaacattatatcaattaacatttaggacatactatgtgtcaggcgctgtgctagcagctttccatgcattatttaattcagttctcataacccaatgaagttggcactattattattcccattttacagattacaaaattgaggctcagagaactccctcaaacattaggtgatctctaatgtgcagtttttttgtttttttttttgagacggagtctcgctctgtcacccaggctggagtgcagcggcgcgatcttggtgtactgcaagctctgcctcccgggttcacacctttctcctgcctcagcctcccgagtagctgagactacaggcacccgtcacctcgcccggctaattttttgtatttttagtagagactgagtttcactgtgttagccaggatggtctcgatctcctgacctcgtgatccgcccgcctcggccttccgaagtgctggaattacaggcctgagccactgcgcccggcctctaatgtgctttgtaaattatagcttttaaatagttaaaaaaaaattaagatttttgaattaaacatttggaccctctaaaagttacacccaagctggataggctggcgcatccctgtagtctcaactactcaggaagctgaggcaggaggtttgcttgagcccaagagttggagattagcctggggaacacagcaaaactgcatctctaaacaaacatttttttttacatgctgtatatagctgttacacaacacatatccatgaatgaacaaacccaaatgcctgtacaccattacctaagactttcctgtattacaacccagtataaaagttgatattaatgatgtccctaaattattagaatatgttaaatgagactcccttgtcaaagaaggcaacgatgtataaaatgaatctgaagcacattttcataaagctgacaaaagtaaaccagttctggcagtttacacagacagaaattcactgatgtttaactagtttgatcccaggaatgttaataaattgagtgatacggattcaggatctttttctttcctcttgtggctaaattaaaatacagagtcctaggtctaaagattgcctgaaattacaaattttagcaacaccccttctttaaacccttggttcaatcctgaatccagcaactccagatttctaggcctgaggccagtcctataccctaattgtcttcaggagagctagcttgcctgctcccactggcaccatccaaatgacttcagaggaaaggagaggggtggaattcttttaatactgttctttagttcttaatctatatttccagacaaaaattatgtaggagatactaatcactcttagtccagtgatactgggtgattccaaagcagctttttggcacaggactatttcaagaatgaggtttcaaatctcagaccatgaagaaatggtaaaaaattaatcataaacaaacaataacaggtatgggcaaatgaaaggattctccaggggcaacacaaatcaggttttcaattatccacctacaaatgagatgtaacaattttaattgtggttagataactgaatttatctaattgtgcatcataaaacacaatagtctcaactggatataatacactgctaacttttacagcaaataacagattgtgtgtgtgtgtgtgtgtgtttttttttttaaaaagggttcttttcttttggaaataaagacaaaaacatttaatactaaacatatgatttctgaggtctgcttcaatattataaaattggacatgatttgataattatagaagctgagtgataagtacttggcagttcattatgctatattctctagttttgtataatgtttaaaatgcagaaaaagttgttaaaatcccaacactttccaaaacgctcactcaggacaataagaggacaagtggaacacagtgacttttggaataaaaaccatgagtctgaatttgggaagtcccttttttgccacacagatcctgcttatggaaccaaatatatcaaactgttttccctttagctaggacaaacttcagtctacttatcctaaccataaacatataatgaaaatattctggcaactccaccctgacatttcagcagcaataaataaattataaatcaccctagaaaggtacaagcctcaactaaggccaggtttatatctatttaagaaaaaaaaaatttggtgttcctcaatccacaatgaacaaataactcaaaataactgaagtcattaaaaaacaaaaacaataatgaattatgaaataagtgtaagtccaaatttataattttcccatgattaatacttaagtgcatgcatgtctacatatccatacacataaaagcacatgtattattttcttctgctagcattgatggaattgttaacacctgcttggtctacctgctgggtaatccagcactaagcccaactacatttacagtaggaatttaggaggcaggaagggaggaaaataacgatgtgattccaaagaaattctaccctcataccaaccacagtgacccctgaagtatttgtagaatactttctttcctgagaataagcctccctcatcaaacttctcatcttcagacattgtcctacttagcaaaggacatgttgacctttactccccttctctacctcaaatgcatcaataattcaattagtattactgatacctgctgggacttttctctgagcttcttctgtgaactgtgtcccagtcactgtgtactggtaaatgtttaacaactggttctctgaaaataaagccctgattttcagtgtttgccagtttccacggtgtatatatatatatatccatgatggccagtttcaagttatcagcataaggatactgaaatgcagagttgggaagtcatgtgtataaacaacacccatagcctgtataagttggctttagcacaacgctgagatgcctggtttgctaggataatcccagcctatatctgtggtcctagcataattaatggtacccctaccactctttaaaagtgttaatgaaatattacatgatcaccccaaagaataaatcactttgggaccctttctcaaagtaaaaaccttccacaaaaaaggataagaccttccataaaaggtaagaagatctgattatctccttagtcaaatgtacactaacttcctagtatggaacaccctaaaaacattaacagccctttaatttttttttttaaatcaaacataggtagttgggagagtatgaatagtaaacaggttccactaatgttcaagtactgactcacacacagggtttagtgatttctggagctattacagcatctgagtgaagaaatcaagccacacagctggcttcaggttacactctagcttaaagtcacatgaaaccaaatatcacatgcagagtctagcacagtgcctagcccaaataaattaaaaactggttagtccctgtaggtttaatgggaatcattaaatctcagagttcaaggcaacccaggtcaatacttacttgatctcctttatgactaccccaagaagtcatcctccaatcttgcttaaatacttgtcagcaacccaatacaacctgcactgggtcacatgggtagaatctggcaggcaagaatattggtcttggttcttcaaagaggagaacccaaaaaaagagtcaagataagatagctatctttaaatacctcgtgagctgttatgtagaagatgaattagatatactgaattgtcaaggaccatggggtagaagttatagggagacagattttgagttagtataaggaagaacatctaacaccaccacagtaataatagctaacatttattgagtgcttacattttgctggaagcctcaccatactgctaactcatgttaagcttgaagtcaacgaatctattgctctctctggtcgcccctgaccatctaccttgggctataaaagagttgtttgtccagaagccccagagggatccaagtaactggctgcccaggctagctacaattcagaagttcatacaggtccagtctgtcctgagcctctatctaaagtccttgcaccctcagattcagtgtaggatcaaggccaagagtactagaatgtacatgtgctggtgctgaaggcaagcacctggaaatattcatctcattcatcatctgccaaaggaagattccagagtcttgcacatatttgcaaggtcattttttcaattcttggagaatgggttaaaaaaatgacccaagaacttgatgtagttcttctgaattctgaagtcttgttcaattcatgtggcttttatgaaggaaaagtactcacttttctcatccttctcatctcctttgcatataactgcctcactcaagggctgagatatcaaacagttaagatcaaaagaggacacttcttttttaaaaaataaccatgtcctgacacaagattagcaatcaaataaattccacagtcctcttattcactaatttgccagcatcactctcagacagggtatgctaaacttggtgaggcaatctatgataatcaggtcaagacttatgacacaagccatgtgtcctgcttctagaaacatcagagggtattagggaagcttccattgaggaggtgatatccgatcaggttggggaatactctgaaatccaatctccgaaagattcccagtcagggcaagatgagtttgtggaaatcctggtatttcagagtcttggaagcctctgtaattaaataacagcaatgatattaatattaaatgtctacatggttgatcatttagcaaatatatatatatatatagagagagagagagataaaatgtcctctattaatataaataagactggtattaatagtgtcttagtccattttgtgctgctataacagaacacttcagactgggtaatttgtaatgaacagaaatttatcgggctcacaattctagaggctagtaaggccaagattggggggctgcatatggcaaggaccttcctgctgcatcatcccatgatagaagcataaaagggcaaaagagcatgtgtgcacaagagagcaaaagagtgaactcacagcctcaaacccttttataatggcattaatcattcatggggatggtgccctcatgacctaaatgcctcccattaggcctcatctcccaacactgttacactggggattttcaacacgtgctttctgggggacacatttaaaccacagcattccaccctggctccccaaattcatgttcttctcacataaaagacacattcatgtcatgcaatagccccaaaagtcataactttccagcatcagctcagaagttcaatgtacacagtctcatctgaatcagatatggatgagattcaaggcaggattcatcttgagggacacttccctctagctgtaagcctgtgaaatcaaacaagttacttacttccaaaatacaatggtggaataggcaaaggatagacattcccattccaaaagacacaaataggcaagaagaaagggatagtcttaagtcaatccaaaacccaacagggcaaacaacactaaatcttaaggctccagagtaatcttccttgactccacatcctaccatctgggaacactggagcagcagttgggcccccaaggcctcaggtaggcaggcctacccctacagctttgtttggtgctacccatgcagcagctctcacaggttggtgtcaggtgcctgtggctctcctggctagtatttcatgctggtaggtctagagttctggggtgttggtgtgagcccactccttaggctttactaggcattgctctaggagactctctgcggtagctcctaccctaaagttatgccacacactgccctagtaagggccctctgggttgctccacccttgcaacacgtgtctgcctgggccatcaggctgtctatgacattctttggaatctagctggagaaagccatgcatccacagttattattattattattattattatttttaatttttattttttttgagatggagttggagtgcaggttggcttgcagtggcgcgatctcagctcactgcaggctcggccccccggggtgcacgccattctcctgcctcatattattattttttgagatggagtcttactctgtcacccaggctggagtgcagtggtgcgatcttggctcactgcaacctccacctcgtgggttcaagcgattctgctgcctcagcctcccgagtagctgggactacaggcgcatgccaccatgcctggctaattttttgtatttttagtagagacggtgtttcacagtgttagccaggatggtctcgatctcctgacctcgtgatccgcctgccttggcctcccaaagtgctgggattacaggcatgagccaccgcacccagcctgcctccacaagtcgtgtactctgcatgtctgtagacttaacaccacatggatgccaccaagatttgctgcttgcacattccaaagctgtggcctgagccacaccagagcacccctcttttttttttttgagacagagtctctccctgtcgcccaggctacagtgcagtggcgcgatctcgactcactgcaagctccgcctcccgggttcatgccattctcctgcctcagcctcccgagtacctgggactacaggcgcccgccaccacgcctggctattttgtatttttagtagagacggggttccaccgtgttagccaggatggtctcgatctcctgaccttctgatccaccagcctcggcctcccaaagtgctgggattacaggcgtcagccaccgcacccggcccacctgagcaccgttgagccacaggtggggtgagcaagaagcactgtaatgaaatgtggcaagcagagacttcaggcagccctgagaagtgaactccaagatccagagggcacactagttctctcttttgatatacagtcatacgtcacttaatgacgggtattttcagagaaaagaagtgtcattaggcaattctgtcattgtgcaaacagcatagagtgtacttacacaaccctagacgctatagcctactacagacctaggctatatggtaaaccctattgttcctaagctgtaaacctgtacagcatgttactgtgcttagtactataggcaattgtaacaatggttagtatttgtgtatctaaacatacctaaacatagaaaaggtacagtaaaagtacagtctaaaagacaaaacgtggcatacctgtatagggcacatacaagagcttccaggactgacagttgctctgggtgagtgagtggtgagtaaatgtgaaggcctaggacatcactgtacacactgtagactttacaaacattgttcacttaggctactctaaatttataaaaagaaatttatttcttcagtaatcaattatacttagcttactataacagttttactttataaactttctaattttaaaaattttttgactcttgtaataacacttggcttaaaacacaaacatattgtataggtgtacaaaaatattttctttatattctcattctacaagcttttttctatttttaaaattttttagtttttttttttactttttaaacttatttgttaaaaacaaagatgcaaacacacacattaacctaggtctacacaaagtcagggtcatcaatatcacggtcttccacacccacatcttgtcccactagaaggtattatgtattatacataattgtgtgtgctatatttttatatgactagcagccagtaggtttataccatcatcatcaaaaacagatgagcaacacattgagttatgatgttcaatggttatgataccactgggcaataagaatttttcagttccattataatcttataggactacctttgtatatgtgctccttccttggtgaaaaggtctatatgtggggcatgactgtatttccttctccgaggtcatggcaccctgtgcctgtgatgggagggacagcaccagtaatttccaaaatgccttcagagtcattcttccattgtcctaatgaacagcctctggcttccttctatccctactgatctccttatcaactggttgcttgcccacacccttggtcttctctcctgaaaatgttctttcattctctaccacatggccaggatgagaatccttcaaatccctaaattctgtttcctttttaattataaattttatctttaagtcatttctctcttattttcctgtatgcagttaatattttgcttagaaatttcttccatcaaatatcgtagtttattgctcttacattctgccttccataaagcctagggtgtagacacaattcaaccaaattccttgccacttcataacaaggctggtccttactccactttccaataccttattcctcttttccatctgagatctcatcagaattgcctttattgctcttatttctaccaacattctcatcaccatcacataagtaatctctaaggagatttagacttttactacagctctcctcctcttctcagccttcaccagaaccacatttaatgctctgttcatagcaacataggcttttcatagcaacataggcttttcatagcctgcttccccacattcttccagcctctacctgttacccagttccaaaaccgctttcacattttcaggtatttgttatagcaacagccccatttctcagtaccagttttctgtctttgtccagtttgtgttgctataatagaatacctgtgactgggtaattaataatgaacagaaatttatttggcttacagttctggaggctgagaagtccaagatcgagggactgcatctggtgaaggccttcttgctgcatcatcccatggcagaaaggcaaaagagcatgcttgagaaagggcaagagattgaacttgcagcctcaagtccttttacaattggcattaacccatacatgagggtgaagccctcatgacctaaacatcccccattaagccccaccttctaacactgttgcattggagattacatttccaacacatgagttctgggggacacattcaaaccgtggtaaatagtaagatatcttttactatgcatgtactagggtccaggcatggtactatacttgatatacattttccacattgggttcttactacaactgataagatggccaccattatctctattcaacagtgagccttgaggaagttaagaatctcacctaaggcttcattgctagtaagtaggaaatgcggacctgaatccaggcctggtggcaacaaagctctttacaccacagaaccctacccacacttgcttcatggaacccactagggccctgcccagcaaagtcaaaatcttaaatagttttaccctgagtcctgagccctcagtttcctcatttgtaaaaggaagagaatgacagcccctatctcacaggctgctgggagtatttgatgagagaatccatgtgtctaacttagtgcctagcacatagtaagtgctcctcaatgttggccactgttacctccacagacacatggatgagcattttgccaaaggtgtacagattacatggacctatcttttccgaaagttttacagaacacacttttttttcccaacataaataataggcttattgtgatagaaaacaaagccagttggcaaggaagatagacttgggttacaattttggccctgtcattcactgataacaggtctttggacaggttgctttacttctttgagcctctctttgcccatctttaaaatagagagtaggagtgggaactgcatgcttttgtaaaagcacatacagaacaatggacacagagatgtcactcaataatagctactttcattactgggtaaatcgaagctactgtcatgactttttccaccttctttcctaacaacagagaaatctgttagaggttcaggtcattgttttgatgtaattctctttaaataatatttctttgcccctttgaatcatctactactctcaaatgtactctcaaggagagaatacacacacacacacacacacacaaacacacacacgattacccaacaactctaggcatttaaaaggtgtcataaattaagtaaagagataccaagcttgacagctgcactatctagagaaaaggtctacttagaaattctgtatgccacagtggatacactaaatacttgtcatcccaaggtcccaagatgaatactggcttacctattaaacctaaagcatatgtagttaaatatattagaagtcaagccctgattaattttcatgataattggctcatacttaacatatatacacacaaaatattaaaatgcaggctatcccacacagacaaaacagcctgtcagttaaaaccaatacttatttgtttcccctacttattctgtctccaaaaccatgaaaggtttttagtcacttgttaaatgtctcacatatcaagaaccaacaacactgttcctgtctttggtcaccatgccaaataaaatatgctttgtattatattaatgttgaaactcacttactggtcttttggaggaaaagcagtgtttgtatgcttaatagaatcctgatccttaaccagttggacactggacacttgggccttaaattattaatcatcaattcaaatgtgtattgtacaattcatagcttaattgacaaacttgggaatttgaccacactctagaaggtagcaatactagagtgtgctcctgctttcccttttagtcttttgtttttgaacttgcaatgtctcttatccatgtagaagtattgattatgttaaaattaattgttaaaaatactgtatgcatccatactctatgcagatacaaccagaaaattttccttatttatcttttttatactggtttttctaattagcccaattcaagggtaatgtaaagtccaagttccaaagctaaacatcccaatatttaggaaattaaagccttatactttcacaatgatggctaaaactggtaacagatttggggtttttcagtctgtacccaccagtatgctacctgcataatgaactctcactcattttctgctatctggatgatttgagaagtcagaacctccgaccagaaggctgactgcatgcatctactcattattcctgcctgttgccacacataaggtagcacatgcccttgagcccttcagatgatactcacatacaaaaaattagctgggcgtggtggtgggcgcctgtagtcccagctacttgggaggctgaggcaggagaatggcgtgaagccaggaggcggagcttgcagtgagccaagatcgtgccactgcactccagcctcggcgacagagcgagaatccgtctcaaaataaataaataaataaataaataaataaataaataaataaaataaaaaaaaatcagcacaaggcaaaaaagtccattcacaattaaatgttaaatcagtggcacagcagataactagtatcatctagtaggaagaactgtcagctctgaagtgtcatagaattctgaaggtacaggaaacagcacttggagatcacctagcctagctccagcagttcaagatgtgacttggtaacttggttaagatcacactgctgctaagtagcagaggtgggtaaagtacctaaggaaacctgatagtaagtagatagtctaagaaaagccttccaagaataagtagagtgaggtgatggcactttagatgaaaagagtggacaacattctcctttcctggtttagcaaaattaacctgccactggtctgacttttagattgtaggatggtgaatagtctcggcactgagaggtcagattaaaatttgttaaataatctaaaaatactgatctgttttattccatccatcattttcaaacatgaagtattttaatgtgtattgtcctttacctacaatactacaaaatagaaacacacctatccacacatgcattccaggtgcatttacaagtgttaacactggctatcttaacacacatcttgttgggacagaggccaaactgttgtaactgaccaggaggaaataattatgtgtctagcttgatgcttcgccaccagcacacactaaagtttgcgtttaaagcacacaactactctttgcaaaaatcgttcctgtaaaatctgtcagtcatcagcaaataggaataagcttagagtatgtaaatactcacagagtacctaaatattcctcttagagtacctaattcctcttagagtaactaaatatcaactgattggacaatattctttttataaagatatgtgaatgtcaataggcaaggcacaaagatattaagttaagccatttttaactaagaaattttggtagtgaaaaggccagatgtgactcctaggaacatgtaaaatttatttcagacatgattgttcaaatctgagagaagaaaacatggtaaataatgtaaatccaattttgacgaaccgttttttaaaaattataagtaacaatcgtggtcatgaaacttaaaacaactaggatttttattctgtaagaaacataaaccactttaatttctgatacaaagcacacaggcagatagttacattttcttgtattttaaaataatttctgtgggtttgcaagcacaagttaaggctcaggttagtttttctctgtcttcaagatattcctagagggtgtattttcaattcctcagaagttatttcaagaggtgttatatcctcaattaaacatagaagattaagctagaagctccctttcattatattttagctattttcattgcaaactctagtacaatctgtcaatgtagataagagaaataactgaagtatagcttcaaaataagtgaaacaggtttataaatcacaggtaatcaatattaagtcctgacttttaaaatattaatactaatgaaagtcattttctaacaagtatcaaaaacaaaagcaaataaaaattcaggtgctagattacaaccttacaccttacaactgtagccaaatctgctgtttggctttaaagttccacacaaaatcttaacctacaaatttaacatttcaaacccacaaaatacaagtaccagagtcacccacagtcatgtcaaagggctttccaaggtcttagaaaccttaatccaatacagaaaagctaagagtcaaaaagacatagaaacagggaaaagtgaaggtgttatttgccaaacattaaactttcacagaaatccaaaacctacttaacaatttccctatatcgaacagcataacctctatgcaaatgcagtcatttattagcatttactgtacttactttgctttttgccatttataagcttcattaaagacacccacaaagaagtaaccagttgaatgagcttcagtcaagaaaaaccagctgtaaactcgacctacaaatttacatcccacagcgtcctgtggggaaggtacactttacaaactaccattatatatacaagctttagattgtgaaataatgcacttcggctttctccggtgtacattacaattacaaaccctcaactcaacctcccccttcgttgaaaaaaaaaatccacctccaatcctcattggtccacatagttccggcccacatggtatcagtgggtgtgtccctcccaaaaaaccctctcattggccgtgaagaaacagcttctaataggctgtgattttggggggtagttaaactccacgcctccagacttgcgctctccaatagacccgagacgctgctggctactctgtgattcaaagggcaggcaaccccagtaggacgcgctcagagaagcgagaggggtgagaaaggagagagcaccctcggtgtgccgcccactttatcctcactcctggaccccagcaaatgttcacacacctgcgttttcccagccaccaattagaagggcggacagagcgttcgcttattatatatccttgacctagggacccgctcaagcttcgtgtccaatcctcgttctactgatagaagcgagcaaagggcaggctcaggcaaagacctgtagtgcttgatgtcccctaggaaaagaatcagtcccgggaacctactctgtgcagtccctcgaccgcagacgcgggggcgcacggggcgtgctgcggcgcctgcctcagccgctcccagtcccgggccccgcacgctgcgtctgccttgcgcccgcgctcccctcccagcgggacttacgcggcctgttctttctccccgagtccatcctcctccgcagccggcatttcttggccggggagtcatgctgagggagcagtggctgcggctgcagctccggcaggagcgggaggcgctggggcgccgcgtcgctgccgcccactggaccccggctgcagacgtgcggcggctggactggcggcggatggaagccgttgtgcagcagcccgttcacagcggcggcgctggtgcccacgggggcccctggagagtgcgggaccgagcgctcctgctgcccgctgcggtcgcccatgccgggggctggcggggctgtgcgcgggccccggctcaggcggcctcgctggaggtcattctccggcgtctttatttccccggatcctccctgcggcttccgattcagcagccgcagagccggcgcctggggatggcgaacccggcgctcctcccctcctcctgccgactcccccacctcctctgcgccctgccccccgcgcgccggccccacggcgccggcctggagcacgccagccccgggcgcggaatcggggatccccgcgcacccccagccggggctcccgccgcccgccttcccctgatccccaggccgcgcgacttcaaacgcggcttcctcgcctcccagactggtccccgccactgagcatgcccagtcctgcccgccaccgccaccgacgagtttcaacatggggaatcaagttctctgggcttgcagagaggagatgggcgggttgggctttgtatggcgatgtgaaaaccagatgggtctgggagagacagcgaaaggagcgaaccgtttcaggaggaatacgggaggaagacaattatttgcagaggtgtcaggtttgctaatcctgtccccagtgagcaagatacctttgcaaggtcattcacgttaccctccccgctttgtgagtgtgtgcttacgcgcgcgcgcgtgtgtgcctgtgcgtttggttaagtgaccaaactacttagaggcctgaggggagggagaacaattatttatagaaaagttggcagacttggggagggaggggagtgaaatttctttgctggcacgcacacacactcaaacaccatgtggtctcatggagttgtcttttgcagggaggaaacctaggaatacagtgtaaggacagtgaaggacaaaactgtaggcaggattaatcggtgctgaaagagatcaagtaaacaggagcaattccatgctataaaaagcactttcctcacccagaaaggacttcaaaagacaatgtcatgttatttatagagtaaggagttgcctcttctaagaagggaaggcggcatcacgtggtgaccagcactacgagctttggagttagcactgggttcaaattccaactcagccactgagcaaacccagataacgttaatgctcaaggtaacacttctagcaataggaaacgggactgtccatgctcactatgcaggactaatttgggtggtgaataccttcccaaagttatgcaatctcttgaggcctcactttcctatccataatggggctgttgtgagaaaatctactaaaagtacctggtacaatcctggcacacagtaaatgctcagaaagctagttttccttattacgctattatgattagcagttcaccctttgtttcgacaggggaacaaaccatgcttacagccgtatttattgtgtgatttattttgtgatattctccgtgatttgcaattaatctacagaggagtcagagtctggcaggtgctggctggctactgggttgctgggcccctgggcttcagtgcattcagcagcatctagggcttgcatctggcaattccttccagcagagccttacctagaatcagagcttgagaaccatgggggccactggagcactctggtctatccactcttgcatacttttttcgtatcaggaaactgagctgcagacagatggctgaggttattaagagcaaaggtgggactaaactccaaatctcaactctcttagcttccctaaccttatgctatttaaagacagagaaaaaaacccaggtgatctggcccctccctacctctcctgcctcatcaggggctccctgtgctgccttcaattccttaaacaacattctgctgtttccattgccttagagaagtctcttctctaagacctcttttgtctactagactccaactttagatctcctctttaacttctcatatttagagaaatgttccctgacccttagggctacattaggtctccctgccataccctcttcctactccttgtactctgtttatgactccttatcattttgtaactataccatgcatctgttccctcatttgtaacttgagaataataggacatcactgagttgttagactgatgaaatgcataacacatgcgtaaaattaattcaaacttcaagctattggaacttttttgtgagacttgagagaaatgtggctatgcagctacaacttctgctttttttttttttttttttaagacaaggtctcactccttcacccaggctggagtgcagtggcacagtcgtagcttactgtagcctccaactcctgggctcaagcgatcctcccaccttggcctcccaaagtattggaattataggaatgagccaccatgcctgggcttgccttttttccttgtaaataattaggaagaccgagcagggccagagatactaatcccttggatcactgcctctcctcacagagtaataatcttccttggaatgcagcagtctgcaaccaatcaaatcgctgtggcatatgcattggtcttgtatggaaaatgtaattctgctggaacttctccatctctgccagtataagtgaaatcttaacttctccactttggagcactgatcccactcatttggagttagtgtttccaggtggctatcctcaagctttgcactcaaacttcatacttaatcatgttctctaaatctcattatttaaggttaacatatgtaaagtgtccagcacattgtaagtgctagaaaaagacattattattatttgattgcccatcttaccccacttcactgtaagcatctttaaggcagatgacttgttcatcactctatccctaggaggcacttggtaattatttgtgactggataaatgacttatatcaagcttgtctagcctgtggcccacagcctgcatgcggctcaggacggctttgaatacggcccaacacaaattcataaacatgagatttatttttgtgacttttttttttttagctcattagctatcattagtgttagtgtattttatgtgtggcccaagacaattcttcctcttccagtgtggctcatggaagccaaaagattggacacccctgacttagatgatatttcacacagagtccccctcactttctactgtaaatttgctaaaaatcaccagccactcctaaatattcaaatatatcattttcaaattcccacataattgagctgagtggcttaggaagcaaattacatcagagatgcaaatagaagctttagcattgcaatatctccaaggacatattttttctagctggattcccaggcctgctgaggaaggcctgagccaggtggctcagacccaggcagggcaaaagtactggtactgggacagaacgtcctccacctgcttcctttctcctacccttgtcaggctgggtgcttggatcagttacacccagcgtatggtagggaagaagccaggtggcatctcacaggtttattcaggggtgtgtgtaggaggtgtaactttgaggcgtgagctgtcatgtcctccaggaggggcatgcaacaaatgtttggaagagagtgagggagaagggaacccacaaaccagtgcactcccttgggtcttattcatttatttaataatcatttattgtgtgtactatgttgtaggcactaaagcatgctgggaatacaaagacaaaatagatggcttcactgccctcaaagggcttacaattcagtagagagagaaaagtcagtgattctccagcatcagtgttatgtaagaataacctagggaatttttcctttttaaatttgtattaaaactaacatacatacagaaaagtatgcatatcttataaagctcaaggtattttgcaaaaaatgaacatgcagtgtaacttgcaacccaggatattttgtaagcacagattctgggtccagttcccatagactgattcatcagtaggtgatgatgatgataacgaagatgataataaatatttttaaaattaaaaaaataactttttcaaaaacaggggatttgatgcagatgatcatcatggcttggagaaacaatgaaggaagcaaagtatgccatctatgctgcgggaggtaactccagaagaccccagagagtgagcaatgacagagtcaggggtgggggtttatgggggagtggtgctgaggtggaagctaaaacaggtttcagggaggaaatgacccttaaactgaattttgaataatattggcctttcttcaggtgaatagggagggaaggtttaaaagaatctactcagaactgaaggagccaagactctgtgggtgcatttgaaacaacctggcatttttgggaaactgccaggagttccacaaggctgaagagcagcctgagaagggagaaggtgagcagtaatggctgaaaagtttatgtaaccaaccaacaggctcattttacctgctgcccagatacagccgatttatcaagacaggggaattgcaaaagagaaagagttaattcatgcagagccagctgaacaggagactggggttttattactcaaatcagtcaccctgaaaattcagaggctgtggtttttcaaggatagtttggcagtccagggaatggagtgctgctgattggctggggatgcaatcataggagtgtggaaaatggtccttctgcatatgtgctgagtctgcctctgggaggggccacaggatgggttggcaggtccacgtggagccactggttgtcaaaaatgcaaaaccctgaaaagacatctcaaaaggccaatcttaggttctacaatagtaatgttatctgcaggagtatttgtgaaagttgtaaatcttgtgacttctggaataatgactagtaatcatttatgtctacactttagcagaattcaggcttctcttatctgcctaacctataaagatggtttagttttggggaagggctactatcatttaaactataaactaaacgtctcccaaagttagcttggctcaagcccaggaatgattaaagacagtttggagggtaaaggcaagatggcagttggttagatcagatctctttcactatcataattttctcactgttatatttcttgcaaaggtggtttcaattgaataggatccaaatctcaaatggctttctatcccataggaacgagtttggacttttaactgagggccattggaaactactgaagagttttaggcagcataagaactactagattttcattgtgggaggatcctcagcagcagcctcagaaaggagattggggaaggagatccctagtcagggagaccaagaagactactggaaaaaaacaggtaagaagtgataagggactgagtgaaggacacagcagttggaataagagcactgggtggattcaagaattattttagaatctataggacttggtcaatgggagggtaagggagaggtgtggctgggctgatttctatgtttccaggtcgtgcagctggggatgtggtttcaacatgcagatctaagcatatccccattccatcctgagctgcatcactcccaggctgggttgggtgcctctctggtgtaagccatatcactctttgcctatctcagtctaatactacacttaacacgtttcattgcaatttttttggcaggggaatcctcaaggacctgcaaacaagaaaccaaatccccccactccccccagccaaaatgtgttcattttgaccagctgtgtgtgtgttttaaattaaaagtttgaattagaaagcaagtaggataaatttatatacttagatgtataaatttaaatacctggcccctgaagcacttctgataggtctcagctacccaaacaagaagaacggaatctttgaatccccaggactcaacgcagtactggacacaaaatgggagctgaaaaagtgtgtgtggagtcagtgaaggatgcaatttcccctcattgtagagatgaagaagctgaggctgcagagtagaataggagcagacagtggggattgtcttcaaagtaggttcctagttcctggctcagaggtcccagtttttgttgaccatggacagtaaaactccctggggaagcgggcccagtctcaggagagcagttttgattggtctaagtttgtgattgacttaggaactgtctggccaatgaaatatgagggaaagcctgggggattctgggaaaggttttgtaaaccaaaaagtatttgagacatgtctcaattttagaggattattttgccaaggttaaggaccattgcccatacagcctcaggaggccctgagaacatatacccaaggtggttggggtacagcttcattttatacattttagggagtcagaagttacaggcaaagacataaatcaatacatgcaaggtatacattggtttggcccagagaggtggaacatctagaagcaggagcttccaggtcataagtggattcaaagatttcctgattggcagtttgttgacagagttaagctccgccccaagagttgatgtcagcttaaattaaggtaagggggtgctttgtggaaaccaacgttcttatcatgtatatgaagcctccaggcttcagcgagaatagatgtgaatgtcttttattggaccttaaaaattgtcagactttctggaaaagacctaataagggaatctttacagaacataattttttcacccacaagtgacagcttggcagggccgtttcaaaatatgtaaagaaatataatttgaggtaaaataatttgatttccttcagggcccactggctgtcacgtgatgttataccagagtcagattggaatctgttgtcttactgctaccaagattttgtcttgacagtcttaagattcctgttttaatgtcagttctggtcagttgtgtctaaactcaaaaggaaggagggtataatgaggcatgtttcaccccctctttcccatcatggcctgaactagtttttcaggtgtttttttgaatccctttggccaagggggatccattcagtcagctgaggggcttagaattttatttttggtttatagtttcctcttgattaaagaaggaagtctgcaatgtgggtttgtaacctagtttttaataactttacatcagacttgtaatttattgttactttctgaagacacactgataaaacctctctaccatgacgtcattgcatgttttcacggtagaaattctaattatttgctaaagtgaaaataaagtcaaacatgcctaagtctttatctgcttaaccacattagctatggtgtgatcatggaaaaagggcacacatcaagacatagttttaaaagaattattagaatgttgactaccagaataatattgacccaggatgaacttctttttttattttttcatttctgcttttttgttattggtgtttataacttcctcagagattcaccatggggttacctcatacaagagactaccttcaggtacagattttcatcaccatactttctgtaggtgcccctggcagtcagaggttaccacaaacaaaaagtactttggtgagtagtgttatagtgagattctgataactcattcatcagagcctctcacttaagtacgaagataagtaccagagttacaatcttgagcaaaagcaaagtccctgtcttcatctgtgttacagaaaagacaggccttaagcacacactcaccaaaaaagcaaagacattagtgcatacttcaaaatgcataaaatataagaccccctagtgccatgagagtacataccaggctgacctggcctaaatataagtttcatcagaggaagtggtatttaaactgagttctgaatattgaatagaagttaattaaggttggagtagatgtagaagaggtattcacagtgtatctcatatcataaatatggtaggtaattcataaatacttgttgattgaaagaatgaattgaacctatccccccagtagggcaaatcaagtgtaaggaaaattattcactggaacaaaccattggagaaagtttaggccagtttgtctaatcatcagtctttcacaataatttgttacagaccagaggctccccatgtaataaaaattaacatggagccaagcagattcctcagacaaggcttttatctggtgtttgtgcttgagtgcaagggagacagcagaggcacaaggaccttctggtgactctctgaaaaagagctggtagggattttttatgagacaaagtgctggaattgacaataggggtaagatatgcaggctgggctggacaaagcatgtgaggggtagggtatgtagcatagcgcgttgctatgtttttcttgagtaatgggccaactggttatctgggagcagcaaagagggtttaaatcagattttcggcattccttcccaggtaggacactctgcaaccttggtttgattttggatcccccaaagccagtttctgaaattctgtaagtaaaagacatggttaaacattatgagagcaaagaagaatggctgtgttctttgtgtgactaaagccttggagttagcaggtatagcatcagtgaggtagtggtgtgggttttgtggtcagtgggaatgtatgaaagaatgctctactgggggcaagctgaagccaagcccagttcttgcgctttctcaaattgaccacatgagagtaatccctttctctttacgattctttctctctcgtgatggagtactttcttcaaacacatacccaagatactcttgttgtctatttttttttttcgttttattttggtcaacaaagaggggaaaatatagcatcagcagctgccactaccagtaataactgtgtgtgcaggagtgaaacgcaccccacgtgaataaacttcctgttaggcactaatattttttgagcacctactaattatgatatggagggggatggtgcatggctgcctagaaatttgataggctgtaatcagaatgaccccaagtattggacataatttcaagaatggagctgagtttagcaaaattataacagtcatattatctaacatgtattaaatcctcatgtgccatatactgtcctaagcacactataaatatcatttttttaaaataagtatcacaatagccatgtgaattgggtactattattatcctcatattccagattagggaactggagcttatagaggctcattagcttatccaagttcacacagtggataatagtgtcactgacatttgaacacaggtctggatggctccagaacttactgtggtataaaacaaaatatatttggtctttgtcccaattcctgtcagagatcctgaaacactcaaaatttcccggagtgtggggaaaaaaaggagtgttttgttattcataatggcctctttttatcatacctgactttatgctaataagttgacttgtggtgggccccctgtgatagactcaggatagggccagacatcagaaaaatcaagtgattagggaattagagggttggaaatttcagcctcacccaccaacctccaggaaaggggtgggggctagagattaagctctctagaactcttgaataatgcaatttaatgaactcccaggttgctgaacacataaaggtgctgggagggtagtcgcccatccatgccttgctctatgtatgtattagttcattcttgcattgctataaggaaacacttgagactgggtaatttataaaggaaagagttttaattggttcatggttctgcaggctttacaggaagcatggtgctggcatctgctcggcatctggggaggcctgaggaagctttcaatcatggcagaaggtgaagggggctcaggcacatcatggcaacagcaggagcaagcaggagagagagaattgggagggaggtgctacaaacttttaaatgaccagatctcacgagaactcactgtcatgaagacagcactaaaccatgagggatccgcccccaggatacaaacacctcccatcaggccccatctccagcactggggattacaattcaagatgagatttgggcagggacaaatatcctaactgtatcaagatatcccttcatcaggttgttcatctgtatcctttgtaatatcctttgtaatcaactggtaaatgtaagtaaagtatttctctaagttccgtgagctctcctagcaaattactgaacccaaggtgaggagtcatgggaaccttaatatatagctggtgatatggtttggctttgtgtcctcacccaaatctcatgtcaaattgtaatccccagtgttggtggaggggcctggtgagaggtggttggatcatggggtcagtttctaatggtttaggatcatccccctagtgctgcttgtttaaaagtatgtagcacctcccctgcaacctgccagccatgtgaagctatgcctgcttccccttcactttttgccatggttgtaaatttcctgaggcctccctagaagcagaagcctcagaaccatgagctgattaagcctctttttaaaataaattactcagtc

SEQ ID NO: 1304 - DNA, 71056 bp, Homo sapiens
tcccttggggtctctcgtgaggttactgtcagatggtggtacagccacagaagtggctccataccacatggctggctgtgccaagcacttagcggtctcccccaacaccgtgatgtcgggttggagggactactggtttgagatagaaagtgggacgaatgctaaaactccattttaaccctgccaccacagcaccaaaaagcacatctttcagcatgctttgtggaagaaggattgcatgtttatggcaattaaagattgcaacacttttgattcccataaaactgtgtctggttacacctctgactgaacacaagggggggctatcctctgaaatagcagaaacctaactttctgtgtgcaatgacagccagagcttattcctcaggtaccacctgccataaatatacaagtccctttacctaacaaagacacagtgatattgggggttcaggccaccactagtggagggggaggagactaacctttggctcaaccttcagtggaagcagatgtgcttgaagctatttgggcaacagagttcaaggatttgacctgtgtcaacatgggagagggaaagattatagcgggacacttttggcaagctctggaaggagacgaattatggaacatgcgcaaatagagaccgatgcacagaaaagctaataacattcaggctcagggctccttccttgcatgagtcccatggcagattgtattttccaagatggcagccacaagactccagccacatgtactcttcttacaggatgaggccaatagtcctcccatggaaaggtggggtctatatgtccttccctagaatctggggagacttgtgactctcatgcagatgatgctggagtatttccaggctagactgtaaaggagaaataacttctgcctgattctgttggaagccagttgcaggcttctaggaagcccagacacatggagaagttctgagtgttttggccgatagtcacagatgagattccagcaacagctgggatcacccatgagatgtgcgtgaggaaggctttgagatggtttcagccctagccaccactgacctaagagaccacaagaaagagaatcacctggccaaacccagcagaccttcagaattcagaaataaaataattcgtcttattttaagccactgtgttttggtttgattcatcccatagcaaaagacaacttcaacaggccctttctgaggctctggaggggccctggcaatgtatccatttggtcatttgcttttgtcaaaagcagacattttagctgtaattggctaaaattctgatctctttctgccctcatgttgggtggtggtggagtggatgtgggcattttgaggatccagcaaaagaagaattgagttgagtcattgagtttgggttccatgggatttatttatgtggtatggagtcatttctgtgtatgttattgctagctgtccctgtgtaaaacagatttcagaatagtcttcacctcccttgtgctgacttacctagaggtgtaatgtaaatatgcaagaccatagattacatcacgattgtgtcacaagacatgtgcgtttgcaggaacatggatggagctggaggccattattcttagcaaactaacacaggaacagaaaaccaaatatcgcatgttctcacttataagtaggagctaaatgatgagaacacatggacacgtcgaggggaacaacacacactggggcctatcagaggttggaggatgggaagagagagagcgtcaggaaaaataactaatgagtactaggtttaatacctgggtgatgaaataatctgcacaacaaacccccatgacacatgtttacctatgtaacaaccctgcacttttatccctgaacttaaaataaaagttgaataagaaaaatagaaatgtacaaagctagaaaagagtgtagctcatcccatctgggaattaaaccaaatcttacagctcatacataaaaatagtttgataaagattttcctaagtgtgccaagaatcctgaaaactaatcttccattatcgatcatgagctatgaagccagaagaaaaatttaaatctatcaataataaaatactagagccaaaatagtttattattctcttctctcatagaatatgatattacaacattattgaagaggcaatcaaagcatacacaggcaaaaatgttggtaaaggagtattacagcaataggtcaggaatttgtttaattaaaattgctattttactgagttttatatatatttagtggtagcagtagccagagtagactttgctggagtctgggccattgagattggtattattaaggttatgttggcctcatttgctcttaccttctggcatacacaggatacatctcacttgatttctcacaagtctttggtacccatgaccactcccacctttttacaattttcacttttgctggcttctctggactcacgctgtcaattttcccctctggctaactgttctcagtcatctctacagaattctctccttctgggtctttatgttgttgaggactttatcctagggcttctttttctctctctgagcaagcttgtccacccccattgcttcaatcccacctatctgctgacaactgctgattccacatctccagctcagacctctttcctaggctctacaccaggaattggcaaactttttctgtaaagcgatgataacaaatattttatcagcttgctgctcattgtactgtctctgtcacatctgctcaactctgctaaggtagtgcaaatatagccacagaaaatggtaaaagaatgggtgtggccatgttccaataaacttgatttataaaaataagcctgcttcatgggctataatttgccaactcctgttctaaaccagaatattcaactcccttctggaaatttccacttgggttttctcaagttcctaaacataacattgtccccaggcaatttcatcttattccctcctatgtgttccttcttaatgaatgatccactatccaccagatgtccaagacagaaattcaggcagcatacttgatttcattccccacattcagtcagtcacaaaatcatgtcaattctactttctcaacatccccctaatccattcttttttctctttctccactgccttctttcaccccctctcatctctcacctcctatgacctcctcactacactgcaatcagagagatcaagccacccttggattttaaaagccttcagtaacagtagtccctgcctttctttggctgaagtctaaacttcttgaaacagagtgagaagcctgcacaattggaccatttccccatgttagccaaattcctctcatctgcctgctcctcccgcctctgggaccctgcacatatatttcttctgcttaaagaatgtgtagcaggtgaagcaactatctgaggccagtatcccatgggcagtaagaagaatttaccaagacagttgtagataaagaaaggcagatttattaaagaaagcatgaaaatatgttgcaaggcagcaaggggcaggccagcaagagaggagctgaatgccaagagacaaaggcttgctgggggttttataggatgttgcttgtgctgcgtgctgaagagggcttagtgcagtactgataacaccaaggttgcagtgggataacctgcatttttctatcagctgagggcctggtgatagctgggcacaggaagattgtgagttatttgtgcaggagggctatggtcctggaccatgaagaaaggcaaacttatagcttatctgctttctctttcttttttcctcagtgtcaccagcctgattccttttgcctaattaggacttcacagaattattctcctttctcatccttccagctgtcttctaagtctcaacttggatgtcacttcctctgggaaatgtctcctcacctctcaagactgtctctctgtgcaccactacagcaaatgggacctgggccacttcacttttacaattccagtttacagacctgcattgccccaaccccgttagaccaaagactccctgagggcaaagatggcctcttatttactcttgattccctagcacccagcacagcactaagcattgtacccactgaaagaacatctgaaggatgagcgtttatagcaaaagtggtttccactgacgttcccttctctcttccccaactttggattgaggagcccaggagctggtcaggtggcaagataagatgagaacggagaagtcattacttggggcctctgttttgctggtgttttgctggtgtgtggagatggtgggtttcccttgaatacctgggaggcaggagcaggcatgaactactccagcctctgggttctggatccacatggggtgctgctgctctctggcacccatcagtccttaaccatctggtctccagccagggaaggagcgtggtggtggagaagcctctctgtcccacccactcatcccaggagctcacgagaatcagccaaagtccgagttctgcaccctgagttaggaactctataactttagactttccctgagctttgggagttctcttaactagtgtgaaagcagttacatcatcctgggtcctcctaaaatagacacatgtatccaaatataggcacatgtattgcaaacataacatgtatgtatatatgtaaatatatacatataatttttgttttgaattaagtataaacacaacaagttacaaatatagtactgagaggtccttgtatggccccgcctccctcaggcagtatcttacataactatagttcatgattacaactggaaagttgccattggcaccacatcagaaactagtctgcagaccttgctcagatttcaccaggttttttgtgcactcatttgctttcctgaaaatattttaatgtttttctacatgacttatctccccgacatactgtgagataaggtttttttttctccgaataagcttagagaacaatgaatgtgagaggtgggaaggatgatttggtgcatctctgttttatccatggtgagtctggacctcagagcagaaggaccctcgtctctcctctggggagtcctggtgccaactcagtgcaggctgctaagttatccgggtctgactgtcttcttctctgctaaaatttgtcttaagcatgtaacacagccatgcttattaatgatgaggagacagccaatgaaaattaattttttcaaagatgaatagatatctagattttttcaagcacaactcatttaagaaaatatcacctcactgagccccaaatgagttaggtctcacttagaaagtgtcccctagtgccaggtaaagtgcctcatatttgcaatcccagcacttctggagacggagataggaggatctcatgagcccaggagttcaagaccagcctgggtaacatggcaaaaccctgtctctacagaaaatacaaaaaaaaaaaaaatagctgggcgtggtggcgtgcacctgtggtcccagctactctggagtctgaggtgggagaatcgcttgaatccaggaggttaaggctacagtgagctgtgtttgcaccaccgcactccagcctgggtgacagagccagcctctgtttccaaaaaaaaaaaagaaagaaaggaaaagaaaatgcccccgagttgattacattttaaccactgtgctaacttgagagatagtctgctatctctttacaggacatgagggctgataatcacctcattgcatggtcctggggactgatgaacaaaggctaacatgtggaaaagggcaactaaagaaagaagagccacctccaggttaattagtacaagtctcctcgctggtatgccctaatacactaaaacagcagtaaaaacaatctgcacattggcatcgaaggcacagataaacttgccgaggacccttaccacggcagagggatgctttatatgagtccttagtagattaattaagttcttgctagttccatttggaaatgatgctgtcctcttggggctatgcagagaagttcatgttgatgaaatgagctgtcctagaatggcagttcccgggcagcagagcctgggctcaaggaaggttgaaagaaggggtggcgtggagctgccaggtgcaaatgtcaggccagcaatgcagtccagcttgcatggacgtgcttcgcctaggaagttgtgacttggctgcattttccacttcaggtgagatggaaggttgaactctacctcacctcctggtgaggttgatgtttcctggtgtttataactttctttgtaaatacttgaaaggaatttaccattttaatgctggaagagacgtctattccttcttaagaggacctgagtggatcttgattgcaggccttatgctgggcagagctaaggagaattcaatttgtctccaatcttatttgaatgttctttttttttttttttttttttttttttttgagacagagtcttgctctctcacccaggctggagtgcaatggcacgatctcggctcactgcaacctctgcctgctgggttcaagcaattctcccacctcagcctccccagtatctgggacgacaggagcatgccaccatgccctgctaatttttggtatttttagtagagatggggtttcaccatgctggccaggctggtctcaaactcctgacctcgtgatccacctgccttggcctcccaaagtactgggattacaggcatgagccaccgcgcccagcctatttgaacgttcctatgcctgctacaagtgcagcagcagaatctccacacatcttgcgtgcgaaagtttcctgtagttcctttagcatagagaggctggggaaggttagagactgacttgtactctttagacatatagttgatcattgaacaacacacgtctgaactgttacacacagatttttttcaataaatgtgttagaaaatgttttggagttttgcaacaatttgaaaaaactcaaagacaaaccatccagctagaaatatcaacaaaaatagaaaaagttaagtatgtcatgaatgcataaaatatatgtagatacctagtctattttattctttactaccataaaatataacaaaactattgcaaaagttaaaatttagtaaaaattgtgtacacactcacagatcgtatatggtgctattctcagttgagagaagtgtatacaaacatcaagatgcagtattaaattgtaactgcataaatttaaccgtagtgcataccacactatggtaataatttcatatcctcctcctgttgctgttgcaatgagcaaaggtgttgcgagtatccacttaaaacgttctgtgatactcaacattccatcatgagcagttcatccccagtgaattgcgcatcacagtaaaaagtgctctctccctgttcgcatgtatttttcgtcctgtttcgtgctgtactgtaaaccttgaataacaccatgggatccaatatgaagtggcactagtgatgctggaagtgctcccaagaagcagagaaaagtcatgacatttgacattacaagaaaaactggatttgcttgatatgtaacagagactgaggtctgtagctggggttgcttccatttcagacagatgattcatcttgtaaacaggtggtgtaaacttactgtatggaaaaatacataacagtaccacagatgtattttctccttacgaacatttccttttctctagcttactttattgtaagaatacagtatatcatacatataacatacaaaatacatgttattaactgttgctggtcaacagcaggctgttagtagttaagtttttgagagtcagagttatacctggattttctactgtgtatggtcagtgtgccaacccctgaaattgatcaagggtcaactgtaatcctaaaagaatctaatacaatattgtaaacagtaagtggtcaataaataaggaattgaactaataagaatacataaatcccagaatatgtgcaacctgatcatagtacacagagatctctctatatatctcttttcttagttcatgctgttctttcaggtagaaagcgccttattttgaattagttgtctttagagcaaaaatccctccaagagtgctgtgtggtttcctatgcacaacctggaatagtccattgcttcatgcctaccctggacatgaagggccatgccgcagcggaagtctctatgcacccacccccgtctatacctgagcaacacattcctctttgctgctctcttacaggctacagagtgcggtggcgccagcacagagctctgctcaacgtccctctgtgctttcacgatgctgatggattatgaaggtagggaagaatgtacagccaggaggccattaggagggcaactaatttataaaatcacatttgtagaatttaatgcatccaacaactaccaggggaaaggtgggcaaaagctataccaacaccacccaagtcaaaaccaaaacaacaggaaaagaaaattatgtggatgtagaatttctgataacatcattcccaaggtgccttatccaagaggaactgctacaataatattttaagtggaaataaatacatgctggaagcattatatattagtagagtatttttttttcccagagtactttctcaagcacatcaacatgagccccctaagagacatttcacattaaaaataaaatgtctgcccactgctggtttctcaatctgcctccaccttctgtcccctttaatgaactgggccatgaggtgagtcagagaggataaagggagtggtaagaatttgaggagagaagagagtgaggctaaaataggaaatcaggaaaagcgattcggtccccctgtccctcacatggggccaccctcttgttgcccagtgtggcttcttcttgagggttctgcatggttcctcaatcccagggaattccgcaggacattccacccaagaccattgggctcccacctctactcttttgccagttaatgaataggcaggaatttcactgcctggaaagaggaacaatgctttctggtccttatttcacatctaaaatagagaggtcaattgatttattcctaaatatctttgaacactaaaatagaagttttacagcatatatactacctggttgctctagacttaagccagggaaaagtacagattcaacatttaaaattgagatagacgctttccacttaatgctaccagtcttgctttatttcatgagaatgagaatataataatatggcatacgttcatttgggggaaagattgatgtcttataacataatttataattacagaaaacatgtgagttcactgggaataaataaattttgaagataataagatactttcacttatgtcgtaatttctatgtcatttggtgtaggatgtagagatattaacgtttacacctaacttaagtttgtcatctaagacctgaaggggttttgtctatcagctgcacccctgggtagagacacaaccttggggaaggcctcagccccatccctcgtacagcaggaatgagaacagccctgcctgttgggaagcttgagggaggctatggacgtgcagcgcttggcagagggtctcgtcatggaaggttccagcaaatgtgagatacttttatgatttcattttctccaaaagaaagggaataagagaagaggggaggaaataagactaattgcgagagataaagtacaagggtgagggaaggaataaggagacatgacggcagcgtggagcagccgaggggggagattgctttcaccacttcccagcatctattgcagattccaccctcaaacatgttgtaaggactctttattcaaggtaatgtttgaaccctgctgagccagtggcatgggtctctgagagaatcattaacttaatttgactatctggtttgtggatgcgtttactctcatgtaagtcaacaacatcctgggattgggacccactttctgggcactgctggccagtcccaaaatggaacataaggaagtggttcttctacttcttttatttctgaaatcaggtaagacatagtttttttaaattataagaattattttttctcccacaatgtagtaaaaatacatatgccatggctttatgtgcaattcatttaatttttgattcatgaaacttccagttgaaaatcttgtataagattgaggaattcttcaagaaataagtttaagtttcctgtgaagattgtcagggtgctggaatgaatgggcagagaaaataatgggtgatttttcaaatctaaatgagtgcacccacataatggccagtctaattgaaaaagagccaatgtagctaattatgcaaaggacggctaagctctttgcctggttctcagtttgactaatttatatcatctctgttacggtgtcatgctcccctcacttgcaagttaaaacagtgaaatatctctttgaatatattccgttctctcaccagttcatggtggcggcagggtcggggactcagcatttctccctttgttatggcctgaggaaggctttccatcagtatacgtttgcctcttatccccggaaaaatcacacgcatccatttgccagatgctgtgtgcagatagtgatcaacaaatactcagttgcttgggttaggtccctacatttttacacatacatacatacctgtgtgtgaatgtgagtgtgagtgtgtatcctttacaaatactagcttatttagctcgtggtataggtagggtagcatattcatcctcattttataaacaaagaaatcagacttaggaatatcatgttatttgctcagtgaccaaattctcagatctgggaaataaagaaaactggatttaagccaggtttcccagaaggaatctagggctcttctcacttttcagctttgtttaagcctttgaaagaatattctaaacatgtcctagtacttctttttctttaaaaaaaaaaaagctttattgagatataattaacatatagaattcacccatttaggcatacaatccaatggatttcaagatattgagagttgtgcagccaccatcagaataaattttaaaactattcatacccccaaaaacgcactccactctccttagctgttacccccaatctgcagcttctggcaaccactaatctactttctgtatttatatctttgccattttgaacatttcatacaaacggaatcatacgatttgctagtagttcttcatgtaaataatgtacgcttgaaattcaatctataaattaccagataaaattttacaagttgcactttagagtcaaatacatttgaatttagtggaagccattcaaggagctatcaaagaaaatacagagcaggagaaaattaaagaaatttttgtaagaaattggtgtatgttggggggtatgaatattatatttcaatgcatggaaactaggacatagatcactatgaacttattcagtgggctacacccaaaggctagatcaaacttctctgccacaggattaacatatgttttaacccacctggtgggcacattctctcataagctcttttggaaagccaggttttctgtggatgtatcatctttccagtgtgctgcaatgcccggggagagggaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagatttgtttgatgtttccttgccagcaaataagccctatcaaatcctattgccatatgagtcctagaggtgaataagagaagaaaaaatgggggaaaattatttcaaactgaaaagagaaaagtttgattctgttttgggatatttcctagggacatgagctggggaggggatctcagcagcgatgcgctatgaagcatagtaacataacacagagaacttaattgaagggggaaataaatggaagttttctttttttgaatatcagttgtagcctgctctgctatacttcaaaaaaactcttcagaaagtttaactgaactcactgtaggacacactttgtggatttattgtgtgttttgaagtcacactgtgagctatatagaattaaccaaaacacaactcttcttgaaaatgagagttcaagttggcagaaagtgcggggtaaagacatggatatgggcctaaagcatctatttctttgtgatcttttgatatatctctcaagtgctttttagtggattagctttagaatgcatcagccaactcctgctcaataatccatttttccagcccggaatgtcttaaattgaggaaggacaaagtcccagaggtggggagcagggggactttggccgaggactttgcatgaatcgatgagcatgcatccacctccctgtcctgccccttgtgctctgtgtaccctcaggaggtcaggacaggcctttctgagaatgaaaatctgttcatttgctttcctactggatacttgtcatcagcatacaaaccaatgcgctctgcagtgtgtcatctttcagaacctcccctgaccgcatgttccctggagggctcgctgtcttcagagccaggcttgtctcctgctgcagcctccactgctctcctagtcactctgtaacccaccccctctgcctgcggcccccaccacgcccctcaaagtggtcaaggttgtcctgttgtctaattccatggagcttgcctgtcttcattttattagcctcttttggcctctcacccttgtgcaaatcactagcattctgtgccaaggacggagctggcatctccaggcttggaatagagctaccaaagctcagccagatgtctggaagagcctcaggacaaggggacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggtcctgcttttttacaatttcctccgaaatccagatacctgtcaacaccttggaaaaactgacttctccccaattagtagtgttgtgtgactgtcataagcccagtacaaaaatggccttctttgttggggagcttcttaccctccagtgttttgcccaatttttgtccaaggtggcaacataatttagttcagttcttgtttatttccaccatcatctatgcaccaaaatttatgtttctcaaggagggaccattcagaggatgcttcccaccggttcaagtgacagtgccagaaccaaagcgcatattgtaggaaatcaaacaatggcctccaagttccatttctacccagggatgaacaaatcaacatcaatcttggtaacacaactgccactgatggtgccttactcttctctcatgacatggcacaatcaatagcaaacataaaatttgttcttgtttaaggatttatatccactaatatggtaacatagtagtggttccatagttctaacctgtttgtcaatccagttaatcttttactatcttgcaatctgctaatgaaactgtttttctttgttttataatttcaacttttagagtcaggggtacatgtgcaggtgtgttacataactaaattgcgtgacactgagctttggggtacaaatgatcccatcacccaggtagtgagctaaatacctactaaataggtagtttttcagcccttgccttgctccctctctcccttctctggtagtccccagtgtctttagttgccatctttatttatgtccaaatgcccgactgtgtgttcttaactaaacattttgattcatagctacccattctacttccagtaaacagaaagttttatttggttaatgctaaccaaatagattaaaaggaagtcatgacaattagacattgacattgatttactgaccatttattccacttggatctcccacctctaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcaggtatttccattgtcgttgcacctacgcaggaatctgtaattcagatggcaagtaatttactcacaaatttattaatgatttaagaggaaagagaaatttatggagccagagtttggaactatatttgctcacagtatgtgaagccatactaacagcttcttgttaaggtttattggagtctttgttagaaaaataccctcaaaggaagttatttgtttttacaccggacacaaacattagcagttattgttctgagctccagttttcaacatcatcatcagtaaatgtttgttgaggatcaggtgaatgaaagtgtcctagatagatctgagcaatgacttatagctacaagatccagtgcctgccctttagtatttaaggtgtagtcaaagaaactggatataatgttaaaaaaaaaaaaaagacagcccaagtgaggtacaggcataatcaatgcatgctctacccagatccagaagaaagaacagtgcctaaggttgaggcagctagagaaggctcagggaggaggtgggaactgagctgggtttggagttgagagagctcttgacaagcaccaggaaggcaggggaagatgcggccctgcaccttctgagggggaccattaagagatgaagttgactaaagcagagactttgtgtaggtgacgggcttgggaaggtagctatggaatccagactgagcacccatagcaggaccacgggatggagatgggaggggtcaggggccagggtggggtggaatgtggagcagaggttcaggggaactgatcagagttgggaggtcatggagacggactatcttggcgaatgggttcaaagcaaccagagttgcttctttccaacccaaaaacaaaaattaagaagatgagtgaagaagaagtaaagcagttgaaacaggaagaaagggaaaattatgagggagggaaggtaagggcagataagatttgctgccacgttggtgtattttgttcagtacttcatcgatgccatgcccaaataactgaaagaggcagcaattctgagctctctggtccctcaagatattcaatgatctttagcatgtctcacttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgtagttttatttgaaaagaaaggtgagtacattttcttcctcctcctcctactgtcctccccatcctcccactcttcctctttctctattctatctttaatttataagaccagaggaggaaggcactatcgtgttataaaactgaattctgagttaggacaggatttgattactaactaaccatgtcagcttgagtgtattacttcacctcttagatttaattttttttgttcaaaagatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggatgaagccttgtaaaacagaaatactgaggtgttttaatcctcagaaacatttagattgggacacaaatcttatttttactcttaaatttttcacattttgggggacatggtctatatttttctcagatttctgaaatgttgtcttttaaaaatgtgtaaaagttacagttccttttctatagtttattttaaaatgtgggtcaatagtcccactgcttagaataagaggcagacaggatttcaatagaaattgcatgcctttttagatgtgcaaatgtttcattaagcatttcccatcaagtatatcccatcaagtatgctcccattaagcatatcccatcaagtataaatatttgaagggatgcatgacactttaaaaactgtttcctctactgtgttggtagccaggtattaagactgttaatagtaacaatttagctctccaaacattctgcatcccaggtgttaaagaggactggaaacaccttagttcttgtattcttgaggatgatttgccatattgtgtctagtattacggcaaaactctaagtagcattttaaatagtatttatttgggttggaattatttctatgcattgactcatcttcctgggtttcattagctgtacgcattgtacttccttccttaccactatttatctcgaattcttgagattaaagtgcagattaaatctaaactttatctggtgaagttattagttcttacaagtagcaagcaaacggtaaactaaataggatcacctaattgtaccagattttaaaaaaaaaaaaccctgattctcctgattctctctacaaaatgctaacatttaaatatgtcatttgtaaattgttaaccagaaggaacatgggaatgactgtaggttgagtttgaagtctgaagtttgaaggcttagtttgcttgttttcaaagtgacagaagggagcaaaaggttatataaactctgatgggtacatacaaaaaaaaaagaagtgaaaagtcaaaagtcagtcattttttggtccttgtttctttgctgtgggatattgacctgctactaacttacctgccagggttttgccaggaacagtcagtgttagatcacatttacttctgccacttgccaccagccacactgccttcaccaagtccaagaccctatcaccactggttggggctacttgtagctgtacacatgatctctaagaaatgtaacttccctgtttaaagcccttcctagtgcccttaaaataagacccaaagacttcccaaatgtgctagggcccagcattatttaagtaacccccagctgctgtttgcttggcttgctaaacttttctacactggccttacttctgttccttcaccaccccaagcacacaccctcctgcctgggaccctcttcacctttgtcctgctgtgccagctccttcttatctcctaggtgtcagctcaatcatcatgtcctttgcaaatcttccttgacccctagacctccctttcacaaagtaccttgagtttacacttttgatgagtgtcttatgtctactgtaatactatgtcccaatgaagatgtacttgcaatcataatacgcagtattgggttaaaagcattagtttgctgtaggtatgttaggagcactttccccatgtgattgatcaattaattaaaaaatggctaaagtgggtaaccttaaatgatggtgtaaatataccttaaacattttatattttcattgaaaacacaagtgtacttgacaccttttgacgtagagcagaggcttttcttcttcgaatatggggtcaccagtagaaggtctctggtgtatttcctgcataaactatgctccagtgcaacatctacaataattactttccttatttttgaagtggaccatatctcgacatttattaatcaatctgaatgtgtaaaacctttagatttttatgaattcctcctcaagctttatagtcaactatatgagtggattgccctctgtggatttgatagcaattttttaaatgattcatgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaatgactcgttgtaagcacataactcacgtggggggaacagacatgggtgggcacactagcaaacacctgccagctgcatgtggacccaggtgggcaccggactgttttaaacacaggagagggcccgttgtctaactggtgagttggttgagtggaagctggttgagaacttttactgcaaaccatttacagtagaccacaattttatagccctgtttggcactttttcatatcactgggagcctgaagaaatagaagtgggttggatctctttcagcctctgaaaagcctgccattcccccatctaaaaagccctttccccattctctcactctgtctcatcatgtatgtaatatgtatcatcattaagtgatctcattttatattgtttccttgaatatttcctgtaacccccctgcctgattccactagaatgtaagctccatgacggccaagcctctggctgcactgtgccccgtgtgtccccagcatcctggtggggctcgatacacagagagctcataagtagcatttgaatacatgaatcaaagaatggctcagtttactgcagcctttttgcagatgcaaaagatgatcttttagaaagcagaaacagggggtctggtgcatgagatctttttctcaacgtgactatgctgtgcagaccttcatgtggtgtcttgtgaaagactttgaccactgtgtggacttcccttcagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaggttagaactctcatcacatgttcgactcaaattgtggagcaaaagagtaaataagatataaaaatgaaaatgaagatacgtgaaattcaaatgttgcaacttgcctattatttattttagtgcatttttttgtacttttcccagtttggtgttaggtggcattaagttctcagtaatgacgcttatcaaataggaacttagtgcttgttactcacctttatccattcccccaacactcaacaaattgcctttgctatatccctatgagatgagcagatcaaatattccccgtgagttaatgaaaactgattcaaccaaatggcaaagtcagagactatcgggggccatggagacactctgggccatttttatgaggtagtctaggctcatctttatgagggaactgaggtctcggggggtgggggttatcccaaataggttcacagaagaaccagaaataaaacctgcctttctagactgtaagtcttgtgattttcatctaaatggttgtctctatacagcaactcatctctagaactgaaaataagcttaaatccctcctccatccccaataattcaagctgcatttcagagaaaaccaggactttggaatcagacagatcaactttgaattcttgatctgcttcttcatagctatttacacttaggcaagttttgttttgttttgttttacgttgccactcagttttctcatctgtaaaatagggataataacaccttcctcaaatggttttattaggactaaaagagagaatgtgtggaaagatgttagtggaattcctggcagatagttcacatggacaaaatggtattaactacaaaaatttttacagagaaaacggtaactgacaaaagcaggtgtttggaatgaattaagaccatggcagccttttgaggcctttatatttctcctgactgtgcaataaaaatattttggctctctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttcttttccatcctccccagattctcacctgctacacacccctcagagggactggaggagaactactgcaggaatccagacaacgatccgcaggggccctggtgctatactactgatccagaaaagagatatgactactgcgacattcttgagtgtgaaggtcaggagtggttctagaaaatgttttcatttctgcccttcacctgtaaaataatttgttgtaaagccccttcccacagggatgttattaataattgagtaacgtattcacctctcggaaagaagcaaaaccccagaattaacctgaattttttttttttctgagacagagttttgctctcgttgcccaggctagagtgcaaccgtgcaatctcggctcaccacaacctccgcctccgggttcaagagattctgctacctcagcctcccaagtagctgggattacaggcatgtgccaccatgcctggctaattttatatttttagtagagacagggtttctccacgtaggtcaggctggtcttgaactctcgacctcaggtgatccgcctgcctcagcctctcaaagtgctgggattacaggcatgagccaccatgcccagcagacctgaattatttttattaaaatgttacatcaacatgtacaaatataaaactacatctaaactctaagtacaaacttcttatgcttacaactcttacacagtgttaaccccaagacaggtttgcaattaaatagttaaaataaaacaacaaaatcaataaaaatcaaataaacaatatatatttaatgtggtagactttgctgttttgctgaagctaagcaaggaaccagtttttaaatcagcaatccattatttgaatggactgagcaatttaatagtgcacctcaaaggtcaatgctaaaaaattttaaaaaaatcctactgaaaaaactgtcatcgtttcacatttctggctacattagtgcaaaagggaataaataaaggtgagatttgtgtgacagtgtggatatggtactgtgtgacaactcagttctcccatcacttccacctgttcgaatcacggggatcctttatttgtacaccatgttataggtatttgcccttaagcaccaccaatgcatcactgttatattaagtctgcccgttttccttagtactccataaaatttaagtcacatattactctgcctcaccatgttacttcaataattctgaatcaaagtttaagtttgtgaataattttgcaaaaaagagccaatcatgcttctcaacaacataaaaagagaagcgctgtcacttcaggtgaatattgttctccctgaggccatgagcataaacaaaaactccagactaaaaccctgagacggtgccaggtcattcagcagtcagcggaatgatcagaataatttcatacaaagttttaaagatcattattgaaatgaagatgccaaatattgaaaactcctaatggagaacgtagactcctgggaatatatgcacccttggctccccactggcctgtgcatcccggtctaaggacatggcatcatggaaattctgaacttggtcatgactacaatagttgagggagtattgactaaaatatgtgaatgttacggtttaaaaggaaaatgacatttggattatgctagaaaatcctgagtccttattgccaattttattgccaagtgcctgttgtgaattacatcggaatgagaggcaagtcgcacttaagtgagtaggattctggtttttactctctattttgcttcatccatttcagttttcttcttcctctctgtccttccttcccactctgtccagaggaatgtatgcattgcagtggagaaaactatgacggcaaaatttccaagaccatgtctggactggaatgccaggcctgggactctcagagcccacacgctcatggatacattccttccaagtaagtctcactgggaaaaacattccatgtttaattaaggctctgcagctctatcagacatttgctgtcatttagatattttagcattcctcaagaagtgaacgcctgatgtttttaatttcaaagctaacctcctcccacaatattgcaagtgaaatacgcattcttgctgctcaaaatatggtccacgggtcagcagcagggatgttttctgagagtttgttagaaatccagaatgtcacaccctctgaatctgatttgaataataaccagatcctcagctgatgtgcacacacattcaaacactaatgtcagtaatgaatacattaacatctgtcttcagaaatgcacacacacatgttgctggtgtattttccaaatattttccttttctctttactccttgtctttcttttccctttgtaccaatgagattcaagtctcctaacctttgacctatgagcagacgtcatggatttttgaatccctgatgttttatgtatatttacatcaatgtgtttttctggaatgaggattcgtaacttccatcagattctctaaggggaccacgaatttaaaataagaataagcttcttgctctagaaagtcatgatggttcctagaataaggtttcgtgagtattctatttcacattaattgtgctggaaaacacctcccattccacagtcgcttctggtcttcctcttcattctatgatgactacagggccataccagggctttcaagaatgcagaagtgaggctgagccacagattccacggtggaaagcagctctattgaatttgtacacctcccattccaaatagctagcttaaaacacagcagctgccattttccttcaaaggagaaatacaggaaagacctaagggtccaaaactgggtaaaggcacttccaggaaaccagaaggagaagaggattgcttaagccgctgctggctcctctttccatcctggtaagcatttacaatcagagagggaatgaataaacgcagagggccaccaggcatggagtgcatccaacagccctggccactgggccccactgaggaaggatccagccccatactgcatggtgagacccttgcaagagcacagcttctcctcttggtttttctaagcttcaaggctggtgggagcagagcctggtagaccagaaggaccattcctttaagctatgaagatgcacatttcttggctctgttaggtactagatgagtatctttaggcagggagcactttacattttaaagactgctatcatttgtggttgaataactggaatttgcttacatcaattttccagatggccaaaatgataaggtcactgattctgttgagtgatttttacacatgtaaactgttagaaaaacagtgcttggcagccgggcatggtggcacatgcctgtagtcctagttacctaaagggctgaagcgggaggattgcttgagtgagttcaaggagttcaaggcaagcctgggcaataagtgggaccctgtctctaaaaacaaacaaaaaaaagaaagtccttggaatacagggccaaccttgtttccttgttgccatctctgaacacagccttcatctgattacctcctccatgcccgactgtgcctagcacacagcaggtgctcaatgtttgctcttgaaaaagagtcttatccatgaatgtaaatgttcagtgctactaaaatctttcttgtccattcagatttccaaacaagaacctgaagaagaattactgtcgtaaccccgatagggagctgcggccttggtgtttcaccaccgaccccaacaagcgctgggaactttgtgacatcccccgctgcagtgagtatgatgcacacccagattccaggatttggacctgccctgttcttgaaatcaaaagaaaacatgtgtcagtgcctgagtgcagcctctgaaaagtgacctacaagtcctatgggatgttattggtctttattttattgctggtttaaaacagttatggttattggttactgtgggtgattgatcagagcgtccatttatcatgtttttctttctttgcaactgaaacttctgcctcaggagttcactgaaatgtaggctttaggtgttgttcatcctattctctctgtgctaaagggaaatcagacccatgctctctgacacatggatttcattttcaaccagagttctaatagttgttttgtaaacaaagagtgtctttgtttacaatgttcaggtctgtgggtgtccagtttttccaccttggggagcagagggtgagtggtgggggtggggaagagttcaagaggagaagatgaaatggcagacctagtagaaatgatgtggagtaaacaattttatcatattttcctctctgagaatttgaagcaaaggattacacactaagagaaatacaggcatgaaaggttaaaaaggattcagtgagggttggcctcccctcctttcctctgacatgtgtcctttgaaagcggaagttcctcaggcattctccctttttatgaatattaatttctctttttttttcagtttctctttttgtcatcttttttcctcaagaatatcttgatttctggatgcacacacttttccttggaggtgttttttgccttctttccatggactctttccctgttgtttggcttttatggcatgttgggtgccattcagtcatgtctactcagtgaataatttattcttcaggaaagagagtggacctttggtgtatgtgagaattcggggtgtgaggtgacacgtgttgatacttaccaggtaggaagaactgagcaaagagaacatagaaagaagcacctacccaagggtctttctctgaaggagttccttgtgaaagggtctcacaggcatagatgctactaaattgatttcatctgaaaacatgaaacaattctcaagtgccaaattccaagagaggctgagcaaaagccaagacaggccagaacaccctgcagccatcctccttaacatccatctgtgcattctctattttaaaattattcattgtagggctgggcacggtggctcacgcctgtaatcccagcacttccggaggccgaggtgggcggatcacgaggtcaggagttcaagaccaacctggccaatatgatgaaaccccacctctactaaaaatacaaaaaaattagccagttgtggtgacacgcacctgtagtctgagctactcgggaggctgaggcaggagaatgacttgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaagtaagtcccctccggtctcattctgctgctatggaatgtgaaatcccattgactttgccttagttttagttactgtaggaacgcaggataaagtattctggaagaaaaactgatctagtcataagtaaaggaaatgaactttagcacgttttttcccgtaacggttgttctcaaagcgtggttccctagacttttttctttttggaaagctaaactcacaatcacttctttttcagaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacaggtaagcaagggtatgggagcttactgagggcccaagttttctccttatttttgtataccagtggcatcatcacaatatacagtagctttgtaagtttaatgctattgtggtcagaaagcctgcccttatgatttcagtttttttagatttgttgaggtttgttttatggttcagaatatagccatcttggtgaatgtttcatgtgctcttgaaaagaatgtgtcttctgcggttgttgggtggggtgttccctcaaggtcatttaggtgaagttggttgctggtgttcttctgtatccttactgattgtctgtctcctccttcattgactactgtggatgaatggtgatgtgtccaactttaactgtaaattagtctatttctcttttagatcgtaactcttttgtatattttgaagctcttttgttaggcacatatgtatttaggatggttatgtcttctagatgaaaggacccctttatctttatgtaatgtttcttcttatctctgggaatatttcttcttctgaagttctgaactctctttatggtgatataaatacagtctcacagctctattttcactagtatttgtgtgatatatcttttaaatttgtatgatatatcttttaaatttatctgagcttttaaattgagatgttcaaaccatttgcattcatgcaattgttaatagagttgaatttacatctaccatcaagttagttatttctctttgtcccatttaaactttgttccttttttcatctttttctgccttcatttagattgagtttatctccactactcacttagtaaattaatttttaatggttttagtattttccacaatgtttataatatacatttttgacttttcacattccaccttcaaatgatatcattctacttgacatatgaatccttacatcattgcagttctacttcctccctcccaaaatgctatactattactctttgtaatagaagcttacttctactatgtcacagatctcacaatacattgacactatttttgccctaatagttgtgttttaaagtgatcaagaataaaactattttaaatattttctttatttatttattttaccatttctggtgcttctcatctactggggtagatctcaatttccatctggtgtcagtttctttctgtgaaaaacaacttttagcattttttgtagcacaggtctgctactgctgaagtctttcagattttgagtgtctgaaaaagtattttgccttcagtttttaaaagtaattttgctgaatgtagatactgggttgagagtttcatcacttgcaacactttaatgatgatgttccattatcttctgttttaaatagtttgactagtaatctgatctttgttcctatgttttcaataggtcatttttctctgactacctttaagattttctcatctttgtttttcaacagttcgactatgatgtgtttattattaatttctttgtgtttaatctgcttgaggtattctgagttcctagatttgtagattgttgatttttttcttttctcttttttcttttcttttctttttttttttttttttttttttttttgagatggagcctcactctgtcacccaggctggagtgcagtggcgcaatctcggctcactgcaaactccacctcccaggttcaagtgattctcctgcttcagcctcctgaggagctgggactacaagcatgtgccaccaggcccagctaatttttgtatttttggtagagacagagtttcgccatgttggccagactggtctcaaacttctgacctcagacggtccatcaccttggccttccaaagtgctgacagtacaggtgtgagcaaccgtgcccagcctagattgttgattttcattgtccttgtaaaattcatagccattatctgttcaaacgtttctttttgcacttttctctctctgtattttccttttgggactctaagtaccacgtgtttgggattctaagtacccacaacattcatgttgtttcataaatcttgtaagcttgttctctttttttttcagtaactctttttcattctttgtgttggtttggataagttctggtaacctatttccaagtttatggattattttttcagttgtttctagtcatctcctcagcccattgagagaattcttcatctctgatattatgactttttttctagcattttcatgttactcttttctatagtttccatctttgctgaaattctctacctatctatgcatactgtccaccgttacaacaagatcctttaacatactaatgtaggtatcacacaatcccaatctgatagtttccagatggcgtcttctctaagtctggctctctggattgctttattattcaacagtggctttttgttcccccttgggttttttggtgtgtcttataattctttaatcaaacactagacattataaatagaagaacagtagaggttacagtaaatattatttatactttgaaatggacacccttgtcttgcaaatatatatcgtggataattgagtcaatgtagtcactagtttaactgaattgggatttgtgattgctagttttaccttaagtgcaccacagatataaattcctccagtgatgtgctgctgctatcttttacttagagtggggcctggggtgctaaagagttttctccgtgttcctatccattcccagatttcagcagtcactgcatgcctgcactacagaggagatatcttcatacacataatctaaccccattgacactcggctgtttcttgttactgaatgctcactttttggtggacgtaggagaatacttatctccctggtctacctccctcttaggccagttgagcacagctcggctttgaaagtagtgatttttcagtgttcttgtgcctccttctgatggaacttgtacctgtggtgggtttggaaagaaagagtagtaggcttctgcttcattgcaatgcaggatgttgggcacaagaggattccctgtaacttctccaagggaataagatttttgcctccaccactctctgagaagctgtggatctttgcctgcagtcctagatgcaggaccatctcctgccctatcacccagaagctttggtctttggctttgtttgaggaaggagctagagaaatgtgcaaagctttcatgtctgccccccactgacagccactcaccacccacagcctgcactgccgaatgcatcctcctctcatctgccctcgtgttctcatgaacactcagtagggacccataaaaaagagcttgcatgtaagtgcaatttccaattataagtactctatctgttctttcacacccaggttttaaatgaaatattactaggaacttattaatgttctaaaatgctataaatctatttttatgttaatctgtctgctaatacagaaaagagaacagtcataattctcagaggctaccgtactgtttttgtcataaattgcttcatgcttcttttttttcagtaattgttaagcttgatttcttttattttaatttcagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgcgtatgtctttgatttttactgtaagaggggcatcagccaactgaaatttctgttaaaagagccatgcttcatgcttcaagccaacttcctaggaccaaatttctcttagacccagaatgtgtagaaaaatgtctcaagaatcttgcttttgaagaaagggcctgcgagaagagaaattttaggctggctatttttcctgagtagttttatggatgcaggaggacatctggaggtgatgaggtcacattaattgaaagctcaggagtacatatgagcaaatgcttagaaacagtaccattccacaatgcccactaaatatcagtgcaatatttctaccatagaaatctatcattttaacctccaacccctgaaatgaaggttgaatttgctatttttgtcttgggtcacaagtaaatatactttatatatataagtatgaatatatatacacacatatatatgtatacatatgtgtgcatatataaatacacacatatatgagatatacaagtatacatatatagtgtgtatatatatgtacacatatatgtgtgtatatatatgtacacatatatgtgtgtatattagaatatatataacataaatatgtatatatatatattctgacctgtataaacacagtggatcctgagcaccagtggcctgaaaggatatgggttgctgggacatgaagaacaaaagcaggatacgcagatgctgaacagcgaaagaggccattagatgaacagaaaaccaggtctaacaaggacagcttttcttccataaatgagtacacaatatatggaaaaaactatttttacatattggagaacagataaactgagataatttagaaagggaatcaaatgagatcaacccaataactaccttggctttgttcctggagacttcctgggctgaagaacaaggagatggagcccaagccgaccacagcagtcttgctgaactgaggaaggagactggagttgggattactaaaacagctgagattttctaggctaggtaataacatgaaaggaaacattgtggaggaaagcagctccaggaatgtccatagaaaagtcctcaagtctttggctaaatagaaagctgcatatgcacagggagaggttccagagagaaaataggataaagaacagctactggggaaagaaaaactgcaggggaacagtgagctcaatggagatgccagagctcacatagcactgggggatatttgagttctgaccagcctgaggagagacctcgctgaacatcttgggcattcagtagtcaccacataaagccaaactttgggagtaggattagtgtattcctataataaaggccactccagaaacagcatagtaaagctgaaaagcaagtctaaaaaaatcaacacgatctccaagtaaattaactgattgccagaagaaaattcaaccctttagaggcaaacaacaaaatcaagttgctcagttatgtggcatccacaatgtgtgacctaaatttataactttaccagacatacaaaaagcatttactgtgatccataaccaggagaaaaagcactcaaaacaaataaaccccaaaatgaagaaattggcaagaagatttgaaatatatatatatcataattgtgttcaaggatttaaataaaacatgaacatggaagaaacaaatggataatatcaaaaaagaaaaattataaaataaccaaatagaaattaaataactaaaaaagtgcatgtttaatgaaaaatgtactggctacccttaccatcaggttagacattacagaagaaaaagttaactagaaaataattcaatagaagtgatacaaactgcagcacacacatacaaagactgaaaagataaagaaacagagcctcaagaatatctatgaaaatatcaaaagatttcatatatgtgtaaagcaagtcacaagagaggaaagagatattgggacagaaaaaaatacttgaagcaacaagaaaaatcttattagaagccagaagaagaaaatatatgtttacacagaagaatagtggtaaaaatgactgatgccttctcgtcagaaactatgctggtcagaaacaatgaaataacacctttaaagtgatagaaaaaaataaaaaagattaacatagaatgttatatccagcaaaaatatcccttgaaagtgaatgttatataaatacatattctgcctcccccaaaataaataaaacactaagagaatatttcattactaggcttatataataaaagatgttctagaaatctattttggtagaagaaaaatagtgccagatgggaactttatactaagtaatgaagaaccctggaaatggcaaatgtaaaagattcatatttaatgccttaatttctttaaaagataattgatgggaggctgagtcgggcagatcatggggtcaggagtttgagaccagcctgaccaacatggtgaaaccccatctctactaaaaatacaaaaattagctgggcatggtggcacgtgcctgtaatcccagcaactcaggaggctgaggcaggagaatcacttgaacccaggaggtggaggttgcagtgagctgagatcgtgccattacggtccaacctgggtgacagagcgagactcaaaacaaacaaacaaacaaacaaacaaaaagataataatttactacttgaagcaaaatgatagcaatgtattgctactttaacatatgtaaaagtaaaaatttctaaataataataatcacataaataatgtaggaaataaatggtagtatactgttctaagtttcttgcattatccatgaagttatataatacacatggttgaaggtggtaagttaaagagggttattgcaaatcctagaacaactgaaaaaatttaaacttagaggaatagataataataagaatgttccatttatccaaaagaaggaaagaaaggaagaaaaaagaatgaagaagatatggcaaagagagaaaatacacagcattatggtacacttaaactgaactgaaaatatatttaatatactcctaagcatattaaatataaagggattaaacattgcacagaaaaggcagagattattaagctgaataaaaatcaaagcccaattatgttctttttactatacatgctctttaattgtaaagagctagtccaaaaaccaagtgtggaaaatgacatatcatgaaaataagaatcagaagaaagctggagtggtaatgttaatcccaaagtaatctacaagaaataataccacgatgaaaaagttatttcttaagtaaaaaaagtttattcatcaagacttaacaatgctaaatgggttgcaccctcataagagcccttctgatatatgaagcaaacactgacagaactgaagagacaaacagataagcccacaattagagtgggagatatcctaatgtctctctccgtatggttatacatcttcccaaacaaaatataatagaaaaaatacacaaaaaaatcagaaagaatatatatgttttaaaggaaattgtcaacctatttaacactatgccaaactgcagaatacacattcaagtatgcatggagcattccccaacatataccatatgtgtgggcctacagcaagtcttaatagattgaaaagaattaaaatgatacagagtctgtttttgagcaaaacagaattaaatgagatataaataacaaaaaaattgggaaattatcaaatatctgaaaatgaaacaacacatttccaaatacttcataagtcaaagaaggaatttagaaaagttttgaactgaataatagtaaaaatacaacatatcaaagttcgtatgatgcagcgaatgtttttagggttttataactttaaatgctttcagtagaaaatagaaacatgtaaaaatcaatgacttaagatggcatttctcaaagtatgctctggagaaacctgaagtctcttgagatcccttcagagacagtctatgaggttaaaacacctttaaatttaaaaaaaaaagattttatttgctatttcacttttatttcctgataagtgtacagtggagttttccagaggctacataatgtttgatcacattatctctctgatggctaataaaatgtgtgattgtctattatgtttaaaaacattctcagttttggatgcaataaatattcatagtatatattacaaaatgaaagctctttagggtccccaatactttttaagagttaaaggggtcttaagaccaaaaactttgagaactgttgatttaagataacttaaacatctagaaaaggagaagcaaataagatccaaggtaagtggaaggaaggaaagaatgaaaatctgtgaaatccagtgtataagaatatagacaaacaattgagtaaatctgtgaaacagaaagttggttcttttgaaagattcatgtaattgataaacctctgcctaaactgacgacaaaggagggagcaccaccgtcaacatcaggagtaaaaaaagggaagagtcattgctataggatctttttgatattaaagctaataaacaaatattgagagcaactttacgttaacaaattcaataacctagataatatggactaattccttagaaaaaaacaaataagcaaattggacactgaataaactgaatttctaaccaatctgatatctattaaagacaacatgtgtatataatctttaatatgttaatatatattaataaatcaataaacttcccacagagaacactctaagttcagatggcatcattagaaatgttattatttaaaaaaaatccaattcttcacgatctgttacagaaaatagaggagaagggaaatatttcttgactcaatttgtgagaaaaaaaaaaaaccctagttgtaaaaaagtagacaaggatattgtgagaaactatagcacattatgtattgtgaacataaatataaaaagatgtaacaaaattttaatcattaacatgatgaatatcccaaacaagtgaagcttctcttcaagaatgcaaggctggcttaacatttacaaaacaatccatgtaatccaacatgttaacagaataaaagtgataaatcatatgattatgtcaatagatgcagaagaaaatgtgacaaaatttaacacttatccatgataaaatgtcttagcaaactatgaatagactggaacttctttaacttgatcaaaggcatctacaaaagacctccagataacatcaacttaatggtgaaagattaatgttttctctctaagattgggaataagaaaaatatgtttgctctcagtacttctaatcagcattttactacattggtcacaaccattgccataagacctgaaaacaaaacaaaaagagaggaaaaaaaggaaggaaagaaagaaagggcctaaagtttggagaggaagaattaaaactgcctgtattcacagaaagcttaattaacggatgcagaaagtcctaaagattaataattaaattttgcaagattggagaacacataagtatatacatgatcaatataataaaagtagttgtatttttatacactgccaatgatcaactggaaaataaaaatgtcagagcaataccactgacaatagtatcaaaaccacaagatatttagtgatacatttaacacaatatgcacaagaattatgtactgcatactaaaaaacattgttaaggaaggaatcaaaagatctaaataaagatatatcacgcttatatattaagagtcaatatcacttctcaccaaattgatctttggattcagcccatacccaaccagaatctcagcagtcgttttttttaaaaaatgtgaaaaaatgtatatgctagaatcacaaggacaatatttaaagagaagaaaaaagttggaggacttacttacccaaaggtaaagacctataaaggtacagtaaacaagatatgtggtattgggaaaaaaaagtatacagatatagaaatggatggtccagaaacagatccacatatacatgatcaatttagtttctaggtaggtgacaaggaaattcaacagggaaaaacatcttttccaaaatcattgtgaaacaatcggatatccatctagaaaacaaaaataaaaacaaattttgacttctactttccatcccaaattaatgtgcaaaagctcctagatctaaatgtaagagctaaaacttaagctgaaataaaacaattccaggaaaatatataatattttcacaaacttgaggaaggcaaaatttttttcaggcaggacccagaaaacactagctttaaaagaaaataaattataatttgggctttcataaaatgaaaattatgttcatcaaaagtcattgttaagaaatcagtaggtaagtaacagactggaataaaaattctctccatccatatatctgacaaatggtttgtatctagagtataaacgtttctcccactcactaatcagaggacaaacaacctaattaaaatgggcaacagaattgaataggaaatttctcagggaacgatggacagatggacaataagcacctgaaaaaatgctcaacattttagccatcaaagatataagaattataaccatcacaagatgtcaccaacacttaatgggcatgggtatcattaagaagacacaacaataagtgctgtcactgatgtggagcgaggatgtgcagctctcgcatacgctggttaaagtacagtatgctggttttccataaagttaaataactatgagtctaccccaaaaaactgcaattctattcctgaatatttaccccatggaaatgaaaacagaagtccacaaagagatctacaagaatattcacagcagctctagttattataaccccaaactgtaaacaactacaaggtcaatcaatgagaaaatgaatcgataatttgtgatctattcatataatggaatattattaagcaattaaaatgaagaagtgactgatcctctcaaataggatggatggaactcaaaaatatattaaggaaaggaggcagatacataagtgtacattctgtatgagcccatttatatcaggtttgaggagaggtaaaactaatctttagtgaaggaaaccaatagtatttccctctggcagtgggaagagggtagcaggaattgaatgagcagtgacacagggtgtttctagagtaatggaagtgttctgtatcatatgggagtgtggtttacacaagtataggtgatcatcaaaactcaccaaacaacatttaagatctgtgcatttcacactatgtaaaagtatacctcaactgaagagagtggaaatctgtttcaaatgctcagccttttaacacatccagttgcttagactatgaacttcctcaaatggggtgtctgggcttgagattagatcacatgtgtagagtcgctagagagacaatgttgcattcccatggtacataatacatttcccgttttctcagacagccacaggtcatgaatgtgaggattctgagaggttggagcaacattcttgggaggcatgagggggagcacattctccaagatcccccccagcccggggtcctcgcctgctttgactattactccgttgttttcggactcctccgtagctgcccgacctcttcagatcccatagtctccctttatatcttgagtcccactgttcttccaactcatcccccattccctcagacctggagtggcagtggccagcagaggatggattgagagcaggagaggatgtcctgcccaggaacccatcctagagaaatggcatcctgcctgggagctagtttcccagggtggctttgatacgtcttgcagaaacaaacccacttgacacacctgatacggtattgacagtaacactatttttcgtggttgtttttcatagtaaaagtagatccctttagttacactgtgagtacttagagtaaggtgactggcctgggaatgataccatcttggatgtcattttctccttggagaaatgtattttagttccaatgcacatttcacaatacagtcctatagagagaaatacagagagctagacagttagagatatacttttatgtgcataaaaatataaaatatgcactttaaaatctgtacctgttattcctgagaaatgtatttggcagaaggtgggagggggatattctgatccttttatttacatgtttatgtatgatctgagtttttatatggagcatatactacttttgattttttaaagaaaaattaaaatctgtctttgaaatgtacacagttgtttagaagttgaggaccatttttgtttgttacaacattattgtacctataatgggaatatttcaaagccacttgttaacactttgttagaacaaaatgtagagggtgctgggtgcccctgaatattctcccacctcttgtgacctgtattgttttggaatttccagtggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaaggtaagaaatctgtggctggacatctacacacttggacgctgggatgaaaagccatggaaaatctcactgatgcagaaaccttccatgctacacgagaaatcaagtgtttttagagggtctgccatgtggaaggaagcctcagtgcactctctcaaggaggcagaggtgtgacttttggcacaacgtgagtgggctgtgcctttaggacaggtgcaaaccctccaaggtgctcaacttaaccactcaccttgttctaaaatgggttatctcagtatcccagtccaaattcgtattctatcatgctgccatatgtgtgattctttccaagccagtaagcatctccagtaatttcttaaggtaggcagcgttcattgcagtcttcagcattgcagtttctgaggaatgtggcccctgattctgtcatcctagagaaacctgacatgactgtattgattccatatcatcctgggtctctgtggctcttcataatcatccattttttccctgtacagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaatgtaagccactttgatttggactctttggccttttgctcaccaatctttgcaaacagaattggttctgtgttacagaaaatctgacctggactgctcttttttgtaatgggggagaggggacagaagaaaatattggaaaggcatcagggggctaagctagaatataattggccttagtatggaaagtacaagcagcacaggccaggaaacctccacacatgtgagggttctcaggcctcttccctttagtgacatttctttaaagtttccattattggggactgtctctagtttctagtgtttgtatgctaggttccagtaatcaaagatgccctttatgaaatttaagtcagatttttcgagaaaaaatttggatgggccatcaggtcaccatgggacttcccttagcctcatgcattctctgcgatggtttactttggggcctatgaatagggaagactgagatataggaaaaaccaaagtgtctgtgttcccccactctcacacccatgcagcataacacttctcacaccagatgtggggggatttctcctcacaccccaagcgagtctccagcagataccagctgggtgtcctacaatgtaactcagtgctgacactctatctggagacagtgtcagatcccataagttaaggctcagtcccacaagaccgccccactgcagatgccaatcccaagttccaggcggtgacctgtacttctgcccaactggacaaaaatctgtttttctacttgattactttgctagagtggctcacagaactcaggggaacacgttacttttatttacccatttgttataaaagatattacaaaggatcctggtgaacagccagacagaagagatgcacggggcaaggcatgtgagaaggggctcagagtttccatgccctctccagtgcaccagcccccggtaccccaagtgttcagcaacccagaagctctccaagtgcagtcttgctgggtttttatggaggcttcattacagaggcacagttgaatacatcgttggccattggagaccagctcaccttcagctcctgttccctccctggaagttggacgtggggggctgaacagttccaaccctgcaatcacatggttggttcctttggcaaccagccccatcctgagactatccaagaacccaccaagagttgcttcattcaaacaaaagatgctcccttcactcaggaacccccaagggatttaggagctccgtgtcaggaactggggggcagagaccaaatatacgtttcttattctaccacagtgtcatatgaaggggaggacaacactgcctttctgtgtcttgccccatagagggcgcacaatgcatggaaataaatgtttctgaatcaacagcaaacaggcttcatcgggtaggagagcgctgagccctccagggacaatgcacatcaatgatgtcccactgtcctttggtgctggggctctaaggcctccactgggtcaggctcctgaagggagacccattctccaaagacccccgagggtcaccactccctgtccaggggtgtggcctcatagctccttttgaacaggggcacaggaaggacggctttagagcattcaaaaaataactttgccaaaataataataataataatagaaaggaagaagaggctgagcatggtggctcacacctgtaatccctacactttgggaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaaggtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctgaaaaaaaaaaaaaaaaaaagaaaggaagctacttggaattgtcccatatttaacattctgctgaccaatcaatttgtcctagttacagaaaaccaccctggacttctcctatgcataatttggttgcttgtggttgggtctgccatgtggagggaccttgagctgggggaaggagcttggcctccaagtccactgaagaccagcatcctgagattgcctgggaaggtggtacagggcagtgatgaagatcatgggagccacactgcccagcttcgcatttgggcttctcctagggacaccaagagggaggaaggaggggttaggatggtatgaaagattctacttggccaatattattgtaatgcggcattgtgatctctggatttagcatgagttgatagctgactttttctgcagaagcatcttggtggcacctctaactcaaagtccctcgatggagtcagttccagttctccacttctggccccatctggtacacaccactgcctctcactgcccgggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaagaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacacttggaaatcctgaggactgtttcatgcagaaggatatggtttattcaggtttgactcgtgcttgagaaagctagagcctctggtggtgaatgattttaataactatttcctttccaccaacatatacagtacaaataataataagcaaaaataaatagaaacattcagttttgttttgaatagtaggagcagggtaccatcatttctgtagttactcttttagtacaacgatgcatgtctactgtatgtaaggcatactagcagaaattgagctcagcactagagaagatgattgcattctatgccttgcttctttttttaaaaaaaggcttccatagatagattctcagaacagcccatggcaaatgtaaagttatttggaaaacccaggttccagattcactagagcatagaatctctggttggttgggaaggaatttcctcttacagttgttactaataattgtatgaacaattatttaaaatattaacatttacatttgtgaagaccttgaagggctggagacaacagagaagcatttttgaataccctctgcagcccctgcactgttgtaggcattggtggatggtaccaaagatgggacactgtccctacctccagagaccctgtgggctggctacagagagaaggcagggaggaggaaaagaagaataaagtcatatgtttaagtcacccccacggccgttggttagtcatgggaggctccccagaggagctgtcctgaagctggctgacagaaggcaacatttcaacttaggacagtaatccttgctacatacaatcacatacacacacacacacacgtgcacacacagagactcacatggaaaaataaacctttgtgcctttcagcagtgatgacaattatggttttcagtaaactttacatggtttagatggtgatggtgatgatgatgattatgggaaggatggcatcatgttctaaacatactgcatggagtcagaataacaatgacaaataaccatttgtcccaatcaaggttttctcagaaaatatctcattctgatgctaaactataccagtctgtttgatcacttctccaacaaaataattacaaagtgcttatattttcttgaaaagagagggtcctgtgttgtctactaccacttttgaaacttagagaaaatgttccaaaagatgatgattttactatttagttcggcctttaagatgtcaaaaactcagtgcttggaatttgtctcgaattacaccacaaaattgctaccttgtctcaaatgggatttctttcccaccttgtgccacagcggccccttcatttgattgtgggaagcctcaagtggagccgaagaaatgtcctggaagggttgtaggggggtgtgtggcccacccacattcctggccctggcaagtcagtcttagaacaaggtaagaacaggcccagaaacgatttatactgtccctccacgtaagccctgcaaaacccttctacatttacataaaatccacacagctgaggcatcagcacctgcctctaagttttctgaaggaggaaaaaagctacaaaaattaatatatgtatatatacatatatatttttataggttctctactgtgaaaatgacaaaaattgctgtctttttcttgatctgggcagctccatcaaaatctgtaggcacagtgatttgcaccaagttccaatattgctggaaaatactgaagatgctctgaggatttctatggatatccattgtctcattgtcagatgaaaagagggggaagtttttagaaatgtgacactttctgggttgggagagcaaggacaaaattatctccagtctatcacaggcacagattctttttctttggacactttcgtgaatcattgaattcaatgcagaggctactcatccattcgcaaacaaaaaaattctaggtcatgatccccataaatgaagagtgatcagtccaatcccagggaacctggacattttgggtattgtttcagtggaacatgcctttcataagttccattttcttgggtatctcttaggaagcaagcataggaaacaggcccatccgtctgcctgttttgcttcctcatctcacttctacacgagggtgcctgtgctcaattgctgttttcccctaaagagactcttttccataagtttgtgaaatgccatcgacaaacctgatcgcattgcatttcactctgctgttgagtcgatttttctttattttatcatttagtaactccttgctctacagagctttcaccttccacatatttcagattcattctttcctaaactatgtggtggtctacgtcctcactgacttatcaacatgctaccatcatgcacttcctatctctattcctcttctttaaatttggttccaaatggctcacaccattattctgagctattacctgcctacgcagtcctagaaagtaagtgattcaggaaacattccccaaaagtaaagtttctcaggtaagatcagaagactcccatgagtcactgctgctcaggatcacatctggctccttgaagagtgattcatcagaccttacatagatcttgtcataaaaatgaaagaggcctcgggggaaggtcttgggctggtggcttctgttggagtcctgggctgtggggtgaaagccgtggctgtagagcttcatgcggagttacttagctttgctctcctgtggacaggccatgcctgtgcctcccccaagcatcggaaaaattggcatagatgggcccttctcaaaaatcccactcctggagcactggccaaaattactaccatcctgatgctgggcttgcagtcctttcctttgggaatatgaacatggtcaaaattaagtgaacgtgtctttctggctttctgtacaatggagcagaacaaagtatcaatttaactaaaatttgaactaaatcctctttccaggtttggaatgcacttctgtggaggcaccttgatatccccagagtgggtgttgactgctgcccactgcttggagaagtatgtttaggggacaattgacatgaagtcttgtcttaaatactttttctgtccttcttttcctcctttcctcctttcctttctcactcttcctcccttccttctctggctgtgacactagggaccaggccagggcaattggataagagagaagggaagggtttctagaaagaaactgcagaggaaagacacagtacagatgattttgtgggcctgaataaactgcagaacagagctgttcactaccataggctgtatcagtctctgcccaaacagcccaagaacattccttaactgcctgtttcaagcaaatcatgaattttgcttcttgccactcagaagtcactaattctgagtggccaagggtgtcagggagacagcaccaatttcatggcacagaggttacctgaaggggctggaccatattttcctcttgacgtcctcatcttttctaggtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcaggtactcgttcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccctagccctgccacatgctagctgtgctcttgagaaaggcagcaggactccgttttctcatgtggaaaaagagttgaaatgaggtactctgttactcctagaactcacttaatgttcaccagttcatacacattcatgatcagagaacgattcagttattccaggctgacaattcccccttcatcataatatgtttaagagaatcatataagactatatttgtttcaaagcactttaaaaaccacaagatcgagttgggtgtctggtgtgggtgcctgtaatcccagctacttgggaggctgaggcaggagggtcacttgagtcccggagtttgaggctgcagtgagttatgatcgtgtcactgcattccagcctgggcgacagagtaagacactgtaccaaaaaaaaaaacaccaaaaaaacaaaaaacaaacaaaaaaaaaacaacttcacaatgtcaaaaaaatcacaaatacagtttataaatgtaaattatattattattattgtcttctttgatttgattttctctttcctgttgaaatgttgtttcactaagcctgacaaagtgaaacatttgcttatgtcactcatttagtgctgtttggagccagatactagttgagtcagctaagaaacagctatttgtaggagaagcaggtttgggacaggtgacaaggcacgcagggcgctcgctgtgctggtggttctggaagacagggtgtcagtgtggacagggatgagcatggcctggatgagaaggcacggggcaggagcctgagctgctctcctgggcctggccacaagcccagggcagcttctctgggtctgtgaactgaggggtgatgtcctgggatgctctgacactctagaaggagagaagagcctttccagctcagcctttataaacagtagctgatctccctcctgctccccagtgtcctccccgccatcccagcaaatgtgcaaatagaaggtccccgttcctcatgatcctcagagagctggggtgttctgatggcttgaacaagtaatttggaaattttgggttttggaggagttctctgataggctgatacatttcgagtttagagttcccaccccacatccccacaccccgagtctagggcatttagtgctccaccagggaacctgtagagtgaggacgtctgcatgacaggctgggccttctgatgatgctcagaagcagaaagtgtgcctgcttcaaagttggtgacgatgatgtttcttgatcagaatagggcatttcttatttccaatcctttatcctcttgaacttactaaagtagaatcaggtctaaaaaccggagttctaatgtttgagagtccctgggactctaaagtatatgaatgttctttgaaaacaaataccattttgttcaagcaaaaggcttatttccaatcctctttcatttggtatcaagtattttactggattcttacaactatggcgtagtaacattcactgaggaggaaatggaggatccaaggatggagcaagttgctctgggcacacaacacatttgcaattttacagcctcttggtggcatctcagtcagacattccatgcactgatcaatgccctattcgattaatgtaaaaggacacactcagcatgagattccagttgtgcacagaatatacatgagaagtgcgcctttgtcatccctactttcaaaggtgaaggccaccagcagtatcttgcatgcaactgatgcctttcaaatgaaaccttacatctgcatagtccatagacaaccacaggcaaatgtgagggtgaaactctgtgttctacgttgctctgtgtcagtgaagcaaggcagtgccagttcagagggctctggggcctcaagacagggatgactggttgtgggtactgcagctgcgagcagagcagtcaaacataactgctgatgcttttctttcagtcctgccgtcatcactgacaaagtaatcccagcttgtctgccatccccaaattatgtggtcgctgaccggaccgaatgtttcatcactggctggggagaaacccaaggtgagataaattccattgcccacataacgaattggttttgacctacagtccatgtgacaaaatgatcattttggagaaagctgtgcaaattcctatccatgaatgtggtccaccccactcctgattttgcctgggcacctgtctatgtcttaatcagtcttcaaggcacatgatcaaagggaggaaaactgtgtctttgagtctctctctctctctctgttttcagaacatttttatttcaattaattaatttttaacttttattttaggttcaggggtacatgtgcaagtttcttgtatatgtaaacagtggtttgtcatgcagattattttgtcacctaggtactaaccctagtacccaattcttagtatttcctgctcctctccctcctcccactcttctccctcaagtaggccccagtgtctgttgctctcttctttgtgtccatgagttctcatcacttagctcccacttataactgtgaacatgtggtatttggttttctgttcctgtgttagttttctaagaataacggcctccagctccattcatgttcctgtaaaagatattacctcattctttcttatggctaaacagtattccatggtgtatatgtaccacatattcttcatccaatgtgtcattgatggtcatataggtgattccatgtctttgctactgtgaatagtgctgcaatgaacattcatgtgcatgtgtctttagggtagaatgatttatattcctctaggtatatcgccagtagtaggattgctgggttgaaagttagttctgcttttagctctttgagaatcaccatactgctttctacagtggatgaactaatttacagtcccaccagctgttagtgttctcttttctctgcaaccttgccagcatctgttattttttgactttttaggaagccattctggctggtgtgagatgatttttcattgtggttttgatttgcatttctctaacgatcagtgatattgagctttttttcatatgtttgttggccacaggcatgtcttctttagaaaagtgtgttagtgtcccctgtccattttttaatggggttttttttttcttgtaaatttgtttaagttcctcatagatgctggatattagacctttttcaggtgcatagtttgcaaatattttctcctgttctctaggttttccctttactcccttgagagtttctttttctgtccagaagctcttaagtttaattagatcccatttgtcaatttttgcctttgttgagattgcttttggcatcttcatgaaatttttgcccgttcctatgtccaggatggtgttacctaggttgtcttccaggatttttgtacttttggattttacatttaagtctttaatccatcttgagttgatttctgtatatggtgtaaggaaaggggtccagtttccatcttctacatatggctagccagttaccccagcaccatttattgaatagggagttattttcccattgcttgtttttgtcagctttgttaaaaatcagatgtctgtaggtgtgtggccttatttctgggctctctattctgttccactggtctacgtgtctttttttttttttttttttaccagtaccatgctgtttttgttactgtagccctgaagtatagtttgaagccaggtaatgtgatgtctccagctttgttctttttgtttaggattgccttggctattctggctcctttttggttatatataaatttttgaagtagttttttaatagtgctgtgaagaatatcattggcagtttgataggaatagcaatgaatctgtaaattactttgggcagtatggccattttaatgatattgattcttccaatccatgagcatgggatgtttttccattcatttgtgtcatctctgatttctttgagcagtgttttgtaattcttattgtagagatctttacctctctggttagctgtattcttacatattttattctttttgtggcatttgtgaatgggactgtgttcctgatttgcctctgggcttggctgttgttggtgtaaagggatgctagtgatttttgtacattgattttatatcctgaaactttgctggagttgattatcagctgaaggagcttttgggctgagactatggggttttctagacatagagtcatgtcatctgccaacagggatcgtttgatttcctctcttcctatctggatgccctttatttctttctcttgcctgattgctctgaccagggcttccaatactatgttgaataggagtggtgaaagagggcatccttatcttgtgccagttttcaaggggaatgcttccagcttttgcccatttagtatgatgttggctgtggacttgtcatagctgtctcttattattttgagatatattccttcagtacctagtttattgagagttttcaatataaaggatggtaaattttatcaaaatccttttctgcatctattgagataatcatgtgggttttctctttagttatatttatgtgatgaatcacatttattgatttatgtatgttgaaccaagcttacattctggggataaagcctacttgatcacgatggattggcttttttatgtgctgctggatttggtttgcaagtattttgtaaaggatttttgcatcagtgttcatcaaggatattggcctgaagttttttgttgtttttgtgtctctgccaggttttggtatcaggatgatgctgacctcatagaatgaattggagaggagaccctcctcctcagtttttttgaacggtttcagtaggaatggtcatagctcttctttgtacatctggtggaattcagctgtgaatctatctggtcctgggcttttgttggttagtaggctatttattactgattcaattttggagctcattattgttctgttcagggaatcaatttcttcctggttcagtcttgggagggtgtatgtgtccaggaatttatccatctcttttaggttttctagtttgtgtgcatggagctgtttgtagtagtttctgatggttatttttatttttgtggcatcagtgctaacatcccctttgtcatttctaattgtgtttattttggtcttatcttccttttcttcattagcctagctagcagcctacctatcttattactgttttcaaaaaaccaactactggacttgttgatcttttgaatgaattttcatgtcttgactttcttcagttcagctctgattttggttatttcttgccatctgctagctttggggttgatttgctcttgtttctctaattttttccattgtgatgttaggttcttaatttgagatctttcttcttgatgctagcatttggtgctatgaatttctctcttaacactaccttagctctgtccaagagattctggtatgttgtatctttattctcattagttcaaagaacttcctgatttctgccataatttcattattcacccaaaagtcattcaggagcatgttgtttgatttccatgtaattgtacggttttgagttattttcttagtcttgactggtatttcattgtgctgtggtctgagagtgtgtttggtatgattttggttctttggcacttgctgaagattgttttatgtccaattatgtggttgatttttagagtatgtgccacatggtgatgaaaatgtacattcagttgttttgggaaagagagttgtgtagaggtctatcagatccatttggtccaatgctgagttcaggtcctgaatatctttgttaattttgtgcctcgatgatctgtctaatactgtcagtggagtactgaagtctcccactattattttgtgggcgtctaagtctctttgtaggtctctaagaactttatgaagctgggtgctcttgtgttgggttcacatgtatttaggatagtagatcttctttttgaattgaaccctttaccattatgtaatgcccttctttgtcttttttggtctttgttggtttaaagtctgttttgtctgaaattaggatggcaacccttgcttttttgtctgatttccatttgcttggtaggttctcctccatccctttattctgagcctatgggtgtcattacatgtgagatgggtctcttgaaggtagcataccagtgggtcttgctttttatccagcttgccactctgtgcctcttaagttgggcatttagcccatttacattcaaggttagtattgctatgtgtgaatttgatgccctcattgtgttgttatgctggcttgtttgtgtgatggttttatagtgtcattggtctgcgtatttaagtatatttttgtattggctggtagccatcttgctatagttagtgcttctttcaagatctcttgtaaggcagttctggtggtaaccaactccctcaacatttgcttagctgaaaatgatcttatttctctgttgcttaggaagcttagtttggctggatatgaaattcttgggtggatattttttaagaatattgaatataggccccaatatcttctagcttgtacgggttcagttgagaggtatgctgttagattgatggggttccctttgtagacgacctgtcctttctctctagctgcctttaacattctgtctttcattttgaccttggaaaatctgatgattatgtgtcttgaggatgatcttcttgtatagaatctcacaggggttctctgtattttctaaatttgactattggcctctctagcaaggttgaagaagttttcatggacaatatcctgaaatgttttctaaattgtttactttctccccatccctttcagaaatgccagtgatttgtagatttggcctttttacataatcccatgtttcttggaggctttgttcattccttttcattcttttttcttaatttttgtcaactgtcttatttcagaaagccagtcttccatttctgagattctttcctcagcttggtttattttgctattaatacttggattgctttgtgaaattcttacagtttgtttctcagctctcagctctgtcagatccattaggttcttttttaaaccagtgattttgtctttcagcttctatatcattttattgtgatcctcaatttccttggattggattttgccatcctcctggatcttgatgatcttcattcctatccatagtctgaattccagttctatcatttcagccagctcagccttgttaagaacccttgttagagaactagtgtggttgtttggaggacatatggcactccggcctttatgttcctttaactgcagtgtaggttgaatacagccaatagacttgttctttggatgtttttacagggccaaagccttgtgcagggtctttatttgtagttgatttcttgtctttggtttcatagtgtggtatgttagcaaggtatttttggtgttgaagctttggggtgtgatccattttttatttgtatatttccctacacctaaaacaagcaaaaaaacagtaaaggtctttgagtctcttaatccataatttcagcattcctgagtatgcttccctgggtaagtggggttttcacccagccctcaagttaagagtgttagattatttttcatgtgaaattagccagactggctttcttaacacaatgtaaaacaataacaacaaaagttataattagactagtcttcttcccaaatacccacatgtctaatgtaagtgggatggtgttaaacaggggacctacaactgggggagaggcggacaggtcccatggccccaggtctaggatggcatttggtattggttgatgggtgtggatgagaacaagagagggaacacttgtgcaggatatggtatcagcacctgtaatacattttagggattctttcttctctttgcagtatgccctgacaataattatatccatcagcctagtccccttggccattgaaacactaagactgtcttaggatccctgctgcagtttctcagaggtgctaggagggcattaggagtctgaagccctggaagtgtgttctgactttgccactagctagatagacctggactaggcacgttacctctttgtaccactcagctctaacccctcattcaaaaacccagcattttcaagtggtgtttttcacatcagcctttgcataagttttcatttgaagaaaggtttgtttttgttttcttggtttaatcaaacatttaaaaacgaatggtctagatgatttcaaagtggctttccttttcctgtgcttttcctactatttaaaaactttacctccttgatttcttgatctccctttctgcactgctgggtctgggagcattgaggccaagtaaaaggaaccttggcaaaggaggaacacctatgggtgtgccaggctgctcccagtgttttgcatttttaaaaatttaaatgctgcaaacctctatgaattacatattattgttcctagtttacaaatgaggagcctgaggctcagagaatgtgtgggatggtacagactaacctgaattagaaccctggctcccatttactggctgtcaggacttagaaaagtcataaactctctggctgggtgcagtggctcacgcctgtaatcccagcactttgggaggccgaggcaggcagaccacgaggtcaggagcttgagacgagcctgaccaacacggtgaaaccccgtctctactaaaaatacaaaaattagccgggtgtggtagcacacccctgtaatcccagctactcaggaggctgaggcaggagaatcgcttcaacctgggaggtggaggttgcagtgagccaagattgtgccactgcactccagcctgggtgacagagtgagactctatgtgagaaagaaagaaagaaggaaagaaggaaagaaggaagaaaagaaagagaaagaaagaaagaaagaaagaaagaaagaaagaaagaaagaaagaaaggaagaaagaaagaaagggaaagaaagagaacgaaagaaagaagggagggagggagggagggagggagggagggaggaagggtgggtgggttgtgaactcttgttgattgtttcctcagctgaaatgtgggctgcagggctattgggggagaaacaataagaaagtgcaccaagcaccaagcacatgctaagaagtccatcatggcagctcctgataataatatggaatagagttgtatctaacatgactctttcttgcaagtgacagaaaatgcaacttaagttggattaagcaaaaaagagaaatcattagtgaactgaaaattctgcaggctcacatcatggccccagaccctgtccattattcttgggcacaaatgtgacattctcgtggctgcagatgctgtggtggctctggctctgccaggaaaagaaataaggaaggccactctccccattacacaaacaatagtcttccagctctgagaggtcgaacttgtgtcaccagcctgcccctaaacccgtcactgattaactccaacctgcatcagctgttccatgctggaggtggacgcaggaccacactcataccaagatgggggcaaagtgtagttccctcaacaggattataggatatagtgtgataggctgctgggcagccaaaaagcaaacagatcctctacaattcctcaactgatgaaagcacgaagctaaaatcataaagatctgtgtgtgagttctggctctcccatcttccttgtgagattgagcagttagttaatctcttttagcctcagctttctcacctgtaccaacatataaggtcattgtgaggattaagattatgcctcatgatcatcattatcatcatcaccatccacattgcaaccacaactaccatcatcatccccaccaacatcatcaccaccaccaccatcacaattatcattaccaccaccaccattgtcaccctcaacatcaccatcatcactatcaccaccaccatcatcatcactaccactaccaacaccatcactctcatcattccaccaccatcaccattaacattaccatcactatcatcaccaccaccaccaccaccacccccatcattactgccatcaacatcaccatcaccatcatcaccaccatcaccatcattatcaaccatcatcaccaccattccaccaccatcaccattatcatcactaccattatcaccaccaccatcatcaccaccaccactaccaccaccatcaccaccatcatcaccataaccatcatcaccactatcaacatgatagtaattatgattaccaccaccattagcattatcattaccaccaccagtaccatcaccatcaccaccgccaccacctccatgatcattactacccaccaccatcaccgtcaccatcatttcactaccagcacaattatcattaccaccaccatcactaccacccttatcacaaccctcatcatcaccaccattccaccactgccaccaccaccaccaccatcactatcattaacaatagacatcacataaccagtttgtagctggaccttgagcccagagcccactcactgtttcttcagtcccaccgccaaccaccaggatgagtcacaaaacataactcaggcctgctcctcaattttctacatgtcaataatgacattgaagcaatgggtgttctctgcttctcagagggaagttgaaattctcctgctcttcccttcatgtttccagatgttccctgacttggatattccaaacgcagagtttggaggtgttgaggccaaggggtttttccaggtcagccatcatctgcaatcactgagctgatcctgctgctggactttccctgttgccctctccccaacgccccatcggggagggcttcaatcctcaggtcacctgtggcctttctgccctcagaggtgccatctctacatctaccactggaaggcagcacctactcacagattgcatcaatttcccagcaactcatggtgggttttcccccttatcagcgtgtttgccttgctcagagagcagatcccagagcagtgacacctaacttaattttcagcaaaacattttgagaagggtgctccctcacacaactacacagtccaggtgatgcacccactgcccaatgcttggtagtcaagaggagcttcctccctgcagctctgcccagatagggctgagctgggctctggagccaggcgctgggatgagcctcttccatgctgctcatgtaaactccagattcagtgtcggttttctgaacccgagacaatgatctaaatgcagtcgaaggctttggggaaagagagagtgcctcggttcttacctgtgtcatgctcgcaaagcaaagagttttgcaaaattttaatgaaacctgggcttgcaaaattggaaaactagattatttgtgacgacactgagacatccctgggcatgtctatctggaaaaacggcattttctctggcaattttgcagacattctatttcaatttggcaaagaaaataaagcagtttttcacaaaggcagaaatacaactagaatgttcactctccctaattgtcaaagaagtgtaaattagaaaatgaatcaggacaatttcaacctattagattagctaatattttaaaaattgaagactcatacaagtgaggtgaagtgattgttttctagtggcacggtacactgtcacacccttttagaaaataatttggcaacgttattgggagacagaaatatgtctatgtaatttatgggaacttagactcagaaaatgttaaggaataagaatgaactttatgaacaaagatgtggaaagctggaagcaagagtggggccaacacgcatggggaggaagcatttgggcagtgactccacagacccaggctcaggctgaactacacaacctccttacgcctcagtttccttaacagtagaacagaaatgataaaagtgcctgtttcacaggactattgcgaggattaagtgagatacatcgcattataagcttgtgtctggaaaggttaattcttggtaaatgatgactattcttttttattgcaataaaatatacaaaacataaggtttactattttaaccattttggaaggtaccactgagtggcatttagtacattcacaatcatgtgcaaccatcatcatatttccagaacattttcctcattcccaaaggaaacctcatgttcattaagcagtagctccccttaacatattagttatgaagatcatagcattatacaaaactcatgacacaatgatgagtgaaaaaatcaagatgtgaaattttgtgttatgatgtaattagtaaaagaagcatattaaaacatctgaaaaaagagtatataaaaatagcaattgcatttttcagactctacattttaaacattattctttatagttttaaaagcaaaaagtaaagaaacaacaaccaaccccaaaccaacacgacaaagcccagattgttaattccagggctcaggaacacagaatcatatatgatgtttacactctgcagggtcagagactccagcggcattgggagctgcctcgtgttctgcagcctcacagacaggaggtccagtgccgctgctctgttctggaatatcctcctgaatgtgttttgggtgcagttgccatttctttcatctttttaaacacaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccaggtaagcaaagatcaagagaccaaagttagtcttgtgctctcttgtctcagtctcagcccctcagacttcattccccaggtggcaaattcaaggattttcaaccgaagaccccagtctaagtgttgtttagaaacttcctagatctgtccctgaatgcgtattcagatcatctaaggggatgtcttggggcttgagttccaaatcagtagcaagcgagttttaagtgccataactacctcaggccactcaccctcctggggtgtgctggtggccagggactaaagtggtgacttttccggtagggaaggaggtagaggatacaggacagagaccaactgcacacactttacactgatgcccaggctagcccagtctaaaggaaacaccaacataggaagggatgtgtgcaggattcacaaaagatcttttctaccccccggaaaaactaagtggtgtggtttcgctaaacagattttgctaagtacttaagcactgcagatgcttgagtaatatgctcataagttcctttctgatttcaattactgggaaaatgtatatatggatagtagaaggatggcatcccataataaaaggcaggcagcctaaccctcacatgcatttttctctccctctgtatagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaatttttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgtatggggagtcatgcaaaccgattctgttattgggaatgaaatctgtcaccgactgcttgacttgagcccaggggacacggagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtcacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaagagctgtgtttatttcattgacaaatagattatttgtattcaattctgatgtgctttaaggatgaagtttctcattttacaattagcacacacttcgtatatgttgtcacctgttctccttacacaaatgttgttccccattttgaaggattccctttggtaccagttttgcctgtccacataaagtatttcatttaaaaagctcagcataaaatatagactgcatctgaaaagatattgaatataatatacatagcagaacacacacgttccacatttcaaaagcctcgataacaaaaaagaaagatcaaagcccttattagtcgctgtaaagccatttataaagctcctgctgatcctgttaagcatggatataattgacctttcttttaaattaaaatgtaagcttttccccaagacaactcaaagtgccaagactgaatgggaactgtccatgtttctaactcttggccacgggcaccatcagaactgaacttaacaaatatatgaaaaatatctcttcatttttaaaatcctaagacccagaaatcataatccatgggatttgtttagtaaagaagaaaatctgtggctctaggtgtccactaaaggagagccaaaaatgtcccgaataatctcaggaccacagcatcattttatgaataacagaaccaagacctcagattgtacaacagattggttcttattgctggaatggggcataaaccatgcctggaaccccagatgctacagagaaggtagatgggagagacttctgacctgttcatgttgcaaaggcgtgcggagaccaaggtgagcagaggacacgaatgctcacattctgtggcccaggaacctgtgattcaatctcctcattaacaggattcccaaattttcatcctccctgcaatttttcaaatgctcggttatgggcttagtcccttgactgatcagatttgatgaacatttctgcacaaatttcccaaatccttggttttcaaatcctgcattcttgatggagctgttatgagaatcgggtggggggcttctctcgtctctctttagcctaatgaatcagagaccaggaagagccatgcacctgagaggctcttttttaagccagctacatattatgtgttcccagaaacttcaacagcactacaaataatcctaactcatccaacattatataaaaatactctggatagattgaggtctttatacagtattacaacagtgtggcataatgtagctgaaatgcacacgtgcatctctgcaaggacagctttgcaaggaggatcagctcctggatagctccttccttccctctgtcaggggcctcaaaggtgagagctggaaactggagtttttttattcctgccacacttataggaatgtggactgaaaaaacaaaggagaaaggagaaagtcttcgtgaaagattatgcaactagttagaggaaggtcttctgttattatttaatagcatagctggttttgatcaaatacacatacctaacttctgatgaaaacccaactcaaaggtaacaaaaatcacttcaggctaattttttgacttgctttcagaccctagacagaggttagttagcattacagtatttaagctctttatgaatttctgctgaattaacatatgtttggaaatcagctgctgatgtgaacccagcagaaatgatagaataatccagtgcagttttagaagggaatatactaacaggtttcagtaatttagcacgaactagtttttttagagtaaataaccatggatcacaatcaatgtgcttaatttgtagtacagtaaaccatacttctagattttttcaagtgtggggactaggtataattaatctatccaacttttcattatgaaaatttataaacagaaaaaaattagaatttgtgtaacttaaatttttgttggtagaattcctcatgtttatatattagttggatattgattttccttgctccccattgggacaatcctgcaccaccccaccacccttcaccagccaaaaacaatctctcccagttgtttaattttaatgcagctgatgtggtagaagagtcctggtctcaaaggactccctcttcctccatttcttcctgatgagtttgcaaatctgactaattctgattgaatcaagaatgaatgcatcactctcagtgtgtaaacaggcagcagtcaatggagtagaatcaaagggaagaaagattttcctcaggatttttgaaatattaaaaaacattagagttccatatccttaatttccagttcattatcaagattgctttttattttttaagttagcagttaaatcatttttaaagattacgcaaaaaaacaagactatgtgttctatttaaaaaaaaaaatcaaacagtacagaagtctctgacaggaaagtgatggccctcccttcgctacccatctccccagcccatttgtgtccccagatattgttttacatcttttactgtaattctcatattcatatctctgtcttttttagtgaaaaatgtcaaacagaaacttataaagatttcagtaatgttaatttttgttgatataactcttcatgttcatatattggctggatattagctttccttgtacactatttgcctccaaaactcaatctctctttcttttctctgtctacttacctctattacctatctatcatctattatctatttatccattcatcaatccttctacccattatctatcatctgtgtctatctatctatctatctatctatctatctatctatctatctatcatctatcatccatctacctattatctgcctatctaccatttgtgtgtcatctgtcttcctatccagctacagagagggactgcctttggttttagttttttataaatactctaacacattgttgagtgatgtttcactttgtaatcagtcttgaaaacctgcctatgccattccatctagacagacctgacgtcagcctcctcactctgtagagtaagccacactgttaatcccctgctgctgcacgtcccagcgatttccactttcccacgtcagcagttcctgcctttagatcacttctgagtcttagcaccttacatggaaatgcttctctcttcacaatcatgtttaaaaaataatgaatattcttatctagctttggtgggattttttacattaatattttatgtttactttgaattttttgcttacgatgtaagatgaggatttattgttattttttccccatgcatgttcaattttctcaacatcttcctttctccagtggtttgaaatgctgcttttatttagggtgcattgaattttggacaatgcctgccaagtttttctacatcatccactgtttctggcaaggcaatacccgtgatttcaggcaaaagcatcacgaggccaccacagatggatgccagggtacctacggaataggggagaggtgttactgcccccaggaacacacagctgggccttcccccacaggcctcctcactgtgaagccaccgtgttactcactggagtggctctcaaccacagcaacctctacaccccagatcactgccttggctctccttcaccatgatttcaaatgttctctcccttcctcaaaccctgagctatggcccctgtacacctggcagccatgggttctctcacacatctcacagtgattgactgagtgccttctcggggtccaacacccaaggcctcccctcctgcatcacagggaaacagaagtgctggaggggagtcccctctgcacctgctcactgacactctcacttacctgctcctctccctcccattccacctgtcaccttacactggaagaattgtcttggtgtctaccccagggccagtgctcacctaggcttgtctttttgggtgcctcactatggtgattaaccctttctccagtatctttaacctattgggagaagctttcaaacacattaagatctttcttgtttgaccagccttctctcattctcacctcatccttccattaccatcctttcttttactgttctttagagccaaagttcttgaaaagccaccctctcctattttctccacttatttgtatccaagtggtgtgctagtaaatgcctaacaactggctttggacaatcaagccctgattggcagcatctgccaatgtgcacggtgtaaatgctcccactgtgggcccttcagtctactgacacaacatccctgcctgtgccactaggaagagatgcaggagccccatcaatgtggcttccaccataaagacgcagcagacacaatctcaggaacacaggtaatactgaagatgtagtagatgaactagaaactgatgaatgttgagactaaaatcagttcctactttaaatgcatagacattaatgtaacacaacaagaaacatgaaaaaacaaggaggtaaaataaaacaccatcaaaggacacaataatttcccagtagctggtcccatagaaataaagatatattaacaacctgacaaagatttcaaaataattatttgaagaaagcttggtaaacttcaagaaaatacagagaattcaataaaatcagaaaaacaataaaagaccaaaatgagaaatgtaatggagagattaaaactgtttaaaaagtcaaacagaatttctgaaactggaaaaataattaagtgaaaaatgcaatagacagcatcaaaagcagaattcatcatgtagaataaataatctgtgaacttgaagacaggttatttgtgaatatagaatcgaagaagaaaaaatagtaaaaaaataaagtttacaggacttatgaggcagcatgaaaagtgcaaatattttagttataagagttcacaaaggagaaaaaaaggggtagaaagcttattttaaaaataacagaaaactttctaaatctagggaaagatatcaacatccaggtccaagatggtcaaaagtctctaactaaattcagttcaaacataactacatcaaggcaaagtcagactgtcaaaaataaagacaaagagaaaatcgtaaaagcagaaagagaaaagaagcaaatcacatataacagagttccagtaaggctagcagcaaagttctcaacaggttccatacaggccaggaaagagcaggttaatatattcaaaatgctgaagaaaaaaactacaaaataaggatactgcattcaccaaagctgtgcctcagaaatggagatatcaagtttttaccaaataaaagctgaggaagttcattaaccccagacctgtcttacaagaaatgctaaagggagtctgcaagatgaaaaaagatgctaattagtaacaaaaaagaaaacataaaactcactggttaaagtaagtacatagtcaaattcataatattcaaatacgttaatggtggccacatatatctgtaatatgaaagaatgaatctcttatatctttagcatgaaggttaaaagacaaaactattgaaaataatagctacaataattttttaagggatatatgctataaaaagatatacattgtgacataaaaaaattttaaatgcagggagatgtggagtaaaggcacagagtttttatgcaatcaaaattaagttgttatcagcataaaatagcccgatataattatgagactttttgtaagcatcatggtaaccacaaagcaaaagcataaggtagatatacaaaagataaaaaggaatcaaagcatcccactagagaaaaatcacttaatcacatagaaagatagcaagacaggaagaaaggaacaaagagtctacaaaacaaccagaaagcaattaacaaaatgataacagtagtcccttacctatcaataattatcttgaatgaaaatggattaaattctccaataaaaagatatacagaggtagaatacactaaaaaataagatccaactgtatgctgcctacaggacactcacttcacctataaggacacaaataaactgaaagtaatgggatggacaaaatattccatgcaaatggaaaccaaaagagagcaggtgtagttatacagattgagtatccctaatccaaaagtctgaaatctgaaatagtccaaaattaataaaattttaagtgctgacatgatgttcaaaggaattgctcactggaacactttggattttggtctttagggatgctaaaacagtaaatatataatgtgtagtagtccattctcacactactataaagaatgctacctgagactgggtaactatgaggaggtttaattgactcagttccacaagcttaacaggaagcatggctaggaggcctcaggaaatgtacaatattggcagaaggtgaaggggaagcaggcaccttcttaacaaggtggcagaagggagtgtgagtgtgtgaagggggaactgtcaaacacatataaaaccatcagatttcatgagaactcactcactttcatgagaacagcatgagggaaactgctcccatgatccaatcacctcccactgggtccttcccttgacatgtggcaattatggggattacaattcaagatgagatttgggtggggacacagccaaactatatcataatgcaaatattccaaaataaaaaaaaatttcaaaattctaaaaaagtaaaccatattataattcaaatattccaaaaaaattcaaaattgaaaacacttccggtttcaggaattttggataagggaaactgaatctacatgaggtaaaacgactttaaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcatggtggcgcgtgcctgtagtcccagctactcgggaggctgaggcaggagaatggcgtgaacccgggaggcggagcttgcagtgagtcgagattgcgccactgcgctccagcctgggcgacagagcgaaactccgtctcaaaaaaaaaaaaaaaaaaaaaaaaaaaacgactttaagtcaaaaactgtaaaaagagacaaagaagatcataacataatgataaagagatcaatttgttataacaattataaatacttattaatatatatacccaaaatttgagtacctacgtataacaactaaaaaaattaatagttctcaaaggagagctagactgtactataatcatagtagcagacttcaatagctccacttagctccatagtagcagacttcaatagctccagacagagaatcattatggaaacatgagatttaaactacactttaggccaaatggacctaacagaaatatatagaacattctgtccaacagcagtagaatacacattattctcaagtgcacatagaactttctccacaatagatcatatgttaggtcacaaaacaagtaaacaaatttaagaagattagaatcataccaggtattcttttcagattataattgtatgaaactagaaatcaatgacaggagaatattggaaaatccacaaatacatagaaattaatcaacatgctcctgaacaatcaatgatcaaagaagatattaaaagataaatttaaaaactcaaaactaatgaaaatgggcacactaacataccaataacttatagtatgcagcaaaagtggttctaagagggaagcttttagcaataaacacttacatcaaaaaagaagaaagatatcaaataagcaacctaacattactcctcaaaaaaatagacaaagaagaaaagaaaaactaacccaacagttagtagaaggaaagaaataataaagatcaccatagaaatagtgaagtagagaccagaaaaatgataaaaaaaaaaaagaaagaaaactaacggtttttaaaaagataaaaaaattgaccaacttttaactagattaagaaaaacaaagaagactcaaatgaaatcagaaagaggagacattacaatagatattacagaagtacaaatgatcataagagactactgtgaacaattatatgtcaacaaattggataacttagaagaaatgaatgaattcctagaagtgaaaaacctaccaagactgactcagaaagaaatagaaaatctgaacagaccaataagtataagattgaatcagtaataacttccatcaacaaaaagcccaggacctaatcatacctgaattaactgctgaatcataccaaacattaaaaggactaatatcaatcctcctcaaactcttccaaaaagttaaagaaaagggaatgctttcaagttcattttatgcggacagcattatgctgatatgaaacacaaaaaagaatactgtaaggaaagaaaattacaggcaatatccccgatgaacatatgtgcaaaaatcttcaacaaaatactaggaaacggaatccaacagaacattaaaaggatcattcgccatgatcaagtgggaattgtcccaggaatgcaaggatagttcaacatacacaaataaataaataaaaggataaatggatgataaaaatgtgtgtatccatatgtgtgtgtctgtgttatacacacatttttatattatatatatatatacactcacatatacacattgtgtgtgtgtgtgtctgtgtcttatatacagacacacacacacaatggaatattattcagccttaataaagaaggaaaccctgcctttgcatcaacatggatgaacctggaggacattatgataagtgaaataagccagacaaagaaggaaaatactgtgtaagcttacatatggaatctaagaaagttgaactcttagaaacggagtagaatggtgattaccagggctggggaagagggaaatggagagatattggtcaaaaaatacaaatgtgcagttttgcaagataaacaggttctggaaatctaatgaactgaatgctgactacagttaacaatactgtattgcatacttgaaatttgctaaaagagttgatcctaagtgttcttaccatgtacacaaaagtatgtgagatgatgaatactttaattagcttgattatggtaataatttcacaatgtgcatttatattaaaacattaccttgtacatcttaaatatatacaatttttgtcaagtgtatctcaataaaactggaaaacaattgaagagtaatgaaaaaaattaaaa

SEQ ID NO: 1305 - DNA, 118056 bp, Homo sapiens
cctgtattctaactcaaattattttatccgctcaaaaagagctcatgaaatcaactgatgtatttcactgctttttcttaggtttcctttgggaggggaaggaataaccttgaagagaggtgagaattgtcatggattttgtgtgacttgttactcaagatgactcattaagctgccaagagcctcacagcccatccaaacttctcaaacaaccccttcaattccagcccttgacctgatctatgtagagggttggaaaattcacagcaatacaaagctatggaaacagactgtcatccacatatatgttgggtgatgggggagacatgaagagtgagagactgtggagacaggaaagtagcaacatttgccatgagattttcctcgaaaccatctccttcttgaatttagacactcattgtttatgtgcagtggccctaggtacagaagggtcaccaccccaaggagaactataccctccggactcataaaccaaattctagccagattctcccggaataaaatactacagttcatccattaagctaaatctcctttcaacaattcccttcttacctggcccatgaaatgaataatgaagagattattttctgggcaaattggtagaaaaatcctgatgcagacagttccccttctgattgcacctgacttccattcattgactatcacatcaagtagtggttctgggaattcaaaggagagctcagcaaaagaagaagaaaaaaaagcccacaaagtttttcaaggtacctactgcagttatcagttcatagatctaaatgttcgcactgtatgcttgatttgcacattccaaaccaatttggtaatttttttcatttttatctacacgcatgaagtgatttggaatactgaaacaatttagaatcatatttcgtttgcaacagttcaattaacttaagtgctggaacatgctctccaactggtaactagtttaattggttactattacaagaaataaattctatagtcctggggcctcccagtgtcctttctagacagggcccggccatgcagaggtatgtgggagtgggaaggtgaggagtgtagcaaaatttcttacttaaaaaagaaaaatccaagaacccattctcttaataactaggtatgagtttccattttctgctgtgattttatgacctccagttcccttggatcaactttacaaccactcaataagcaagagaagggtgtggatcaagggtcgaagacttttaaagctattgcataaatgcacttaagcatgagccaaagtgataaataggaaaccaagacgcatgtcaggaatgcagcaaagaatgagtagctgggacactttgagcagctgttaaggcaactccaaacccctggaaagaaggatttccttctggcttacaccaaggctcaattgctctagttgcatttgcattgaaaggcactactgccaaattgtacaagaacacttatagtagaaaaacatgtaaattgtcaaaagatacaaaataatactgcatctcatttgtggatatacggaaatgtagttaaagagaaaaagtgagtaggcataacacatactaactattggggagagaatgctactgaggaagaaaggagaataaagggataggtatgtgatttaagtgcaatcttaagcatattgaataaaatattaacatctcataaagctgggtatgagatacatggggctcaattctattattttatgcactttcatgtttatttgaaatgatttctaattaaaagttagaaacacttaaaaaaagaatcagtccctgtttcgcagccattggcaaaccagtcatttctcaaaaaattcttctgtcttaagatcacaaactctggaggcatcacgctacctgacttcaaactatactacaaggctacagtaaccaaaacagcatggtactggtaccaaaacagagatatagatcaatggaacagaacagagccctcagaaataatgctgcatatgcatatctacaactatcatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaagtaaactaaagagcttctgcacagcaaaagaaactaccatcagagtgaacaggcaacccacaaaattggagaaaattttcgcaacctactcatctgacaaagggctaatatccagaatctacaatgaactcaaacaaatttacaagaaaaaaacaaacaaccccatcaaaaagtgggcgaaggacatgaacagacatttctcaaaagaagacatttatgcagccaaaaaacacatgaaaaaatgctcaccatcactggccatcagagaaatgcaaatcaaaaccacaatgagatatcatctcacaccagttagaatggagatcattaaaaagtcaggaaacaacaggtgctggaggggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctgtaaagacacatgcacacatacgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgggaacacatggacacaggaaggggaacatcacactctggggactgttgtggggtggggggaggggggaggggtagcattgggagatatacctaatgctagatgacgagttagtgggtgcagcgcaccagcatgtcacatgtatacatatgtaactaacctgcacattgtgcacatgtaccctaaaacttaaagtataattaaaaaaaagatcacgaactctaggctattttgattaaggttcatggaattctgaaaatgaaagtttatgaccacctttccttctttcccacttcataatcttaactgacctcatgctgactgaggatgaccactggattggagatgggcctcttgtattgcaatgttagaaactgagcccgcttttccctacaactgatgccaggtgcagcaaagacactaccctcaaagggcgatccataaattagaacactgagtgtctaccgatcagtatctacagtaatcctaagatttgattgtagacaggttagcattgcagagagaaatccaaataaacatatttaagaaatcttaagaaggtcttctatcatgaacagctgatatccgagctagcattgtgtcatgacaatgaatgtaatcacagaaacaaggaagcatttcgtccaaaggtggattctccacgtgcctatcgcttgtctgaggatactgtaagaatctctggaaagaggggctcagtttctcacactgcaataccagaggcccgtctccaatccagtggccatgctcagtgagcatgaggtcagttaagattatgaagtgggaaagaagaaaagttggtcatgaactttcattttcagaattctatgaactttagtcaaaataacctagggtttgtgttctccaagacagacgaattttctgagaaaatgactggtttaccaatggctgcaaaatcgggactgattattttttaagtttttttcttatattagccctaaattgaaaacttatttatttacttatttatttgagatggagtctcgcgctgtcacccaggctggagtgcagtggcacaatctccgctcacggcaacctccacctcccaggttcaagtgattctcctgcctcaacctcccaagtagctgggattacaggtgcacaccaccacgcctagctaattttcatatgtttttagtagagttggggtttcaccatgttggccaggccggtctcgaactcctgacctcaagtgatctgcccgcctcagcccaaagtgctgggattacaagtgtgagctgctgcgcccagcccagaaactttttaatagtgcttgaaaaaccataaaaagctcttcaatttgattatttttgtgatttaacttctcagtggtaagaatataccattttatacctccaaatccactttaacttatggaagaggtttctacctctttgtaaagttggttatcagcccttgtaagtaagatcgtacaccttggaatcacagcactaggtcattcctgcccattaagtatgaggatctctggcctcaaccctcatagacattggtcttacagcaatatactttccacaaaatgcaatatatgtaggtaggtggatagacagataaacagatggataaatagatgatagatagatagatgatagaagatagatagatacacagatacatagatatatagatactcacaataaggattctggtgagagtgtcctaccgaagctattacaaaatatattttttaattttttcttactatactgccaactagatgtggagtttctagtacgttggagaagttccatcaatatagaatgatgaatgcaatacaagcagattttggtttcagtcagacggtagcaacaaaagtacacaaattttaacaattaaatacctctaacagatttcttttgaagattaatattttattcctggaggcattatatataggacgagactttcaaaaataagttttaggaccaactggactttgcccaaatctgggcagttttccagctaccttaaccctccatttcctcctcaataaaatgggaagagttgtatacctaccttacagtttgtttaggaggattaatgaagaaaattcatgtaaacagctaagtaaaatgactaaaagataaatccacaataaatgttagctaataccatcatcatctttgtcattatcttcactgttttaatcacatcctgaattcactggactttcaaatggagggcagcttttcatatttgctttcttaccagtacaggaagatttctctaattttaaaatgaggatgttaagaggtcttattgagcaacatcattacctgaggtccaatggctgggatacaggatgaccaggtgtgtcactaagcgctgattctaggaaagggagtctccaagttgatcaagtttctaaaaggagctgataaagctaagtttttaagacagcaaaaacaagcaaataacgtctttaaattattgcaatgccatgaagttatgtctccatgaaatatagcagatacgacttttgagggggcttgagtttaaccttcagaatgctgaaagttggtgaaggttccttgctggaaatggctactttgagatggtagaactgaaacaaacaatgagaagaaaataggggggcctcctcaatgcattattgaaatctaaagagctctttgtattctatgaatgtagggattatctttttatcattccacaaaattaaagcttaaaagttctatccaaaaacctagctgtggagaaatcctcaagggtctcccattaacgtggtagccaggaagtacacaggattttaatcaaaggccagcggctgtctatgtgacacagaactaccctcacatatagaaccaatatgtgaggttcattcctttcttcacaattctacagcctagctgcacaattgcctattttgtctatataatctcatggaatgagttggcatacaaggcaaataagaaaccacgggaaacctctgtccaaaccttgcttcgtgcctgaagttcaaatgtgtttggttaaccttctattgattccttctctttccttcaggtgacctttttggtcttagtttttgccatggcatgccatggcacacagtggctcaatgagactctggcaccaagtgacaaagaaactcttatgagttgtctatgaattatttcattcatcaggtgcacacattggcactccctttaatgccgccacccctgccactggaaatggcaaaaagtcagcccaacagataggtacttcccaccctccaaatactgaagccaaacagtggatggtgaactccaatctttgctttctgttcaattgttttcctgttggatagtcggaactgcaattcagactgttgaccctggaaaaggcagctcattgaatcagtaccaggatgcttttcccatgtaaacagataagtggaggagaatgacgccatgcattgcacttgatcattaaattgcctgacatgaaagtaacacggctccatcacatgccgtgtgaccagtttactaacttacccttctctaggaagcagagtaattaatcatcattctgtgatagtgtatacacattcctgccaacaaatagggaagtgcttacagagggcaatacttctaagcactatgaaacattagtcatacatctgattaaagggtatagtgatcaagccgaaaacctagtagatggttaaactaagaacaagcacgtcctaattttcttttaagaattaagtcagtctttcaagcgcactgtgaagctatgagaggaataagcaggggacctgcttggaaatgaagtgagaaagcaatgatgatacgaatgaagacaggacttgattttcagcaacaccaacgtccatcaaaggaaagtacctgtgaatttccttaaatgacttgctggagggcattttgtggtaactataatactatagccactttttttcatcaattagtattgttaaagagaagcttgactatagagttcctaacagcagcaaaaaataaattccctccaattaagtagtctaataagctatttaggattttaccacttaacattctttccttcccatttaattttggctttcacttggatgtcatcttgttgaaaatccatcacagaaaactatgtggaaaaaaaaagataatgttgctaagtgcccctgatgttcaaaaacaagtagaagcacaatattttttttaaatcatcccaggatttttcctaataattcagcttcttcctactataaattaatatatgaaaatatatgaaaatggtcaatatgcaaattcaagtatcacactagctacttgccttcagtaagtgctatatgcataaatttgaaatgatacaatattttaaggtccttgattataataatgccttggtgtgcatatgtgcatgtataattacattcatttaatttaatcatgaaaatattataggatcatttggttttctcctctaaaagttctcttactcttttcaattaattaatttcactctgcccctttataagtcacctaatggtaagtaatgggttttgagctgaacagaatatggtcacattcctctggaattaattatggacagaaaagagacatgtgggaaagtggtggcctcttgcctttagcctacatcctagtcatgaaacaatgttatggcttttcagtcgaacctggtcctcaaaatattcacatttcataatcatttcttctacaagtttccagtgtccccagtgctgagaattcgcccaagggcagtcacctgattacgacagaagagacctggaaaccagcccatgtgaccccgcattccacatgcttgactagagtggagcttttgggactctgcatagttactggaatcacatggaatataacaagggaaacatgggggtggaggacatttaacattctccatgcactaggagaacagataacgccccagtaagtggaaaataaaaatgggccattttgagtggaagggaggaagcataacgtgaaggttatgtcttaccatccttcccctacaagaaaatcttattttccctctcacagaaaatctgtatttcttttccccaacatgctaacagagaccggtgaacagaaataggctgctttgtgtccatcaatagaatctatatactatcttttcccccagggattaattcagcttttgattaaatctttctgagatttaaatcatgatgttacaaacctccaaggaactcctctatgagttgtgaccttctttattactctctgccgtttgataaagtacaaagattgatttataatggattgtagtgtgtttgaaaacggagtagcaacgaaaattgcaaaatataagattaatataaatattgcaaatggaatgttttagttaaaatattctataactaatactgagttataaatgtgtagctagtaacactacagtcgagtcagtatagtaacgttattagggctgtaaattatatccaatgattagctaaataaacctacaaagaagagaaaaccgacaatgctaaaaaagaatttcaattcaatatcatattgtatacagtttagacagatttggtttggaggacttttgaattgagacaatctttttttaaaaaaagctatatcaaatgttatttttgtcagcccaattttggttttaataattattttgccattagtatcaacaagaatgaaagtgagtcaatgttttgaggacaatatgaaataaatcctttatctcaatcaggatattccagtaccaaactagcagctactaatgctgcttctgaaaatccctcattttctctccgccctcaaaagacttgttaggttaaaaagttaagcatttagggaagagttctaatgtccttgctggttccaaccggaagattaaaaatgccttatgcaatttaagcaacaatagaagacaagtcaggaactgagacttatctattgaaactcaggagtgcttggtatccacagtggcagataaattcagtatttgggtaagataagataatggtagatttttattttccatttccataaaataaataattgatgaattttatattggtataaaacaatccatggggagtgtatcttatgttatttagcagatttcaatgcacttctgatagctcttatcacatttccaatatttacaaacactctttttctctctaggagatggaaatgatggaatataatttagccatctttccccaatgttgcatatgttgagtcttgcaatgcaaatgattggcaatgggagcaaccatttgaaattgggcaagggcattctctgtcattaggaccgtcatcatctaccagccacagtggacatcctgacagcacgatgtgtcttcagctatcagctcatcccatatttaaccaacccgatgacttccatatgatggggaactgcatcctgttacaagtcttggagaaatattcagtccatctacaacaaaatcgctttctatactgaatattcagtgagttttttccctaggggaaagagcttctacttaaaaatacacacttcccagggttaagtacaaaaatagagctaatccatttgatacaatcccctgtcatttttcacctctgaacgttcgttatagaaaccaccacgtctgcctttgccgtttagaaaaagacaagatacagaagatgcacgttaccttagagctgaaatgcatccatgaatatggaaaagcaaggagaaagggaaagagagccagagaggaaatagaataataataagcgagtaatgggtactgatctgagaaacatgccaggagtttggttacgataaataagaaaagcagaagtagatttgaaacattcgtttccctttattagctcagtgaggctgatgtgtactgcacatttaaaaaaaatcacaggaattttcatacaatgaataaaaccacaacaatacatgtagaattggcaggtggaaaaaaggcccggcaagggctcaactaatcgctcactttccctcttcagcatagttcaaccaacagtattacactttcacctacaaatcttaaagtagctccatcaaatcagcagttcacattattgaaaatgtctgtcacataggtacaaatttagaatcatcacattatagtacatggctattctaggtcatctatagatcaggtcttagactacagtgattgaagttctcattacagccatcaagaaaggacacataatcattacctactggaagctcacatctaaaggcatgaaaaggtttccttttatcaactgacccaaacatcataccccaatagtgcaaagttccctctctgctgctttgaatgttgacagcccaactgttgttctcggagtcgtttagcaaaaaattgattttgttgcactggaagaattattctgctacatctcttttaaaaaagaaaaaaatccacattactaaagcaccagttcggttaccaaaattgtagatgtggtacttaccacggcatgaaggcaatggcccacggtcttctaaaaatcctacagatctatgctgaaatttgcctccagtgatgatggggtgcacgtgttcatttgaaatattctctcccaaaaaaataaaaataaaaatgagaggagcacagcttacattttgatgggctacccacagtgtctgcagaagatacaaaagctccactaattctagatgcaatttgaagtccattgaggaaaactatcttcatggtaacaatatttgtcaggctgggggtaggggggataaattaatcctcaatatgatatctgtagtgctgtcttttgataagtaagaaaagaaaccaagtattccactcatgtcaacaatccagggcaaaaaggagaatgtatttaaaattggttcacaaaaatttaaaggcaaaatagagaacacatgtggtccttgaacacataataggatttactaaatctcgatttcttaaaaataatttattgctcttaatagtctttttattattattctacaacagaagatactcaaaattcagaaagaaagactgtaaactttagtttggcgttcacacagttaaaatacctgcatttaacctacagaacaacaagaattaggcggattaaagatgtgttactgttgtaacgcagaacctgtgaacaagttctttcatttcatagtatttttattgctttctatctacttagaaataagaagccaaaaaatcaagcaagcatccgacaggacaaacagtggattcactcagaacacaatatgctggtgataaatgaatgcagctatcaaaattagctgcattggcctgggggtgaaatccatcttacaagatcgtgttgggcgagagaaaggaaaagaacaattgagtagtaggtgtatcatgtcttccagaaaagtcatgtcagccaaacagtaatcgaatctcaatttagaaacttgaatacacactccaaatgttactgaattccattccagggactccacactcagatgaaatcctgatgatcaaaatggaggtttttctgaagtttttattaaatttagcagaagcaatgtcatcaagaacaacaccatggtcacgtcagaggccatgctagtgcaagtagaaacactgcttctgcaaaagctgaatttcccaaatgaagcacttacactccaacctgacaattgtcatgcatcctaggtagaaaatttccactggctttattattttcatcatctcataatttataataaataggctatctgcaactgataaatatgtctctttagtaaacaaaggaatgaaatatcagtatttatacaggatgcataactgtaaaaaatacagataaataccatcgtcatactctgccaagggaaagaaatactggcttcaaagatagtcttcagacacacattaattattgtaaaaatcatactataattattacctcagcattttgtatcaaattaaaatcacaaaaattaaaacaaaacagcattttaaaaagatttttgacttctagtttcaaaactactgttgatagagaaaataaaaacatttcttaatggttacccattgagagactttacataaaatcatgatatcttctagaaaaattttagatgagaaaatttcattcccctaacaaatccagtgtataaaacttcaaagaaaaacaagcgacaagaaaatgtggaaaaatatcgcagaagtggttaatacctttaggggactaggatatttcttgacaagatgcttagattgaagctcacctaagggatggatgtgcggaaagcatcattttgctcttgttgcactcaacagacacacacactgtctttttgtttttacaatcaaatatatataagcagtaagttcagcttctaaatatgttagtgtacaataattgtttcacctcataattacatttgaatattcttgattaagaaaaatttagcagttttgaaaagaaggctgcatttacagtgcatagctgtaacaaaaaagaacattgttgtatagtatatacataaaataaaaatactccatttaacatctgtaaatacttaactacatcagagaatgtagcaattacactatctgaacacatctcagagagttctacccaactctcattagtaatgtaacccggtgtccgctcctcagaaagaaccgctgaacaagctgcacgcttgaccattgacaaggcttttgaaatttgcagtggaagatcaacattttggacatttacatgggtgtcaggattaaggatgaactacagaaacttcaaaatgttaggaaactttagcattctggtgcccgcagtatcctctcccacccagattccatggcaaaaggaaaaagaaaaaaaaaagagagagagagagagagagagagagacaggatattagttctatggaacctgtggtttcttcaggattgtcatataatcattacgttatgagagaaagcttgcttcaagttgattctgcactttcttaaaaaaacagagtacaaaggctgatgcccagacatcagcggctgtcattttagggtggtttgtggttggttggttggttggttggttgttagttttctttcctttttaatttatatatatatatatatatatatatatatatatatatatttccttttgaatagaatacgaacattttgaagttctaggttttaagcgtgtcttcatggaactgctgccatttgaaatggtttgcccttgcgcattctggtcaggtgcccccagtcctcacatgtacccacacatacttcccctaaaccaagcacacacaccacacacatacatacacacacacatacatgcacacacgcacactccatcaccaagagactccaggaaaagcaaagctgacacccatgaataaacatgtgcttactggatatcattctgtctcttgcctcttcagcagctgtgttcatgtaaaccattgttgttattgttgttgttgttcttgttgtattgttgttgttttgttttgtttttgtacagagagtgtaaagtaggagaaattcctaagtatgacttgcaatagtctttagggaaggacgcgctgtcccatgaggtattcgccatccctctgtcatcctcagctagggaacatgttacctgcgcaagcttctctgagcttctttcagtaaactatcaaaatccagagagtcatacttgctcttggtggaagcagggtcaaagtcatctgagtttgaatctgaaaaaaaacacaagccagtttagatacacactttgctgatggccattaactcaatcattccaattcaagattactggattcgataacaactcttccaatcaatatactttagaaaacaatagtcagattttattggatatatatggatatataggaagaggatggggagtagtgagctttcaaaaacacgcacctgttgactcgtttaggcttaaacaccctgggagttaggcagagcacacgttaatatatctctggcagataaccaccctccccttcccccgacacgtcaaatgacttgcccatggttcctcaataacttagatgtagacgtgagagtacaagctggaactaattttcctattcaatgggattaatttaattgagcataaaatccagtagagtatgagagaaagaatcatgagaatttcccctaaacttcaacctgatgcttctctttgaggcaggaggggacatatgatgtggtcctctacttccgtacctcttggcctcccagaatttttggtgcaaattctccccaaattggaaggttgagagaaatgcttcacatcccaggagagtaaattcggaaagaagaaataaagtgcaggtataaataaagccatgcccttcttggactcttaaactagtccaagtaagcttttgagcagtttcactgctacttcaaatagaccttaacaaaatagatatgttttagcaatatagaaagcaaagtaaaattctgttaaatattcctggtttttctccattgacttctatgaaaaagctagatatttctgctggtcttgcaagtaacaaaggggggcttggaaatataataaaaagcctcttataaatacgttaattcttttgaaaacatttatttgaaggaaaacaaaaccattctggaaaactaacaattctaccaaaatacaagaattcccatgctttttcccagagtaaattacaaaatcgaaatggtcaaagtaatagaaggatataatactagatactacagaggcataatcgttgacctaaaatgttgttttgctgacaagattgcaaaccaagctctctagctccggcctgaccatcccatttccaaagtttcaatctacctttacatacctagatttaaagacaaagaaatgtctttatttatgttttcctttcattctgatcacctttggtctttactgagtttttttcagcaagttttttaaggtaagagcaacgagaacaattacagtctcaatcataaaaaacggagacaaaactggccaatctttcctcaatagcatcttaaatagtcaattcttaaattacactggcttcaacgcttctcttcataggctaatgaatggttttcttgtattgctaaggcctcacaaacaactgctgttcaaatcaaaatcttttttgtagagacaaaaaaaaaaatgtctagctcattgctagagattagtctgaaatcagaattccacttgcattgtagatcaagagggaagattcccccagtgatggagtctgtgtgataaaagtcagcctggaaccatcagggacatacacacatacctttccttgaggaactctttgagaatattttaaatttccttactttgcaatattctaagcaaactctagaatttcagtgtttctgtattttattagcaaatatttaaaaaaattgtgaaatagtagttctcaagagtttcttcactgtgaaatatagtgttcacatatatacccacttatacaggcacactgttactcagaaaacaaccaaaaatattttttgttgcatgagatagaatgtggttacatttaatttctgaggcaataacatctactccaccaatttctctcccgctaatgaaaggatattggagcacagtaagatataataaaaatgttataggtgtcaggcctctgagcccaagctaagccatcatatcctctgtgacctgcacgtacacatccagatggccggttcctgccttaactgatgacattccacaacgaaagaagtgaaaatggcctgttcctgccttaactgatgacattgtcttgtgaaattccttctcctggctcatcctggctcaaaagctccccaactgggtaccttgtgacccccactcctgcccaccagagaacaacccccctttttcctttacctacccaaatcttatacaacggccccaccccatctcccttctctgactctcttttcagactcagcccgcctgcacccaggtgaaataaacagctttactgctcacacaaagcctgtttggtggtctcttcacatggacacgcatgaaaatagtaataactcaagccactctaatttttcaaaataaattgttagaaataatgatactgtattatttgaaacaaatcacatcacacttatattcccagcacctggaaaactgttggcacaaaggaggcactcaaattaatatttgttgaaggaatatactaatctcaaacaccaaaatattattaaaaccatggttgaaaatatttatattgggatgtgggaacgatttatcaatgaatggcaaagaaatacataaagttacgtgtataatcaagaatactgataatacaatacattcatttcagttaatgaataatttataatgtatgtgtcatttatttttttaaatgtttaagttatgtaacataactaattcctaatcaaaactattacattcataatactgacccatctttctgtttggatcctgtagtcctactttaatttctcttggtctttcccctctgattttttttcgttgaggtctttagaaagatccatttgcttataagacagtaaatagaaagacacacagactactgattcatggcaactagaacttaaatctgggcttcactgttttaaccttgatcaagtcattttaatctctcactctcatttataatactgggtcataaatagtagctgaaatcgttatgttttgctctaacaatattgtagtcaccattatctagtttcagtagtagagaaataggatgtataagctaacttaatttgggggagcaagtaaacagaaagaaaattggttaaatctatctagaatgataagtaactttcctgtcttggtaaaactaatctgtgtcacatcatttttgctttactattgtgacatatgtgtatgctcctaacccctgagtccagtatattcttatgccctgaaatgtgcatgaacactgaatatggtgagcacaagaatatttgaattcttcagggaacaaagacaagacacaggaaaaatgttttgagttccaaagctgattcctagagtcgattcttccattttaaaacgactttacacttctaacttctcattcccatcattttaaattataaccatagccactatttattgagcacctatgttatgccagacacgtgctaatagcatcacaaacatttatttaatcttcacaataacactatatggtattttacaaatgaagaagcagaactgaaggggttgaattctttgcccaacggcagtggtaagtcagatttcaatcccaggtctgcgggattccaaagcctggcctcttcagactatacaatgatggagctcagaaaaaaactacctttgtgccatcgtacagcttgagggaattggaaaaatccatcctactacaatgcacatcaaacatacttttcagaaaatacagagcgagcttagcaatggcaaagtttctattgctgccggctaggcagggagataacgagagaggaagcatccttcttagaaatatttcaaggaggctccagttcaatttggaaataccatccaatcctccctctctaccagtgatgaatcgtgatctaaaggcccctctaggtagcttattttaaactctagatgttttgagagactagaaacaccctggccttcatcactgaagaaaataagtcaaatcaactcaagacttcaatccgtcttgactgtttttatcagccaacatttgaacaaatgacttgccacattctatattttcatccctagcctgctatctctctaacagtcagctgcctctccactgcttcctactatctatttagcttgtggagtgaattatagcatattccctgtgaacaatgcacatcacctgtatcaattactctaggaagacatcccttcgttggacagaagaaaaaaaatccctgtatttgtatttgtttccttctttttaccaacccagagaaagtgcatatagatatctaataatgatgaggactagatttatatgttaatttcatgataaatattacaaataaatttaatataattatgtcatatgcacaagacacttatcactttccttcctcaaagaatttaaaggcttactatgcacacattagatggggaatgacatgcaaaggaacaaaattaaaattggaaaggaaattaagatgtccattttagcattatttataatattgaaaaattaaaaattaaatgtttggctataatgtaatgactaaatataatggtactattcactcagcaaaatactgtacaaccattaaagtatgttaataaattatttttaatcttgtgagtcacagcagaacacgaatttatatattaattgagaaaagtagaatttggaagtttatatatatataaataaatatatatataaattcaactgtaagaaattagacatgctgagacaaaatactggaaggcaaatcacttcgttggtaatagtggttattcctggatgacaggctgatacatgattttaatttttttcttaatacctttttatatttaccatattttaccccttgagtctgtacagcttttataacaggaaaaattaatattatgtatgcttcagtttccttatctgtaaaatggggatgatagtaataatatacacctcctaggatagttctagtaattaaatggaaaatgctttcaaagctcctggcacagtgtctggcatatggaagcactcaacaaataacaggtgtttctttctttttttttttttttttaaagaaagcagagtgtgatttagtatatgaaatttaattttcttctctcttagttgtagttcatagaaaatgatgatatttctaagtgtctgtgaaataataagagaaaatgagacttgcatattctgttccataaaacaatgatggcaatgctatggttcgtgaaaggattcagggtaggcctggaaggcaaaatcaggttacaaacacacacacacacacacacacatgaatcataaacacatgtagacacatacaatacctgcatacatacacacacaaagacacatgatagccacacacatctgcataacacacgcacacacaaagcacaatactacacacatacatgtttaatattcacacaacacacacagacacacacaatatccacagagatacacacaatacatgcactcacaaaatataaagctgcatgcacacacaacacacatacagaaatcatgaacacatgtggaaacacacaatatccacatacatacctaccacaattttcagcacctgagtagatagtacaaagaatttacttctgtcctttcttgccaaaacctaggcccctttcttctgaaactgtcttatacgtttttcttaaaaatctgtattcaaacattccctttagtaaaataaagtgatggttcaacccaaggtgcctacggattatgtttgttcccatcttgagctctacattatggattcctcattccacgtacaataaaatccatacctaggtctgcatagttagacttgaaaaattgcttgcgtccacaaaagtacagctcaaagtcagtttcgtttgacctgcgcaaagtgtatccattttcaagagcagcaaaagcatcacaggtataacggtaggtaatgaaaccatagctgtctctgcaacggacaaagaaaagttcaaagctggttaagaagtattagtatatgggactgtaaccctttctactttgtgagacttctccagtgccaacgtctgagccactgaatccatttatcagtgtgattgtcctgtcaagcagctaaatacttatttctgggacaggaaatctcaactagaaagattaataaacagggatgaaagaaaataaataaggttctgaactcaacatgtcatctgtcaaagcacttacattggcaactcccatcccagtaatcttatggccataattttttacatacgtcagcttctaaacaagaaataatcttgaagattctcacccatcatcccgcagatttactgtgcactcctcaatttcaccaaaaacttcaaaacggtccctcagttctgtccgtgttgtgtcaggtctgattttaccgacataaatcacacggcgctcttcctatggggggaaggaaggagagagttctggagtgggaaaaaagctagccctcggccgggcacagtggctcacacctgtaatcccagcactttgggaggccgaggcaggtggatcatgaggtcaggagttcaataccagcctgggcaagatggtgaaaccccatctctactaaaaatacaaaaattggccaggtgtggtggtgggcacctgcaatcccagctactcaggaggctgacgcagagaattgcttgaacccgggaggcagaggttgcagtgagctgagattgtgccactgcacttcagcatgggcgagagagcgagactccatctcaaaaaaaaaaaaaaaaaaaaaaaaagctaaccctctagaaacattcataaatgtacaatcatgcataagaaaccccactgagcatggcaattagagcaaaacatacactacaatggaaggaaagactacatttgaaccaagtattaattcccatttcttcagtatcaatctcttcttgctcacatagattcttctcttcacctctactcttttctacctttcctatctgtctctgttctactctcagatgaacttgatgtgttagaaaagaaatctgtatagtgcattcttttttcaaatcatggaacaatacctattaaatatttgaacatttgtgacttgattatgaatcaaaattgttatgaaactgacctggcttacaaaactattacatttctcattaactcagaattctaatactgagatgaacaaactctgacgtcctcaaaagagtggttcttaaactctactatacataaaaattacttggggtgctgattaaaaatgcaaatgattgggctttatctagttgtactaaaaaaaaatgtaagataaggttctacaaccttcatttttaacaagcacacctcagctattttgatgcaggtggtccaaagacaataatttaagaaatacagtcttaaaatgtaggccattttaagccatgagtctccgaagaataagagctaaataaaagaggctataaatttcactttgccaataaatctagtcttattttaggaacagactagaggggtgtggcctaattttcacaagtggagtcaatatcatcatagtctgaaagtcatcagtaatttataacctacaaaatacaggaataatatttatagcctgaggataaattctttttttacagcacagaaatgcattcttagtgtaagaagcaatcctatacctcttgttccaagaagataaggccaaaagttatgatgtctctcaaagttttaagaacataaggagttaatataaagaatgtgctcaccaactagtttgtatgtatactaaggacaaacaatgataaaatgaatttaaggttgcagagatttaagctaggttgaagcaaagactagaagcagagaactgaggtacagacttagcttgcccaagagttttctttggatgtactgagagtccctggtcttgggtgatgaaaagagtaatttggactgaaagcaaaaagatgccctttcttatttactgaatggttttccttttcttatgcccagtatttggccaagaatctggtaaggagtaggcacccgacaagcatttgtgaaatgtaactgaacaatttgcagaccctttatcttcctggatgataagcttaccaatgtctggtcttattctaccacatgtaacatgctcgcctctattttttattaggaaagtaagttcatctgagcctcaggtgcaaataatcaactgtctacttgacatctcaggttggttgtgcctgaggaacctcacactacaccaacattaccgaagcccgaccctccagccttgccctctccccatttggttctttcccaatgttcttgtattagtgaaatgaacaccatctagccagttatttaggacagaaatttaactacctccctttactcctttctcttgttcctctccacatgtctaaccactcaagtcctattaatttttatcccctaaatctctctgtaatctattttctttattccattgtcctaagccaagcctccagcttctctttctggactagtataacaaacaatctcctaacttggatctgtgtccatgtttattcttctccaatctattcttccattgttgttaggatagtctttgctaaggaaacaggaatccaatgacgtccattaacttctaaaatattccaatggcttctcataacttttaatgaaagacctaaatcattaacaagacctacaaggccctgtatggtctgggcctgttgtcatcatgggctttatctcttatatcgcattctttctgtgactctcttttccagccacactgagcttctattagtctagtatatactgtgcaccttccttcccaaagcctttgcacatgctctttccctgctactgggacaccctattcacactgcaccactcccaagcctctcacatacacacactgtctacaacaaccttaagctcaacaatcacattttttctgagacttgcagtgaggtcagaattcctattagttgctcttatggaaaactctcctttccaattgtaattaatagtttatctactgtttaatgtccacttccccaggataataaaagcttcatgacagtagagaccatatctgttctattcactactgtattttaaacaaagcatcaaaacataacagactatcaatgaatatctgctataaaatcaatcagttactaatcaattaatcatcttgaacacttatcccattcccttcattacatcaaagatgcctaagagtggtccttcttctctgagactctccaatacaaaggagaagggaagttagatttggtgttttatcacagaaaaaaaaaaaaaccttgctcaagtagctcagctgagtgaagaaacaaagatttccataatttgtttttacagatttaagtgtaagaagtagctacatgtttgcaggaatctcactcataaaaatcacctctgaaaatcaaaggtaggagataacaaacagttggtaaaacagaactctacgaacaatagcattgagactaaataaatgaccagatgaagcagagtaaccagtgcaggctgcctgacgcccttccatgtagattgtatgtctcaattgaaggctgtgattgtgccacttcagagcaccgagcacatcctggcagtcagaaagtagaaatggatgaagaggcacatcccagaccatcgatacacacttgagcaagggaatcataacaccacattccattctgtttatgcagccagctctagtcaaacagccaaatgtgatgggactgctatctaaacttaaatttcctggcgcctgctttcacgggtgttaaggaatttttttttaatgagccttttagaaaagttactactgtatagagaggagggggaagtgcagaagtgagagaaagaaattgagacattgcaaagaaattgctcaactaccattatgggaataaacacagcctatgtattcaaggaaatttgaagttaaagcgaaaatcgaccatatgtatgcccatatgcagacatactgggacagtctctgaattgcagctttatacgaagttgtatgcaacaacgatcccatacaaaatataaaccagaggaccttttataatggatactgatacattctacagtaaaaagaagatataacctagaggggagaaacaggaaaccgaaggggtgttccacaattacttgaattacctatttttctaccatctctttttatgaaacacaggaatggggccatgcctcactaccttacaaagatcagagattgaatacatgttgaaaggcttatttgagaaaattattgaagtgcttgattttcctactgctaaaaatgaaaataaaaggcatccaaatgcctagaaagcaaagacaaaaatctttctaagattggccaaaatgtctagcaaagaactgattcttttaaacatgttgcagttgtattagacagatgaatagatttcatatctttaaaaaagcttaacatttgcagccaatttttcaagacattaatttctaaacaggagatgaaaggaaaagaaatcaaaatgcttaatgacattttcaacttcttaaaggcttggaggaactctaaacctttggaaacagctcctcgaaaaatgattttcggaccagttttcactattgaggaggatggtacatttatcaaataacttttagcttcagttttcataaaagctagtacgctgatggggtggataataaaattgaagacttacattgcattaacatctatagtaaatcctcactacaccaaaacgtgggggataaataaagaaacaagaaactgactgaattaactgacttcacattactaaaatctttatcaaaaagagtctagagcttcccagttactggaggaaaacatacagtggttgtttctcatcaaataaactactcctgataaaaggggtttgacaaagaaaagacagaaggtagtagagagatgaacatttgttgaactcttagctatgccaagtactgcatttaatgcttttaatgggtgatctctctaaaatgtcctttaaggtaggtaacaaggaagagcttgatataatgtagatttcagctctctacgtttgcaagtcagaataatgtaaaaatctttttttctatgctaaggaaactacatatcaactttggcagtgaaatactagtgttcattcctagattagctgtaacctgactgcctcaaaaattgcaaagatattataaattgagtgtatggtgtattccaactaaaagaagaggtgagtggagtggagggtcatggaaaggtacagatagaaagatataccaagattctaaaaaatgctgagaagtgtttttctttcttgccgttaatattgattatctaacctaattcattaggtagtcaataaatgcctactactagggggtgttcttagagaaaaaacaaaattgtagcattaaatttgtccaaagtgtcccccattcacgtaccgtgtgctactatccctgcttagtgtctaagtctggttaatgtgaataagtccaggttagtctatttaaaaggtaagatgcaaataaaagctaacatgcaagtaaacatactggtaagtcagaaaacatgaaaattatagaataagagtatgcataactactttttaaaaaagcttcactgaagcataattgatatatcaaaaaactgtacatattaaacatatacattttgatgggtttggacatatgcctatatccttgataccatcatcacaatcatggtactatatgtatccatcacctccaaaatttccttgtgttgtgtttttttcttttgtgtgtgtgtgtgtgtgtatgtgtgtgtgtgtgaataacatgaaatctatcctctcaacattttaaagtgtacaatagcataattaactataggtactatgttgtatagcagatctctataattattcatctttccataaaactgaatatttctaaatattgaacttagagtcacaatataacatatactcacccacacaaaatatctctttaaagaggcttgcatagaaagctatttcattttctccaaaaaagaataactctgagcactttgggaggccgaggtgggcagatcacgaggtcaggagattgagaccagcctggccaacacggtgaaaccccgtctctactaaaaatacaaaaaattagccgggcgtggtggtggatacctgtagtcccagctactcgggaggctgaggcagaagaatggcgtgaacccaggaggcggagcttgcagtgagccaagattgcgccactgcattccagcctgggagacagagcaagactccatctcaaaaaaaaaaaaaaaaaaccctgagtaattgcacaatttttttcatttcatttggaagaagtttataattatcagcagtactacactgtccctggcttctgagctggacactgaccaacagagaagtgaagcagcagtcattgccgcctgagcacatctagttttggttttgagtgctgagccatatcacaatgtctagatttgccctttaaattaacatcccattatcatgttttctggcagaaaactgtacagattgcaaatggagttggacttagaactccacaagaaattagagcagtgacagtttagacactaagtactaaactctggtttgcagagtcccaatataacctgaattatttcaagcttacgagtctgagaaaggcagaaagtgaattgctttttgagaaagagtcaggatggaaattacaggaaagtgccaactgaaacaatggtaacattcaaccacaatataagattttgcattggtaattactaattattagtgttctctttgtttttggatttggctcactcaacttgggctgaattaggattttagaaacataagcaatgaaaagtttatagatctcctaaaacacctcctacttatggaactcaaaatagaagtaatgcagacaaaggttaaaaagatgactttaattttgtaaaataacaattattaaatttctgaaggttttttttttcattgccttttggagtctctgtttttctggttccctaaatatatgattgctttgattaatgaacaacccaacactgaccccaagatatcttaaatgtaatttgcttcttactcattactttaaggttgtttcaaacattgaaagaacatcatgtacctgaccaacttaagtctggactgtccttgttcccttagctcttctatgtatgaattttcaagctaattttttcaaatcagttaaaaatcattgcatgtatccctgcactcaagtccataaaaatatactttggggatgcattatggtactagaaagctaactatttggaggaagggaatcaataaaaaaaattcatgtaggtaaactcattaaatagttccatgatgccttcaagatagctttcaaaatctttagcatgaattataggaccctttaggctatcttccaccattccctctagacttatttcttgcccctcttgtgtctcagtgttccaattaaacgactagtagtttctcaatataccttattcttttttagagacttagtataagctatagccgctgtctaaaaaagcaatgtccagtaatcatacaatgcagtatgtcatgtaaaattttctaagagccacattttaaaaagtaaaaatatgaaaaattcaatgttaataatatattgtattggtctcaacatgtccaaactattatatcaatttgtgattgatataaaaagataaatgaagtattttacactatttttttatactaagtcttctaaatccaatcacacagtgcatcttaatatggcccaatcaaattaaccgtgtggctaaaggctaccatattggatgctgcaggtggagaaaatctttgtcctttctccctttaggatttggatcagtcttataccctctctgaggatgttctccttcatatatagatctggatgcccccaatataccaccccaacagtgccacagatgcaccccttataatagcacttatcacactgtattgcctgtttgtgtatttttatctgccagtatggttgaagctccttggatacagggacgatgtctttcctaattttatatcccaaccaaatggcaaatatttattacagaaagagctatgagctttcactcatgttcaatagaaacagcatgtaattgtccaagtggaaattggttaaacagtaagtcccaaatctttattaagcacttatcacttatagtccactctgttggtaaacaatctctatgttctaggtttccttcaatctacttttcaaaaacaaaagcgaattttaaagccaaaattctcacaaatgtctagttaatgtaaaatgatttaataaaaatcaagttgacacttgtattacaagtgctctttggaagagaactgatacagattactttcatctaagaattaacagaggaactagtcaacatttgtaacacaaagggacaacagggtagcatctgcttccaagctgaggctggtgaccctcagggtgattttgtgtcatctagaccaatgacactacttgctctatctgtaaagggccgaactagcaacaaaaaagacacctcccttcctttctttattaatatctggcacttaatcatctttagaaggcataaaataaacacatcatttatttacatgcttttgattaaaatattaatctggctttagttacaactgtgttgtgtcatggccatataagcaaatttatgatgaaactattaatctttctctttaatgtcctatttttgggggaaaaatgaaggattttataaaatataaatttgcaaacaccaaaataatcattttcctacatgttcgctcagcatgattttcttttgtaatgattataatgtgccatattaaaaggctttgtaaattatatggcactatataaatgtgagttattataattattgaataggccattaattaaatacagtgatattagaaaaattgaattttaattttcattagtcttcgtaagtgttaactaatgacactttggcaaatcttaatatcactgctcatttggaagttgagaaaaatgaggcaaattgttgtaatttgcaaaatgcctttgagtcagtcttaggtagattcaaagttaaatggcagcaaaccctccaaaactttgacctaagtgttcagttacttctcacttatttctccttaagtgcctgtgttgaacaaatctctcatttaacctttttcctccagctggtaactgttggccaatgcttgattttgattccattagtcagctcttttatatagcttttgcaaaattgtgttgatgttagtgagtttttttaaagataacacataaatctaacctttacagtcaaaaatcatttccctaagccttggctagcttagatgcaagatatgtcaaaagctgatcttcactgagctaactctgagtggctagcacacagggagcagctgcactgaataaaagcagtgctatatctcattgattagtcatggctccctagagcatcatgtcagaaaagaccgtaaggctctgagggggctcaatgggaaagagttccattatcgattaggaatgtctgccatgggcatgggctggattttgacaactggactgacttatttttgccatccaaagtctaggttgataaacagcggtagggagttggggtaaagcctacccactagtcagcagctgctgaaaatgaggactgatcttcagacagcaaacaaatataacataacgtggatctttacacagaagggtcagcactgtctatatgtcaagttaatataataccccctggtaagtggtgctgaaatccataaaatgtcattgaaaagtagttcataagaaatgtgggtgtgtcaattacccagttagatgacgaccatcacgcagaagaaatgacttttttttttttttttttttttttttttttttttttttttttttttgagacagagtctcactctgtcacccaggctggagttccgtggtgcgatctcagctcattgcaacctccacctccctggttcaagcaattctcctgcctcagcctccctagtagctggtattacaggcatgcaccaccacgcctggctaatttttgtatttttagtagagacagggtttcctgtctcctatgtcgtttcctgtttcctatgttggccaggctggtctcaaacttctggccttaagtgatccacatgccttggcctcccaaagtgctgggattacaggcatgagccatcgtgcctggccagaaatgatgactttcttagcaactcttcctccactgctcctttaaatccaacttgaactcagtctcttcatggacaatttaagtctcctgccggccaaaaagacaaaaactgaaacgagatagcaatccctcctcattttccgctcaaagagagaagtaacaggaaacagaaagaaaaacttatcctgtgatcagaaagaacaaatatctgactgaaaaaaaaatctctactccctccatttttcaaaacagaaggtgaaaacagtaatgaacttcaaaatgaaactgtgagtgagaaatatactgacttaaacattttgttttccaataagttaggtcaatggggaccgaagacttatggatattttaaagccaaaaggctgaaaatggcctgttctaacaaagacttagcttttgtttattttctaatctatcaccaaaaaaagcacacagaaaaagaagaaaccctactttaaaataaaagtgagctccaggccacttacaattgccttctgcctctgcctctccctttgcttggccctctcagactctcgcttctcatactctctgcgatattcttccctcttcagcctctcgtgctgatattcctcgtagctgtcatacctgggaaacataactttatcactaagtcaaccacctcaattttcatgagcaaaatgaataataatatggggaggggtatagggttttggagaacatcttgtcatctcaaggaggggataaagggagctaaaggaaaatgacatgcctcattacctgggccgacggctgtagggcgatcttgaacgtgatctcacatacaagggagaatttcggtgcgtgcggtgtctgtagtggcttgactcatagtaatagcaggatctgcgccagaggagaaaagcaaaaagggcatttgcaactgccacttaacccaagtttatcggcactgtggagcatcctctgggacactgtattacagagactggctttttcttcccagctactagggagatttcccagtgacagtttgtgatcatctagtcaacttagagggctgggagtgatgtgctctctctcagcgtctcttattgatgttaacactgagcaccaggtctggtacactgtcagctttatcttgcatggatctccactatcctggcacagggcagctctccaggtaatggaaaaagttggatgagcaagtttcttaacaaattgctctctctgataggactggctcaaggcactgtgctcagaggtgacagatttaagagaacatggagagagatgtgagtgtaacaatgttctcgttagttccagcagtgccagaattgcagtggtcaggggccagaatggctgcagatttcaaatttttatttgtattttattttattttttacttcttaggaacaccttttgtgttattagggttttgccaaggtttaccttgaagaggatctactgcctggagaccttgatcttgacctggaatatggtgatcgggaacacgacctgtgtcgagaaaaggaccttgaacgagagcgcatcctttggggtctttgagaaaataaggatttgggtggtgacacagaatctctacatggagagttaaaagaagaacaagaaggagacacattgaacaatgaataggattgcgtgccatcccaagggtagctcagtttatcactttcatcttcgctgtcatcaaacaggccatccatggctagtcctgaatttataaacataggtagtttggagaattgttcattactgaaatcactgtccctcagttcaccggtcttgtctgcttcgtcgtcaaaaacagcttgactgggatgaccgaagtgcttgttcagctcggctcggatttcctggtcttggagctgttttcttgtgctgcaaggagagacctgcttgcttgcctccaaagtctctctcaggtagcactggtctgaatctgtggaagaacaaatctgcccctgccaatcagaggagacatctttattttctagttgtctagagtcttggagctcctgtgatatattaatgagtatttctgttttggaattaattgactggcaatagtcatggtcaccaaacagccgcagactgggccgcttggtcttcctttcctcgtgtccaccagtgaggactgaggacttgctgagttgtgcatacaactcggattgctccggccctttcttggtggagttattgccttgtgtaccagaagactcactgtacctgggcttctttgatggtggtggcaccacagtcttgcaagaggacttcagctttggagaagccctaaaagggttatcttggttggctttatgaggaggagtggtgggtggagttaggcctaaggcaaaaattaaaaaaaaaaaaaaaaagagagagaaagaaaagagacagagataatgttcttaaatgcgaagacacatgtttctaatttttccaagatttcagacaagggttcaaactgagtgaagaagaaggaaactaatttcatgacaaggcctgaaaaactgactcatcccctaagcctctgtcaccaagaaaagatggatctacagtgctgagcaggaggctgtgatcttttgtatttcaaacaccaatgctaacaaatcctgcttcccagaaaacatgaatgcatcacccctggcctgcacggaactaggcattattaccaaagcttgcattttcaaggggattgtatgggctgctttatggaaaattaacaaagtgagactgaggaatcacggaatagccttggtagcatttgtctgcaaagaacattgcagaggatgcaagcagctcaggggtctttgtccaatcaagagaatctacccttggagccaaggaattaagcaacttagaagaaaaaaaaaaaaaaaagatgggatgacaggaaatatggggcaatggtgagagtgacataagcaacttcaaagtaagttcagtgaaatacgacagccgaatgcagggacctagagcaactctacaacttaacggcagtgattctttgtcgccacagttcattaacctagtaaaccatggctaatgtaggtataatacattcttgtaagcataactaatacattctgtctaaaatatggttctgcaacagaaacctaagtgaacagtaacactaaatatcacagtgccagccgaccattttatatagagcacaacataagggagggttatgagactgagggattgaaactcagccaagcttcagcagctaactaattaaataaataaaaaggaagaaagaggaacagccatcagctgttgctctttctgcttttctataggagggcagaacatttcatcagaaaccactgtgggagagtccgtgaagcgtagtagtttcctctgttgagttttcccccaagtaagccctactcatccgtttgtgccgaggaagaaccattgtcaagtggctccagagtccaaggaactttgaagaagggcaggctggagttcaaatgagtttacgcttacaatggagcattttagtttacaatacattttctgtttaggaggcggggtgaataccattcagcaaaaagaacttcaagtctgctaacaagcctggggttagacttaaggcaagttgcaaggaaaaaaatgctaccttgctggaaaaaaaataaacacagacatacacaacacacatatatcgagagccaagtaggtcacagaaagccacatgagattttgatatgaacaggaagatgctgcctcactctcctactttataattaagaaatggaaagaatgaatgttttctctaaagtgaaatattttacaccaatatttggcaatttttattattcaaagctaattctccctgagagaagaaaaggtatacaaatgcaaggtggtttgacttcggagttccaactcagaaaatctcagaaagacagagaaatgcaaacacaaagtgaatgggacactgtactccactcatggtcacacctgagtctcaaaaaggcttccctttgttaacagctgctcttggatggctctttgcccttctctttgctgtagcaaaggaagtgacttacatgactgaatgaaacatctgtgccactgaggcacactcaactcttgtttcctctctcatagataagtatgtcttttactcaacctaataaattcctatttggtcaatcttatcttttctctccattttcacttgctttatttacgaattgcactgccttattcatgcatactgatttcttctacatgctaccttcaattaccacttgcaattcccagcgagataaaaaaaaaagcacattctcaaatattcctcctaggagcctaagatacttaaagaaataatgaggaataatctctctttgctgagtaaataccaatcaaatatgtccaatgacatagcccttgaattggaggaaatggcattcaacatcctcatatccaactccgtaaatctttgcatgatcaccccaagctagggtaatttttacttctttagtaatttactgtcaggatccctctattgataccaatcacatattactatacatttttgcttatctcttttcgaatgtgaattatgtcttgtctttccaaatcagttataagcgctttgcaggatgttgcttgggcacatttgttgcattattattttgtactaattttattttttctagattctcctttagtcgtgggtctcacatttcagcagcccaagaatcacttgggaaaccgggtaaacatttttaatgagatgcttcacaggccacatctgagaaccccagccctagagtgtctgccgcacgccactttgtactctcaggtatacatatcttgacagatattttagatttataaaaagaaaccttaaacttcaggaacgccaaattaggccactattaaagagcgactggttctaaaaatagctcaggtatctagggatttcaaatatagaaatccttctgagtcttgaaaatttgaaacccttgtcctagtacccaagctcattatcgcttaaataactggttctcaagttgctctggggagtggcgacaccttgattgtactttctttgggttaaaaacaaagccttttacctctgtcacacattagacagcctgtggccattgaacagacattcgttgaacacctactatgtgctggatatgacaccagatactgctatttcagggactcagcctccagggacttcacaatcgattttaatagaaaagcgcttctttaaaatttgacataagtatatttttctgcatatacacttaaaattgatggaaacacccagagaccatcaaatatgccctgtgagtaaaaatataagggctggaaatttctgcgggcaccatttgttgaaacaaataggtaatatttgcttattgaatggaagatatttcaagattagtgagtagatggagagagaaaaataatttggctaattccctaaacccttcattgtttactgaaacatctctaaccggagaatatctcaaagcaagattgagaaatctcacggatgacaagatttcctatcaccaagtgcctccctaatggaaagcctatctccagatacagttgagacccaaagccaaacaaaacaaaacaaaggtgcaagaagtatgtttctttctttgaacatagtgttaaacttttcagagctgctgatgagacaggcaaccccttgctgcctctgaactagttgttatttctctagcctcacctccgctacccacaactttcccccctgaagtaagagggaggtcagtgctcaatcccttgatgccactacctttgctcatcttcccactaatctctggactctcgatttcatgccacaagcccaaatcaacagtgctaatgcctcccataacctctggattatttcctgcgtgttgattttctggggaatgtgtacattttggtgttgacagtacaaggtatattccatgctctctcttgaacttagcaggttttgacagatttatgtgaggacagatggccattacaggctgaaggctgacaagaggcagttccgagcattgttaacacacttgcacaaactctcagcagtgcagctcggtgcagaatgtaattcagactatagcttttttattgccgcctattttcttttgtcaaaagagcctgctgtgcagagcaacaaatggctgctattacccagaatgtaatgggtgtcagacaaatcacataacacaaacaatcaagagtatgtaggtcatatttcaacagagcacaaccttagcaatatttatgattactgcattgaaatgtgctccataataaacaagcacctctacatcactcacacttacgcacttctgcacagcaaatctgggagaagtggtacatactctacagtcatctttttaaacagcccttttatttaaaaaaaaaaggcaaagacaagttttgttttgtttttcattatcgctatgaaacgattttcttggaggagttttcttttgggtttgtttgtttaattgaatgactctgataaatggtgagtccctggctctgtttcttgtgatgtgctattcaccaatggcatctttttttttttttttttttttttttttttggagtttataacattttgcagaatgtactgcaaaatctgcaacttactttcaagtttgtttaacagtgggattttgcatatgttgcatgccaattcaggtatttaagaaaaaaaaaattaggagatgagtttctaagttgcttaaaaacacaccaaaataggaagactgagcaaagagaggtgtgtgacttgtcctactcacatatttcaggcctcatgaatttggagtgggtgtcaagagtgcagagggaaagctgatattcactgagtaccaaccgttacctctacagcagttgttaaaatattcagtagataaaagctgccctagtgttctctccttctgcacctacttccccaggactcactggagctccacaagacccagcaactgaagtgttcacacttggcacagaagactatccaacagaccctgctggtcctctggctggccacagtccatttgggagtggcctgcctccagtacattttaagtatttctcctatcacccctggttactgggtaacaaactggccttggagaaaagcttcagaacattcctatgacataagcctaattccccaactcttgctcatggaagatgaagatatcattaattgacccttgtgtaaattccccacagagctgggatagaggatgggtaaggggaacctggcatttcaggtggctattgccaaaccccaaagctgatgtgggagagaaaattcctttgctatccttggcttacaagaaataggatggtaccatttccagagaagaaaaattaggaataaaggaattgtcattatagacactgggtcaaaatgaatgaaattgaaaatagaaaatgaagaatatggttgaaatatggaagaaatctctgacagtaagagtcgccaagcattggaatgggctgtaaaaagaatttgttgggtcttcctttcttagattcttgaagcacaggaatagattatgtggcctgtcaaaatcaccttccagttctctgatgctatgcttttccttttaaaactaccgacaactacccatattttactttggtccactttcccaaagatatgtcacatacacaaggagtatgtatgccaaaaggctacagccgtttgtcaatatttatgctgtttgtcagtacatttttccagcaaagtgaacttttaaattgagagtccacaaaggcaatgtaaaattcaacataaaagtggtagttacaaattggttaatgagtattttgttgttgtttatttgtgagtctactaaagtacactttgaatgactgctgattaaagcgtagagaaaaaattaagtaaaaaataaataacatcaaatcacatgtcccctctgatgaaaataatgtggaaaaacatatatcaatggagaaaaaaattatgaaggcctacttgttttagggtgatgacatctgattatattttttgctcttctcattttatcagttataaaatagttctactgctgttacaatgtttacagtaataacaaataaaaactatatatacatatacataaaattttggggtcactttggtccctacccaaattccttcgtgtctgtggtttaaaccgtcaccttgttgagctgacattgctttgccattcccatttcagaaacaaaaaagtgtagcactctgaaaatctccatatgcaatagatttaaatgccttctgccaaaagagcattctcttttctctcatcttgctttactaacagctattttgaaatcaaattagtttttacacctgtaaaagagaagagtttttttatcagccaaaatgagctagtttaggacaatcacaaagaagtcagaccagctggcaatacctaataaagcaaacttcctatctcatccctcctgtttctcaaagacactgcagatggggcagaggcattattctggaggtcttagaattttgttgactccttacatttccacttaaacatttggaaaatttcaccaaaatttgtgagagtaaagaaaaagaagacaccagaaggcctgagccaaagcttgggtcacttctgctgctgcagtcaaactgattaagcctgtagaccaaggatcaacaaaccaccaatataaatgctatttctacccttgccacccacctgctgcacctatggtagacatcactaattgatcatgacattccccatgagcacagacttggccttagaatctttctcaacacgatgctcctggcagacagtaccaatcaatgacacttggcaagtgcaatgaagcctatttaacataacatatgtcaattactatctttaaaattcagacttcaggaaagagatataagttctcttcaggcagacctgctttgaacccagggtccattagatagcttgtgtcaacgtataaatctttcctcaacaatgaaatgggcagaaagtaaggaagatactgtatgtgaagtacctatttagggagtgcctgattgccagaaattgtagtcatagaagtagctgttgctgagagaatctcaaatcagtgagtgttctgccttgatttggtaaattccatacctacaccaaaagcagtatttgttcaatttgatgtgaaaatagtagggggtgggggaggcacagaaaaagaataaataacttcatatatgagattgccaaagaggatacacagcaagggcaataaaagggaagaggtgaaaccagtcaaaagttggaaagataagaagtaaggtacaacgaccactgcaaatgaagttaactcagaattagtaattaaatatctaatatttattgagtacttatataataagggggcactcatattttatctcatttaatcctcacactgacccagtgagatgtaggtattgtaaccatcttcatatcatgcataagaatcctagtctttcagaggttaagtaaatggaccaaggccacacactagatgggaggtcattcagaatttaaacttgggtttgcccaacatccaagccaaggttttgtaaacttcaccaagctatgccatctgctctttaaaatcacgatatactacttttaattgaagctttgctgcttataaactgttttacttcagatcgaaccacataaaattccatttttgtgtgtcaaaaatgattgcatactggcaattttatttttcaacctatattttagtcttttgagtagacaattttatcagtagttatgaatatgactttgaaatggaggaaactgaggtgtacaagagatcaaggatgtagaaaagagtcttagcaatcaaaagatccaggagggaaagtgtgtgtgccatcttgttgctccttattgatttcacagtccttgccaaattcattgtcatctgagcatccctttggtttcctgctttcttgcttctgctccatcaacatcttctctccattccacccctacgcttcaaaatctgtgcattttttttgtttgtttgttttccctgaaggctctccaagtcaggttagcctatggagagcttaatttcctccacattcctttccatgaatcacctctgtcattcactaggatgatagtattgcctaaatatttctgtcagtcctttaactgcctttatcattttaaaaaactcttttggccaatcaatgtctttaaacttgaactatgctgcagtgttttccctttgataactctttttctccctttgtgattctttctaggtacaattagtgtttgtcacaatcttcaaacactactaagcgaccaattttgctgaagattttaagaggagatgacaattgtagacattatatgttgcactgcatttcaagcccagaatatctctagagaaaaaacaaatctccctcaatctcctctttatgttattctccaggaaggttccaaactttaccttctagcctcattcagcatctttcaagtcctcatctccttgctttccaaagctctaaatcacttctgttacataaatgcaattgggctttacttcagcttccccaatttatatctgtacagctattacaatcacactcaacaaactaaaaactgctttctgggcctacctttgttagaaggtggtggaacatatccagtaaataatatttgctttcatgctacttatcaatgtgtctcagtaccccaatagactaaacagttcatgtgcattgtactggtgattgaaattatgtaagatggtaaaatctcctgtaaatgaatgaaatgtgagtgtggaaaaatattcctgtaaaaaaaaactcaaaaaaggtcattgctaaaagaagtgttatcaaattagttgtggatgggtggaattggaaaatatttgaaaaattataaaaatctagaagaattcagactaccataccaatgtctctaatcttttccttcaaggagcaagcaataaaaagtggctaccatctataatatgtattatataataatatattagtgtggtttatacaagaaagatgaatcaatagacccccaaatagtaaaaaataagcttaaggtaaagatctccatcttctaccaaaactgtaatatttgaatgtatatttttgtgttttaagcaaaggtaaaataaaacagtataagcttgaatcaacttttttaataaacccaccaattgctggtcctcactggtcagataagaaggcctctactgcatatcatatatacacacaaaagctactcctaaacatatatgtaagttataatgtatttaagaaatagtgttatgtatttaagaaatgatgttaagtatatgcttataagtaaagatttgtgtctatgtgtgcatgcctataaaaatatgtatatatgtacatatgtgtgagtctgcacacacatacactatatatctacaccatgaaattaactactctactgcttgaccaagtcatgcaatcatgcattagacctttcataagaaggtaatttagcaaacacaaagtgtgaaattaaactagcaacaatgaccacggtgcaggtaggcaccatagttctggttcaaagcatcttgtttaatgtactgttcctttaaccttatcagcaatggccagagccaaggaatttcttgtttagacatcccacgactcactttttggtggggttcaagtacctaaacttaaagcacttagtgcaagggcaccatttgcaaccaactcagaagtttgcctaagagctcttcagttagtctaagttttttaagcgcttcaatattttttattagttttttttttttaaataaacaactggaaatatttgcagataacttcttatccaattttgtattctttgttaatttcattaaccacatagacagtacactctgttatcttattacacacacacacatatacagacagacacacacaagttctaagtgaaatataaggcttacctgcagttccagagagttccacacttaaggtgcgttcaatagtcttgttctcaaatggggaacccttggggtcactggaagatatggcacatttataaaaacaaactgaaatggagttgctgtagccaaatgtattagaacccccttccctttcagaaaatggttacatttcttaatacttactttggtgactctggggtcagaggaagagataaagttgttggtttggctaaagaaaaaaaaaagaaactaattatgtaatattgagtgtcttttagatttcttttctctccacaacagtcaagttggaaaaacaaccagaaaactcaaagactaaactaaggaattctctgaatattgaatcaaagtcagacaaaagtccattatgctaaaacaaattccaaacagcgtttgcatcagtaaactaccattcgaaaacacatatgaaaatagaatttttccaaaaatgaaccctccctgttacagatacaaaatttgcatcataccatcagagagaaataatgttttctattttaatttggaatacagtacacggtttgtttagacaagaaaacagcagagcaactataaggcgacagaacattatgaatattcagttgattttactcctaaaacgtataattttatatctagccctgataatagttatttctatgaggccaaagctcatgcagtaactattccactcactgaaaattaattgagagatgatggcaaattgtgggcattgatccagatggtttagaaggggttcagatccccaaatctgatagacaactaaagtaaaacaccatgttaatcagttgaaaggtgtgtagacttgcaaagaggctaactactgccttttgtgcttttctgaatcttacctcctacaggaggcatttcccaataatgaagggtggattaagaatcttctcacccaaaatttcaattgcttctctgtggcaatcttgtattttgaacagaaggaggggaaaatatgatgagaggcatacttgggctatacattcatgtattatgtatatctatgcttatctataagcatatgtttatgtgtatgtaggtttatgtcaattttttctcattaaaataattactttcaaaaggtcaagtggtagttatttatgtaatgaaaatcatagtgtcaaaaccaaaaaggtctttagaataaagtttcttatcttatggttgaagaaactgagacccaatgatactaagtgatattttcagggccataaaatagttactcacagagttggccaagattctgtttcctttatcctattgtcaaaagaaattgcattcaacgactttaaagtaaattaatcaaccccagcaatcaatttttttgaaatgtgaaaatattattcatgtccaaattaacctgaaattagacactttacttggataaatagtatttgcatatttatagatttagatctacacagttgaatggtatatcatacatccagaaatatgaagctcatatcttcaacaaattagatacattgattcagtttttcatttacacagataaatgagctgattttacattaatttttgagtatgtctaatataacaagtttttcaaaaagaatccatttatgaagaaactttaccaagttttatgatactcaactaataattaggataattcatacaacttccatagaaaatataaccagatattagctatatgctatgtgacacaataaatgtacattgaaaatcagtcactgaaattctggttttcaagaggtagggtaggctatttgaaatgctcaaaggaagactctcgaattctgattgttgggtacaggtaaggtcaaagtcaatgaaaggagaggagatggcaacagtcatagttaatgagaccaaaggcaaacaggaaatgagagccataagaaggggacagtccccaaaccacatacagaatccgatccctgaataaacccagactctctaattccaccattagaggagtattgatttggtttattgagagtttaatccaccctgttccagtgactggtagaccagagactagtaggatccttaaagtcaggaatgtgtctttttcatgtagattgtggtatttgggtgaatgcatgaataaatgaacaaataaatgagacatcaacacacaaccatggctagacaatcatcctaaggaaaagaacctgactccaaaacgttttatggagatcatacgtgatgttcagtgagaaaaaaattacaacaccttaagaaaggtaatttcaatcgatcctcctagttatctctaattgttcatgtattttccgcattttgattttgaataataattcaaataatcactgaagttgagcatttattagttcttacttgtcagccatgtttcatttcttttaagcctttcataactaaagaattttgtctgtttgtcaacaggttttgttctggggtgagcgttttgtaccttgccacagatatataccaaatacagccagtctcatctaaagaaaatttcctccaaaggcctatttaattcttcattgtcatgatttgtaaaagtttactaaaagaaaaaaaaaacaactttaaaacctgtgctgccgggctgggtcacatattacaaggactttaaatttggccccagaaaatgcatgcatgaccagcacagggtgaggagtagcccggtgaattcatttgttcactcactagagcgagctcatctgcttcccctcacctgaggccttcatgaccaacaaggcctatggcagagtggttctactccaggaaaaactgttctagtgcttatgaggaagatccagctggagcaatgagaatgcggtccatttcactaattatattttcccaaactgacagaaagtgatgggcagtggatttgagatatctaccagggaaaacctaatggaaagccattttaaaatattacaggaaggcttctgaaaatcctgggctaatactgaggtagtgaagagggaagaaaattcagaacactggggaaaaaaagcgtattgaatcagcagcaataacagcatacctacacgaattaatcatggttcaaagcagaaatcactggctcccactctgcagttaaaaggaaaagttgggaaaatgaaagtgaaaaaaaaaaagaggtatatgtttataattggtgtgttataatatgcctacttccaccacaaggttaaagtagaagctggcatgttttaaatcaactgcccatttcaaggggtctttgggcttctaagaccacgacattttgagaaggaggagcctaaaagatagaaaattgtatctctgccaagagaggttttccccaaatcaccaggatctgcctcagaaccatcagccttctccagcaatatatggtgataataaaaatcaacccagatgtttagtttaatctaggcactttcttaaatagaaagaaaacaatcaggatttttcaaatctttatttacagaataaaatctgtgagcatagcatgtggttgtagaaaaggaggagaaggggaagaaggagtggaagaggaagaagaagaggaaggggagaaagcaggaggtgaaggaggagaaggagaaagaaggagagggagaaagaagaagaaagaacaagaagaattagaaaaggaatgtacttagtaatcaagagaggctgcataaacactatttactacttcttaaggtgtatataacaaatcactggtgcctcattttttccattactggaagggaaaaaataaaagctctataatgaattggttagcccagcttgttcataacctcaattatctcagctattctgagattcatataaacatcatgtgatgttgcaattcctcaccacctggctaacatttcaggagtcttttggtgcttgtgaattagactgcctatcagctgaatagaatatgtttaacctgtgtccaaggaaaggtttcttcccccgctctgtaataagtgctgaattctctttccacagagtgacgctgatgggacggaagcaagaagttggtgtgttctcagactttgcatgtgctttctttgcttccagtgccctcaccaacagctcgttttggtccccagcctaccttgtaagtgttgtgactgcgactgtgtgtgggacttctttttggaggtgcatttgtctctgctgctgtttctgttctctgtgggtttggtgtgaggagggtcatcgtttgtggtcagatatttgagaagctccgagcagggacgtctttgtggcttttgctgttgacaaatactcttcgctttattgctccatgaattctcagtcttaaaaacaaggcataaagaaagctaaaattagtgaactgaaccttatcagaatggatataggttttctggagagatgggatttttcaatgaagtgttcagtctaagtgtactagatctatgagctgtgaataactgtttgcagaacaaggaaagaaaattacatttaaaattcctaaatgacatttatgcagctttttattttatttctcctacatttcaatgttcctactcagcaacatgtaactaacaagaccctacagcgcctttattgtgaataaaaaaaatcggctggcttaaaccttaatttgccactgattgctgacgcccagtactcacaactctcttaagtaccccttaatgctccgttttcactcacagtgaatagcaagacaaacattgtttaatacagcccactagctgaattatggcattgccagcattccatccaattaatggcagagatagatgttttgtggtgattccaaaagcaatctttctcaggttagacagctagcaaaacagcaattctgcatcttaaagccactcatagataataccagcttatcagcaaattttaccgtggcccacaatgctgcaggtaacaataaagtgggcaagaactaacagacagtggcacttccattccaaacacccaaagacgatgcgtaaatgaactctgcctagtttaaagtagctcaagcgctgtttacggaatcccattcataatctatttcatcattatgaggcagcttcggggtcccagctgaattaatacctacaaacttatttgttttactgcttcaagccaaaatcctttggtacatcccccctgtattaaaaaatttacatttgtaccttaacaattgcagggtttgttctgatcctgtgattgtgatttgcatggttctgggtactgagaccactgcattcattataacttagctgagtgttggctggtgccagtaagagcttcttaagctagaaacattatcagggaaagggaaaagcaagtaaagttatgcatcttttaagcattggaataagttattgaaattttaaatgtaatttattataattataaaagttaattctatcattttatttatgtcacaccttagcgcaatagtgctacaggaaatatgatatttaaagagtagaaaaaagtttggcattacactaccaactatgaaaatatttcctttccttccaattcaatttctagaatcgtatgcataagaacaaaaatgcaaatgtgccaattattatacaagaaataatagtgaaaagtagaaggaaaatctcaaaatttccagccataagggattactgcataaattggacttggtgttgtctacatattttttttgaacaaataaagcaaaaaacatctttctaaaataatttccaaatcactactaggtgagaaaagctgccttgctaaatgaagacatgggagtggagtgtggggggtgggggagaatagatacacattttctttctaaaaatccaaataagtcaagtggcaacaaatgaaagattttgtgatgctttgaaccgtgtttcataacctggtgtatgaaattactgattcaaagaatgtttggataaaagaatgactatcactgattttagaaaagaaaaaaaggatttgtaagtagagtcctggcctgtggatcaggagatgtgggttctgacacaggcaaagtatttgctgtctcctgacctctgtttcttcatttcactggatgaccctcaaggacttccctgttctgacatacagtatgtctctgagtcaactgctcttcccaaatgaacaaattgaatagatgaaaacaatctgatatcaatggaaagaaatcagggtactagggagcaaagccaatgacactaacaaatggagaaattggagaataaataacaattacttatgagatattctccatatgagaaacctcaaaatccaatggactcaaagtagggcctccatatatttgcatagagtatttttaacattcaaaaacttagtgataggagagtaacaacctctaaatggcatgccaaacacgatattagagtctggaggatcatggcatcccataatttacacagcatgtccttatgtctgatttttagcaaatgacaaatggctatcatagatgagaaggtaaactgtgtcttagaactaataaaactctggtcaagcactgcattgaacagaaaattctctcttcatttccaacaaattcagtcttcattgtctaccataaatttaagtaacttgggtggcaaacgtgctatagtttttcaatcttcataagaaatatggatccaaagtcttaaaacattgcacattcgttgatctaccaattctttctaggattgtatgtataagaataaaaatgctaatatgttaattattatacaatttgaaatagtgaaaaatagaagaaaaaactaaatatccacccataaaagattgcaaaataaattagaatatttccatacaataaaatactatgcaaccattaaaaattatgcatgtatttaaatttgaacccatatgctcatgatatatcttgaaaggatattgcaatcatttttatatgagaggttatttgaaatcacaggtgaaatttttagtcttttccttttagttgccaacattttctaagttttcatcatgaacataaataacactaagatagaaaaatacacacacataacagcaaaagatagtaaaaaaaactgcaataagactacacgaagacgtgtattatcaacacttttaaacagagaatcacacaatttgcaactctgagtgtgcttggggattgctttggcatcattctaaatgaaaaaatccaaaccttattgtgactacatcatacccatgcagcgggtagccagaggcaactccaattcctgctaaacagtaggaagggttcttactagagacggctcttctgcctcctggggtggaggggtgccgtcaggcatggaggaaggactagcctcattgtcagtggtcacgtctccatctgtcagcgcatcaaatgagggcaatccgtcttcatccacagggagactgtctagtgtctctgtgaggactgctagcaagtttgcctcattctcttcatctatcttctgcagaaagagaaaaaaacagaagatgtgagttgaccctgggaggcaggtaacactatgcatcaacatgtttgaccaaatgagtgaaccatacgtgaaatctagaatgcccattccagaacacaaagatcatgtctttctcaaactccaaattcatgttttggtccaaatgacacaattaatgaatacctctactctactaatctctgatggttgagctgcctaatttatcgatttgttatgtcagtgctaaaactgctgtatgcaattcttcttggttacagaagtgttttccacttgctcatgttttctttctttccctgagtaaaagaaaagatttagagaatcttggaccttgagagaattttaaccatcaatttcattttcagatatagtgtttgaatctcctatacagcataccccccaaactgtctagacagctctttatttgaacaacaccagaaagtggaactatactgaaagcaactatacactttcatggtttcaattataatctcatcactgaacactccaaaatcatttatttattttgctccctgacatctctcccaactttagtcataaatctcgaactgcctactggacacttctacttcataatagctccctcatccccaaaacccaaactctatacctttcacaacaaaactgctatttcttttgacttctttagtttgggtaacaattcttcatacccaaactctggacgtatttttactcttctttctgtgatcagtcactgaataaagtcttactttgtaatgtttgttaaatgcacttatttcttgtggctggggtactattccagtgcactattatttctttttctttttctttttctttttttttttttttgagacagggtcttgctctatcgcccagactggagtgcagtggcgcgatctcggctcactgcaagctccgcctcctgggttcaagccattctcctgcctcagcctcccgagtagctgggactacaggtgtccgccaccacgcccggctaatttttttgtatttttagtgaagatggggtttcaccatgttagccaggatggtctcgatctcctgacctcgtgatccacccacctcggcctcccaaagtgctgggattaccggcgtgagctactgcgcccggccccagtgcactattatttctaatagtggctcctgcaaatatattctaccttgtttttgattcattcccaccaacacactcatagaaagctaatcttcaatcattcacttaacaaacatttttgaacatctactctgtgccagggacatctgaagtgtgggagatacaaaaagaaacaagacaaaatctgtccctctaataacactactgtggaagggaagaacctgtaaacaattcattataaaatataatatttatttcagtactctgtaaaaaatgttcaaggacttccaaacatgtaccttgttaacaaggcagtgtgtgatattctatgcacgtggacaaccagtaccaacactgggcacatggcatagctaatcaatgattacttgctaaataattcattgatctgcatttattgccaacaatatcttctggaccattttcttttccttcttttagcacttcacattgtttgttcaatctgacctgcttccaaaatcttcttttgaaagttctgtatgctatgacattaacaatatgggctaaattatcccacacagattttattataaaatgcacctagctgctgacatctaatgaagctagcagtacccacacttcctttctctctagcactgaactccagttaattgacctgacaaaattacaagaatcacagaataagatagctaatcagaaaatcaaattgtattactagagaaattaggcaggcctttatcacgtatacattctattttcacataaaaattgttttccttaattcctgatcaccctccatccagcagtaaaactaaggacttcttttggattcaagaggccaaaaagagccatttgtactccccagggactttaattgacgttttttaatttgcataatgcatccctctcacgtccctggatttgagtttgggtgcaacatggtgtgtctgaagtttaaaactttaatgcacttgcagggcacggtggctcatgcctgtaatcctagcactttgggaggccaaggcaggaagatcacttgaggccaagagttcaaggccagcctggccaatgtggtgaaacctcgtctctattaaaaatataaaaattggctgggcacggtggttcacgcctataatcccagcactttggtaggttgaggcaggcggatcacttggtcaggagatcaagaccatcctggctaacatggtgaaaccctgtctctactaaaaatacaaaaaaattagccaggcgtggtggcggacgcctgtagtcccagctacacgggaggctgaggcaggagaatggtgtgaacccggggggtggagcttgcagtgagtcaagatcttgccactgcactccagcctgggcgacacagcgagactctgtctcaaaaaaaacatatatatatacacacacacatatatataaattagctgggtgtggtagcacatacctgtaatctcagctactcaggaggctgaggcaagaaaattgcttgaacccaggaggctgaggttgcagtgagccaagatcacgccactgcactccagtatgggtgacagagggagactctgtctcaaaaaaaaaaaacaaccaaacctctagtttaggaggcaaatcctaatcagaaggggtaactgttaacttcaaaatggtgccacctacttccataaactgaccaattgtaaaaatccaaattgcacaagtcaataactgaagcttattgaataccctcaggccctcaggtagattcttcaatctaccttctttcaatatgcctttgaaaggaccctgtatatgtaattctaatattaaataggctgaaatgatattccttattttctgcccaggatcataatctggtatccaaagatttcaataactcccttctttgattcccccacatacaaaaattaaattgaggttatttaactgttctgaatacaattatatttaaatgaaatacatgtatttaaaaaatcatctcaaagtcatgagatttacaccattataactatctccatattatctaataattttagaaaatacatcaaatacacatgcacacacagacacatatacacactttcagtaaattgggcatttttccaagtattccgtttttcaaaaaggcttatttcattgatgttcaaaaacagttcaagaaaaagagttaagaatatttaccaataaatggataattttgtttactatgatgtaaattttgtgtttggctttccagcaatactacaagccgttatttgctttcaatcacataatacaatggcgccttagctctatccctagtgtaaacaaactatgataattccaatcaagttaaaacgacaaagaacacttaaatcaaccagttttctccaatttctttaataagtctgggagaatgtataacaaatacaatggcaaaaatattggagcttgataatgtcataattaatttataagatctgattaaaccaccaactattttaattcccctctctactggaaacacaatgagagggaggatttgtaagatgggagattagcatggcggcttgtgtgtgtgtgtgtgtgtgtgtgtgtgtgtgtgtgtgtgttggagtatgtgggtagtaagggctactattcaaccagtatctaccatagggctgtaatgattatttacggtctgtatccattacaaatgattattcgatattattgttatctctgtatgtgggtgactcacagaggtgctccaagaccatttattttagtaaattttttagtgaattaaggaaggaaaaagttattgtttcaaattgtctgtgttttctttaatcatagaaaactgggaagaaaacttgctatttgctgatgacactttgtgtttatataatgttgagtggatattgcccctcactgtggcaatttcaattagtttagcatgagtttcaacaatcaaacaccccggagaaggcaatggatgtgacaaagaggactctgttaaacaattaatgtcacttcccattattgctttggtcccaatttacagagcaaataaatcaaagtcaccgcagatgaagcacactggcctactcacacatgtctgttcacaggtgacagggtatagaaacacattagtcactgcactgacattgcaagataacctttcaaagactcggctctgatactgctttctaattgtttgaaaatactattttacaaaaaatatatgtcttagctccatccgagttggggaaaaaagaaaagaaaatgcagagtagggaggaagaaagagcaggtcaccaattagacagtgatctacagctgcacaaactaagctcagccttggagctggcagcagaggcggaaggaaaggtagaaaacaggccaacgggcatttccacagttgagctctgtggctatcaaacagcatttcccatggtgggtgtcaaccttgggttctccttacacaatgcaattcttccgacctaaataaaggtctgtgtgactgtaacaccttattctctaagggcgctctaggaagaaagaaggcacatcaacaaaaactcactcatggtgtaaagaatttccagtgacagatgatacacatgcatttatactaacaacccaaaatttagaatctgcaacaattcctaagtgttaccgtgtcgttaataaatgatagtttagaacagtcaacaaaatgagaaggtttatctctgctctttgggacagctgagtccctctatgacctgtactagtctgacatcatttaaaaggcatagttgaaagaagataggttctggcccttcaggtagccaggggcacctctacattaaaattctgaacccagtttgtaatatttgggtcttcttcctttgtgcacagttggcaaaaggatcttccaactggttatacatggtgtggcagacagtgcattcaactcacccaactgcacacagagggtcaataaatccactaaattaaggaggagaggagggactctgagatgctaactgccacctgaagggagaaatgcagagtgaatactgcatgcggtatcccaaagacttctaaatgcgagctattatgaaaggaccatgccctgcttatgttagtaattttttctggatcctgtaggattgcaattacactctgtgtccccagattctcacactcgcttgatctctgtttgataaaaatagtttaatagccatttaatcacagcttcattatcttggctctcttaatgtgaattaggccagaagaattctcgcttcctcattattcaaatcatcaataagaaggaaacagtggggtcttcttatcattcattaatcagtttcagtatcttaggtactgtgtacttagagatcaatctgtgtgagaggtgacttaacctctctgagcctctaattttttttctgtacaaaatttaatgtgattatttgcctaattcctattacggaatttttttgcactcatgattaatagaaaaaaaaaaaaaagagttgacaaaggcctgagaattcttcaagaaggtgttcataaacatttccagtgtatattcccatcaacttgattatctgtgtttgaattttgttctttgaacaggatctaccacagacgtttagcactgggccaactccccccaaatacccagcatgccccaggcttcctccttgccccatcctgctgacttggaaacagctaatgaagacaaaattaactcctactttaagtgaggcctaattaggaaaggaaatctgctagagtaacatctggtaatgtattccaaagccaaatataaatgacattcttggattatccactactttggattattggttccgctaggccccaccaggacttcaaataactacatgggaaagcaacttttataatagattcaggagttcaaataagaaatacagtgggtcagaggtgtgtctctttcttgaatctccatagataaaaccttgtacctgtttcatgcatggatcagcaaaaaatatttgcagaaatgtacagattttggttctgatgcataaagtttgattcaatatttataagaaagtaaagtcaaaatttaaagaaaactaagtttttttcctgcaataaaatttaaaaataacaatccagagttgactactggaataggatttgaggtttttagcttttttctttaacccattctaatcagaacagacaccacttcactgcatgtgtctacttaaagtgctctgagcctttgcttataggttgttaagtattttgaatacccacattcaaacaattgattttttttccctcttcgttatctttctcctctaaaatctctgcaatccactgtgggttttgtttttgcttcttttatacccaagtgtgggcactgacagtatatctgtgcccctttctcacacacccaaccaaaagtgggcggactcccacatgtaatgactgagaggttcctagctcctacctcactcaaaggaggagtccttaaaataacccaattactttttgtttgtcatatgaaatacagggctgagaataaggtatgggcactggacggtggggaaaaagaaaagaaatctcaagcatatgtgtgcaataaaaaaatcaagacaataaataccaccttacatttcgtaacacattataaaatgctttttgtccactcatttcttacatatgccctgagagttagcttattcttattttattcccatgagagataagcacattatatgacaatctattttgccctgttggatgccaaatttgctggaatttgtgggccggtagaaataacataaattttaatttcactgtctgagtaactccccatgggcatacaggctacttgaaataccacgtgtgtaaatatgtctgtccatatcacacccacaagtttatatctcaagcacacatatttaaaacagaatctaatgcacatatatatctcaatgccttgagtgcattctctgatattcaattgtagttgactataaaaaaatgtataatctgtacatacattgctcctctcagccactctaactgaggaaagcaacgatcaaaaaccagggctaattcctgtaaaaataaaataagaatcaagtggaaataaaatataaacaaaattgaagaattcacagacataattagacccatgggaatccatttaattccaattaatacacatattcctatttaaacaggcataaaacatatattcacatctgtacttagactccatccttattgatttgcttctatcacacattcatgagttaataaatatgtactgtacacgtgaaattcagtattctgtagaggttataagagccagaagtataaatacagaagttcaacagaaagtcctaaaaattcctggttaatatatgcaaaatgagctatttcaggagaaaggggaaaaaggttcggggaggttgtgggggtcatgcctatttctcacaatgggaagaggaaggaactgagttgtgccatcaaactggagacttaataggcctgaaaagagcgagcaaggcattctatttgttctcaagtttaaactgaaagagaaactgggcactgtgggaagaagtccagactggaagtcaggagaattaatcctagatccatttccaccaccagctagctacatgtcctcaagtgaaacaactcaactctctggctgcattgcatagtctcgaatgaaaatcccataggtttctgctatcagtctgttttcacgctgctgataaagacatacctgagactgggcaatttacaagagaaagatgtttagttagactcacagttccacgtgggtgggaggccttacaatcaccgtggaaggaaaggggaacaagtcacatcttacgtggatggtgtcaggcagaaaaaaaaagaagtttgtgcagggaaagtcccgtttttaaaaccattagatctcgtgcgacccattcactatcacgacaacagcacaggaaagacccgctctcataattcagtcatctcccccgaggtccctcccacaacacatgggaattatggaagctacaagatgagatttgggtggggacacagagccaaaccatatcggttcctaactggcttcccatttgccaacccatctcaatattttattctcaacacagaagacgaagtgatcctgatgcaacctaagtcatgtgaaacccctcttctgaccaaaccctccgtggcttctcatgtctctaagactaaaagctaaatcttaagagtgccttactaaccaaggatcgccatataatttatcatccaagcagaaccttttttgagagggagagcggatagtgcacataatcagctactcagggatgaacccagactacaccaggctaactggaatgtatggtggccctacacttggccaacttcatctgactctggcaacccctcattcacctatctgaatccttcccaatcagtctgatctcctcactactccacaaaaatgccaagcattctcctgtcctcaggcctttgcacttgctgttttctcttcctagaaggttcttctgccagagggccacatggattgcccctttgtcccctcatttactcaagtgtcaccttctcagtgcaacatttcccaactactctggacacattctacacattttccctatcttatttttccctttggcattcatctccctgactcaacatatgttttagtgatttatcttcttcatgaactatctaaaaggggaggtctgtgagacctatttgattattattgagatacttagtatataggagaggcttaactaaaatgagttagaatggtaactaaagagtctaatccatcctgataatataagaatatatggattttcattcttcttttgttgttgttgttgttattttctttgtaatcctcacctcctcctatcctcggacaatttgtcttcttaataatgtttagcttaggctatgattcaaaattatctcacattcatttcacatataccagctgacaggccaggcaagcaagtgatatattcttagtggggaagaaagaatatgaacagctacagctatagagggcctaattctgaaatgaactcctaggcagtgaatctatagaagtaaatgtaatgatcatcttttgtaaaagaggaagtttaaatgggtcttgaaaacgcagaaatttacccaaatctgttgtctggaaggatactgggacacatcatcaagcaatcaatttgcaaacatcttgaaagagtcaagatgctttcgtgaagagataatcatgccagacaaacctactctctgaccatgcaggagtattgactctctagtcaagagaaaaccattgatgtaatctatctgaactagagtggtgaccttcttcattccataccatataacacactcatcttcaagctgggaatatatattaatcttatccagaagtttttaaactatgtttcatagaactctggacactagaatagctggtataaggatttattataaatattatagtgtatattttatgtatttatataccttaattcatagccaaaagaagtcatttttttttttagaaaacacactcacgtgtgttaactttcttatcataaatacagaaacacagtggaaaccatgaccaaattaagcagccaaattgaatcgttttgtattgtattcagatttttaaaaaccttgagaactgagggtgaatagtttcaaacctggagccattttaaaatactcatttctatgaagcaggattttctcaatccccttcaaacaaaacaaagcacaaaataatcagttgctgtgattgatgataagaacctgccatcatcttaaatcccaacttgtactttttctgttcatttaaataatgccatagttctcttagataaatattactttaataaataataataatagtaaatagcagctgatctttactattttctatattcctgatgttgagttaatttctctacatgcattatttaatggaaaccacccatttaaccctattattatgtccaaactcacatggctaatgaaagacagagttggatattaaaccagatatatctgatgaaatatcattctcactccctttctttatattttgggattttatggaagatattattagaaaaatgagtgggcgtgggctattttatcttcatattggggactaagaagtgagttagaatgacatagcatgcatttattgtcagctaaaatctaaggtgggagatgcaagttacatgccatgaggcacagttggccttccatgcagaaagaggaggttgctttgcaaatgattctcactatttattgctggctggcccagtgttggttcacagcctttttttatcctactgggtgtgatttgctcttctatttgaatgttcttccctctttacatcttttgtttctattctatccctactcaaagcctaccttaagcattcccttccatgggatgtttttcaacaagtccaactctattgatagcaccaagtttccaatcttttatcagaaaaacttggatccatagacagaaatgcagatttcaaagcctcatcacagaccactgaatcaaaatctctagatatgagtttctgggctgcagcactgttgacatattaagccagataatcctttgttttgggggctgtcctgtgtgttttagaatgcttaacagcatccctggcctctactcactagatgccagtagcacacctccagttatgactaccaaaatgtctccagatatgccaaatgtttctgggaggcaaaattgccctcagttgagaacaactgccctgggaggtagagcctaggattctgtaattttgataagcaacccaggcgattctgataatcaggcaagtttgggtaatttgctgttttgtggctgttgagtagtgtgtaaatcaagttgaaatgtatgattccatctatgctagatttattctctctaacacatgtgattctagatcttaatagttattattaacacatttttatttattcaatgtgaactatttttcccaatatcttacattaatgtgcctagttgttttatggtctgcccttccctgttgattacagcatattggttattcacttcccgaatttgtttttggcagtcctaaggcagctcagtctttatattgccaatcattctctttcttcaacaacttctgactatcaccattatcataaagttcatttcagttctggagtctattttattacatagtctacctgctaaatgattcttaaggattttcttctatatattttcacagaggtcttaagcatttctcaacttaagattttttaaaggccgtataatattgctatattatttgaaataggcagtgaggcaaaatacagactccaaagttagatttcctgatttggggtcctgagtacatcacttacaaggtgtgtgaccttctgcaagttacttaaccttaataagacctacagtacagggctgttttcagaactgactgagctaatccatgcaaatcatatagaacagtgcctggtatatagtgaggatttatctttactgctaataacaataacattatcattttcatgcactaaattgaattcaaaataagtgagacaaaatatggatttgttgaaaacaaatctgaggaagagataagacatgaacaaatggagtgaaaaaggaagaacactgtacaataagcctacacaatgtagaaattgtaaggatggtaccaaaattactaaatacatattactcaaaaattcctacaatttgtataaaattcattatctcccagttactagttaaggttgagatgctagagttaacaggcatggtttgacatgatcactgactgcttgccagttattacacagaatgatcacctttaatccatactcagctgaattaaaatatctatacctgacacacccttcatttgtgaacatacatgcagaccaatatcatatttacagatacatatacataagtatacatatatacatttttacacatacatattacagatacatataaacatgcatatttatgtgcgtatttacaaatattatatatatatctttatttacacatatttattgagtgcctactatgtactataatttgttttctaggaacttgcattttagtttggtggtgaaaggatggcagataataatagattttatatttatacatcgggagaatacagtatacatatgtgtgtatatataaaacataaacacacatacaaaaaaattatttttattagcctcagagagtttataatctagtcaagggagtgagacaggagcagtgaaaatacaactaatgacacaaggccatgtgtacatgacaacatattatattagaataatcataaactatattatatattataatataataatctataatatattatagattataatatgacaatctatattatttatcatataataatatataatatattatatatattatatataatatagaatatatttattatatattctatattaatatattataataatcataatatataatataataatataataatcacataatataatcatataatatattatatattatcacataattatattgtatattgttaatatataataattataattatattatatagtaatatattatattaatatataataatatatatcatattatatgatatatatcatatattataataatatatatcatataatatatgatctatcataatatatgatatatattattataatatatgatatatcataatatatgatatatattataataatatatgatatatattataataatatatgatatatattattataatatatgatatatattattataatatatgatatatattattataatatatgatatatattatatacacacacacacacatacatacagaaagagaaaaaaagaggtagcatttggagcagcaaagcataatagctaagaaagaaatgttctagacagggaaaagagtaagagtaagggccaaaggccctgagggggaacttgcaatgagtaagaaattactttttcatggtttacgtataggtataagcaggaggggggtgataggcaaaatatttaacaaacatcgcacaagaacattgatcaatcagaacagcagcaccaggactttagcacggaggcctgctgtgaatacctcacaaagctctgctgttacaaattagcagactacattaaccctaggcataaccagtgttttttacattatgtaaggaagaataatttcctattacaacctgtgagttctctataagatagtatatttgctgacaaaaagaagtgcttagacggcaccatcacagaggtcaatgctatttgttcataaagacttagcaccacaagataatatgtgaaactgtgcagctgcagattcctgacacttggatctatatggtatattaagattgcggacactaagatgcaggtaacgtcaaatgatctgattactgtaatatcctggcaatggcattagaatgagagaaaattgtctcaaggtggttggaagctattcagaggcagggtgtcctttctgtgaggccatctagggtgaaagagatccaagtgtgctccatgttaatcctctgagcctttccagctcctttctccaagaaactaggagccacttagagcttgggattgggtctttgactccttgactaactttcgtattccactaaagtgctctgcacagagcaacgggttgtcaataaatgcttgccgaacaaatacaatatgagaagttcatcttctcaatgactttatatctaagtattttacatgggtttaggtttccaaagcatctgagcaagtttgcaatctcctaggatttagatactgagcttcttttaatgccagactgagtgaaccccttgtgaagaatctttaaatacttcacactgaatcaattccaaatgcagactcattcatgattatcagtgacttatatgcatatctggagagcatgcacagtggagaagcatatgacattgggttagacaaagcagctaataacctcaaagggggattttaaaagtgagtttgataacaggataaaaaagcacgtgtccctgtaacagcatggaaaatgacaagacaggtgtaaatggatctggataaaaatgtaagatttacagaacgatgaaaaggaaaaacatgccatttaatgccttgccacattgtggctcctataacgataggatgtagtaacatggaaacactgaatagtaaaagctgcgtggtcaactcttccaacagtatgatgttggagatgagaagcctgacatccaaagggttaaacaaactttctcaatgtcctctggtaactgatctaattctacatctgttttggaactattggctccttagtttttctattataccatgttgcttatcaggagaataaaaggaaataagtggcaaagactctgtctcttacatttgccatatgctttctttaaaactcaacattgtttaacctactgtaaatatattacaattcattaacctccatagaaatactggattgtattttcatgtctgtgtgtttttaatagatcacaagcttcctgggactaggaatcatgatctgtgcatcaaaattagtgtcaaaaattttgacaagaattttttgagcacctagcatgtgtcggacactcttgacactggggatatagcgatgaacaaaataattaaaaattcctgccttcaaggagcttattctgttgggggaagagagatgatagacaaaataaattactataaacaaaataaacaactgtgagaaataaatgaaaggaaaaagcaataagaactctatttgtatttatgtaaagccaaaatagatttaaaaatcaggcttatttacaaaaacagggcacaaatattttttcttagaaaaggtttcatactgggataaaggttttcttctgactcttacagagtaatagatgcttgtaaagtagtgactctcaatgttggctttaaatttaatcacatatgcatttaaaaaaatatgcttgccccttccctacacccttgagcaattaagtcagtatctttggaggtgggagttagtagttttaacatcttcccaggtgagattctaatagaagccaggactaagaatcacacctgtaaaagattaaataataaaaactttgaggaaaggtgagaatatttgttatgatctaatgtgtaggctgaaggagaaggcttgcccatcagtgagaaccagctgtggcatactgagatgcccagaatccctcacatgtgccacagaacatgatgttttatctttgtccagtgcataccaagtctggccccttgaccgaaggagtcttctttcctgagtcacagttctctcctccattaccactcataccctgtttcagtacttgtgagtccatgaaatgtcttaagtcatgaaatctctttagtgtatgatggcaacacccgccagccaaaagtcttattacaatgactactgccatcagattgaacacctttaaaaacaaagaatcacagatcacattagagttacctctgaccataggctgtgtaagcaatgagtacctgggtttaaagataaaaagaaaaccagggaactcatactgtgaaatgcttgatacccattaaaacaattatataggtatacctttgttaaaatgaaacatagccattaaatattatgaaacgaatcaagacagttgtcaaatagcacttgttcagtccatgatctatgcatggatactggaaaaagcctaaaagaatgaatcccaaaatattacaagaaggtgagatttcagatgactttaagtcaatttgtctttttccagttttctgtaatgagcattttattcttaaaaatatataaaaataaagaaccccagagtgtgtttgtgtatgccatacatgagaaaatgggaagagaaatagctaaagtgtgattaaataattaatcaaagtcagcccaggtctacacaactttgtggccctgctttcaaattgtcttccctgggccttaattttttgatctgtaaaaaggcagaagtgaaatctgccatagttgtcccataaggttacaggacataaaaaatagcatgatcattatgtgctttaaggaagagttaagcagcattatataaaaatgtagtgctaaatattcatgcctctcagataaaatcattcaagcaatatttactgaattcgtaccatgcttatatagttacaaacttgacttaaatttatttcttcctcacagcacctcacagtagcaagtagactataacaaccggcataaaaacaatgacagcattggtctgagactctagagcaaagccacagaagcagaagagaaatcatgatgccctcgagctaaccctctcccagagtcctctttgcctgagctcccatcagtggttgtagacaaactttccaggtctgtttgtgaggataatgttagccagctgtaatctcttcaggggtgaaagatctgatgctatcagctagaggtggccctggaatagatctgcacacgatatgaaaacataaggctttagcaattgatagcaaaataattcagtgccatttcagcgtcaattgctgctcaatttgtccccggaagagcattcaatattcttgaaacattaactcaggacctctcattttttgctgctgttcctatcaatattatgcccattgtgaatatttccaaagtagtagactcaaagtcttatgggatttagccttagaaaaaaagggtttcaagttacaattctgtcatatacaggcctgtgtccttgaggaaggcatctgggccctggaatcccagtactatcaacgtaaaaatggagacatctgtaatcccagcactttgggaggccgaggcgggcagatcacgaggtcaggagatcaagaccatcctggctaacacggtgaaaccccatctctactgaaaatacaaaaaatttagccgggcgtggtagcgggcgcctgtactcccagctactcgggaggctgaggcaggagaatggcatgaacccgggaggcagagcttgcagtgagccgagattgccccactgcactccagcctgggcgacagagtgagactccgtctcaaagaaaaaaatggagacatctgcttcatagaattgtggtgaggattaaatgagacactgagcataaagagcaccgtaatacatcagataaaaatttcctactattcctctaatgatgttcgttatttaaaattgttttcaaaatgttatgctggcaataaaagaacataacttaagaaggaacgctaggaaaccgtatgccatgtgaacttaatctgttacctaagatgagccatatcacaatctttagccctgaatacatggcctttctacttacataataaattgactatcgcatagctgataaaaaggctcacagatattgccttcaatttggaatagctgaactaggacaaaactgtcatttaaaaaatcaaaaaccactgaatcatagcaaatataaacaggggatacagatgaaaaagaaaagtttattgtgtttgaagatgataagggaagaaaaaatggatttatcttacataaaaataagactagagagaatagaacctttagtaaatatagcaagcattttactttaattctggataatatttttaaaaagaaaaggggccataatacatatttaagctctttgaaggtcatagtcttgtttcatttggctttactcatttattccttcttgtatttatttgtagatttagaatttttttttttttttggagggcaggtgtttcatgcatgtgaggacacagcagtggccctaacagacactgctcctgtcctcatgatgtttacagaatcctcgctgcacggtacagtcattagtctgtaatgtcgtataattatttaaatgttgaatgaaggaaaaaaatagacaaaaatgaaaataagaagagaaagaaaagaaaaaatcagaacagggagttagaaggagaatggaattatccataattttattttcgctttttgatggaaatgaaatactcttttcatatcacactgtttgtttgagctacgggcttcaggaaataattaggttggtgcaaaagtaattgtggttttggtcatcactttcaatggcaaaaactgcaattagatttgcaccaacctaatgctatctttgaaatataagttaaaggtttaatcaccacttgcaatgcttgtactgcttcttatacattgccaagatcatctttgggagctgtcgctaaaataaagcataagaagagaagcaagaattttctttgagcttctgtgacagtgctcagagtaatattgtcataaaggccaagtgaaaacaaccacgatctaccagggaactaaaagtaaactcctgctttggtagacaccaacaatttctataaagtacaagcatggcagtaaagtacagccttctttctagccttgtttctagtagaaaatacagtgggatacatgatctttaatgattacatctttggccttgaagaaataaaatcaaacttatttcaaggcaaaggcaggagaattaaaatatctaggttgaaaattaaagagtgacaatagcggtcattgatacgctcttgctgtgcactagggatactgtcaagccctttccacacgccgcttccttttatcttcatagtgatagtttgaaataactattaaatcacctttttacgtatgagaaaactgaggtttaaagaagctaagtaactcattaaaggttacttaaacatgtgtctgagtaggaattcaaatgctggttcccctcttttcagtgaccctaacttatccagaacatttttcagggcagaattcaaaactgttttacctttataggtatacatttaaacttaattgttaattttattttcaagatctctttgggggaaaaagtagctcactgaatattctagaaaaaatgtcatgtgtttcattgcttctaatgagttgctgcagttcagaagtttcattacattctgacaattaagttgctaataaagtgaggaaccactaatggacttatccatctcacaaactcaagatccagctagcaacctagaacacaatttcatcactggaacaaaaataattctcattttgcaatacacatagtgattcgatttaatctaggtaaactgcagattgctcctgcacttgacatgatgttctgactgggaacatacacacacacatgctcacacacatacaatattagtaacaatatgttgtgctgatgcagactgtattatcagaaccaatgataagatgataagatattgttatgctgggacaatgcaatggctatggacccaatatcaaaaatttatggtaattgaaaccacagaatcttaggaaatgcagtcgatttcatagagtatcaaagggtcactctattcaatttatatttgaggctgagcacaatattgaaaaaacacgtgaaagcaaatgatgttatcagttgtccaggattcaacaactgacttactatctaaggtaatttactgattaccaaatatgtgcataacctgtgttgagtcttgtgcttggcacaccagttcttgcaaaaaacttaacactgtgaacgcattactaaatatatcaacattaccatattaactgctctgttcaagcttcagtaagagtgaacctttttattgtctcatgtttcactagttacaccaaagattctctgagattttgctctctcttcaaacttttgctgtatgctgtgtcttacagaagctattttaaaacaagaacattaagtatactacatccagtgcttctttaacattaatgtgcatatgaatcacctgaagatgttgttaagatgcagatgctaattcaggaagtttagggtatagcttaaaattctgaatctctaacaagcgtccaggtaatgctcaagctggtccacaaccaagagtttcagaagccaggttctagttttctccatcaattcagcacatttttctacttgtccccatcatgcagggcataaatattctgttccattacaattaatccccactaaggaggcagaccacaacattttgaattaaaatgtagaattatttcattctttctagctcaagtttcaaactagaggtcttcaggaggaaccagtccagacatacgtttcatttggtgagcatggttttgcctacaaaaggtttttaaacattattagattacttaacaacagttattgaaccgcaaattgtatctgaaatttctgcttttaaaaaataaatctgaagatctagagaagctgggatttgaggaggagctgatcactttacagagaggctgctctcctcagatttccactgtctccacccctacagccctgacatagaattttcatggcagtcttcattgtacttgctccccatcaaggccacatcactcattctctttcctgcctacctcccatgagcactggagtcactctcctctgattgtcgttttaaaaatccaccctcccccatttttctacctccacattttggtatcttcactataaaatagttttctccgtttttttttcttcatagaaatcctaaagcttaagatcctattcgagttctcttctcccatgaaatattggttaagcacaccaacataactcttttaaagtattatacagcatcatgccatgttttatacttaccatataaagcctagtttttatcttttcgtgagcacatttttatcagcctttagggaaatagatatgtacaagacacatgacccagacaggcatatgcatgtgtgcgtgtttgcacatgtatttgtacaccaattatttcaacttccagctacatcatcactgccctaaaaaaaaactataatgcactttgtcttttgcaggttaacaggatggtctgcatgaaataattccaatcaaaattatttgttaatttgattctggagctgagagatttcctttcacaggttttcctttttatataagaaatttgtaaaagaatttttttaattaagcatttagcatttaggatactggttttctatattagaagaaggttttcattatagaaagcaaaatacaatcaaaatttttaaatacacaaaatttcatagttcgattaaaggaaagtacagaaaggggttagtttttagtggcaggcactccctagaacatcttttaaagggggaaaagtgagagacatgtaagatagaaacatggtacagaaaataaagcataaaacaacattaacttagggtcattatactttatgtgttctattacaatggtccaaaggactattacttgttaaagaaatgaaaataaagacttcctaagttacatctgctatgttacctcagatcaatgagacacattttgaggaggtactcaaatgtcctagatgtgtacaagaggaatctcaaatttggagatgggacaggtttccatcatatttgaacctgataagcacttaggcactgtgaattttcagtggtgataatgaggagggatttctgtagaaaattctttgctgtacctgaaataaacccttatcctttatactctcaccaagaatattaagacaataacaactgccttatatctcctacccagaaggatagacagaaacttgataggattatgagacatttagaaaactatctgataaaacaacgatttaatttctggagtatcttccacatgcaagtcagcatgtagtaaagcacaagacatctagagaagacaaacaataaagtaaacaagggtacaggttctacagtcagactgcctgggcatgaatcctagctctgtcaattactaggattggggacctagggcaagctactgaacttgtctgggaccagttccccatacacagggaagataatgataaaatacctgcctcacaggttgttgtaaaaattaaatgaaacgtataaagtgcttagaatactgcctggcacatagaaaccctcaataaatattagctattgtctgtattatttttattagcctcaaagagtttataatctagtcaagggagtgagacaggagcagtgaaaatacaactaatgacacaaggccatgtgtacatgacaagtgtcagataagtcagtccgatactgagtgttagttctgagaagagagaatcatttttagttttaagtaatgttgccaggaatccaggcaagggatttcttatcaggtcacagaatttttagcatagttatgttattttggtcatggaaatccctttgaaaacaatttcagaaaaggcctctcctaacctttgggtgtattaaggcatccagattttccctctgacctgggaaatgaaggcacatcatcagcacatccagacttcatataaaatttgattatggtcctatccaattaccggaaattcctacaagtttccgatggcctctcagctgtgtctggcttgactgagaggccatacagtccaacagttccacagacttggccaagaaacataatttgagagaaggaataagaactatataaatgaagatggccttgtcccacaaatatgagtttttatactgaaaataaacactgtactaaactgtttggttcaaaggcaagattcacctttaaaatttttttttactgctgtgtatttcctgaggttggagtgtgtcattcatttttatattccaagtatctaatacgatgcttggaatatggtagacaccgggtaaatcccagatggatgaatgagaagctataaagaaaaaaaggggaaggaagggaaagaaaggcctgtttccaatataaactaggttgaaatactttaccagcctaagtgatatcctcacccactgatatgatttggctgtgtctccatccaaatctcatcttgaattgtagctcctataattcccacgtgtgtaggaggaacccagtgggacataactgaatcgtgggggcgcactccccgatactgttctcatggtagtgagtaagtctcatgagatcgatggttttataaggggaaacccctttcacttggctctcattttctatcttgtctgctgccatgtaggatgtgcctttcacctcctgccacaattgtgaggcctccccagccatatggagctgtgagtccattaaacctctttttctttgtaaatcacccagtctcaggtatgtctttagcagcagagtgagactggactaatatacccatgcaacccctgacccttcactgtcttatttgaatctggcttttaccactcaagacttttaatgttagttatattttaaaatacttatctttacttccaaatagatggtaaactggaacataattggcattcagaaagcatttgtcaaatatatgaggattacttagctaactgaacgctctcttgggacaagcaaggacctactatgctcgatgcttctaaaaatgcctactcttgtgcattgtataatgtactccaaaaaataatttcaggtttatttaattccatattctgcatgcatttaatatatgcttaataagcaccgactatatttcagacactgagttaagtaatgatactgggttagtgacaaccacagcccagacccttaaatagcttctcatcccatgggagagacaggacaaataagaaacaggcagattgagaaatcctgggagaatgtaaagcttctacagggcccacatcagaggcacctaagctgtggtagggtgccaggtgttggtggtttgggagaagtgatgtaggaggggaagtctggattgttataaggaattaggctggcaaagagatgcaggaagggatgtgctacatcagaatgaaacaataaaatttaaacacagaaaaaccaaagtgtcaccagactcaacatatagtagacacttaataaacaataattgaataaataaattactgcactagtgttatgtcacttgaaaccatctgacattgaactatccccaggttctcccaccatggacaaaaagtgacatttggaaatgtgttgcaatagttataatacaaaacaaagcttgtatatctcctattcccaccccatagagctcccacagtatatacttgagcttcctgactttccagaatgtgccaacacaaccataaagaaaatcaaacagcaatcattgcaaatgccaaacgctgaacttttgcagccagtattccaagaaagaattctctgtgcttatattttttgaggtgtaggccacttcttggtgttttcttaccagggattagtcattgcaaacactgttgactaaatgtggtttgttttaacatacaaaatgcctttgttcgttggctttcatcagccccatcagagagaggcccgggccatgctcaaagctgcaggacactcggagaagtcacattgtgattgcttgtcttccctctaaaggttacatttcatgacagagattaaacgtcttgcccattctatgattgcttttgaaaattatgcactaatgatagccactcagcaagtagcttagtcatttccctttagcctctgtagagagaatcccaatttggtcatttctccaacaaatgtttcttgggtgcatatcatgtgctagaaactgctacatgcaagatacagtggcctataaaacaggcatggcccctccctcatggaatttacctttgattaaaggtacacattgaatacatactggggagccaataacagaagccggactctcccttcatcaccgagaggctggcacagagcccaggggcaggctgttgaacaccttctccctggaatttgaatcttgaccagcatgcttgtgcagttttgttcccaaggacactttccgttttacagagctatccaggaagttcaaggtattggaatgtcaacaaattgccatttattgactatcaattaagtgcaagcattgaactatgtactttccttatattatttctacatatattatttgaaaacttaaaaaatggaaaggctaatgtttcctggcagagacacacaaatgatttctcaggaatagcaaatacatgtaattatagaaggtaatgtaacaggtctctccatattcccagagccagtgcaccactggactcacagaagatgctcatcactgatgttctataggtgtttctgggattcctgtgacaatataaaaggcaacaagtgcatagtgacaaatgccaaagagatgcagaaaccacaagatggaggactcgcctttggcaaataaagccagggatgaagtttcataaaatctatttagtatgtgcgtgtgtgtgtgtgacacacacacacacgcacgtactaaatagattttatgtactaaatagataaatatacatttatctgcatatgcatacagataaatgtatattaactaaatcataagcactagtttcaattcatggaatttcagaggatagccactgggtggtagaattcccactgtttagttgggaacaagaaccccattcttttacttaatgtcaaacactttgtgctgacagtataactcatccagctttaagacctcagaactgtcactggttgtttcttgactgcccagtagatttgtaaatgcaccacactttcctttcacagaattatccctccttgactggatacacaccgagagccagtaagcaaaagcctcacactattctcaccactccagggctagcacagaatagggaaaacctattgacatttgaatcgtgatgagactcctcttgcagtttagttcccaggctccaggtcttttaggtactaagcctagttcaacaccctctcatcaattccatcagccatacatatccttctgcctttctgcttgaggaagctagagttgattctttgttttctattccattgtttgcaaccaaagaactctaaattataaaaacaactactatggctaaattataaaaacaactactatggctaaatactactatggctttccgtggaatgaaatggttcttggaaaagtaaaggacttattaatattacatttgctatctttatagattcaaggaaaggcaaaagctattacttccaggagtttgtagactttgtcttaattctgtcaaaatgcataccccctctattccaggcactatacaggacattttcaatgcattgtctcatttaattttaacaacaaccaactagaacataagctccaggagggcaggattttttttactccctggttcactactatattcctagaacattttcacacatgataggtgatcagtaaatgtttgctgaatgaataaataaccctgaggcaggcactattttacaaaaggagaaaaaagataatcatggtcctactgcaagtcagtggtagagctaagatttgaaaggcaggcatgtctgactacagggcccagtctcctaaccatcttgctaccattgcctttaggttcttgggatacaaagagaagagaaggttgctgacctcagggaatttgggcaagcccctttaagtcctggtttcctcattgtgaagtagagatatgtccctcatttggtttttgaagacctaagaaagtcctggaaaatgccacatagagatgatatgtgaatattggaagtctgtctaatgttcagaaaggtagaaaattgacagtcaaatctcacctttgtcattgctagcaattacctggcaaacctcttaactcggagactcagttccatactgcagaacatttgccttttagcctttttagaaagacaggaaaaataactacaagttttatggactggctgagttgaaatataaatacaaattaaggtatataaatatatacttatataaatataaattatatagatttaaagtgtaaatttatatttatattttgtagaataaattaaatataaacataaattaaagtatgtaaatataaatttatataatacaaataaataagtttataaatataaattaaaatagtattgtaataacttttaatactagcccattccagtacatgattcaaatacattatcaactctgtgggctttccagggaatattcccagggaatgtagtaagagaacactcaagcatcatttcaaaaactattctttaggttgcctctgttaattagtgaagagttttaatgcttaaaatgtcagtcccaagttaggccaagacaagattcttaaagatgatgccaacccattcagacacagagccactagcgagccatgtcagacatgatctttggcttgtccaattatctctagttggcctgaatgctgaaagtgtaaggggaaggtacaggtacatttagggtcttccagcaaaggaaggagagaagatgtattcaaagaagagggaaggaaattgggagactgcaaagaagaacattaacaaaaattcaaaatatttaaaatgtaacaccacggtggctcacgcctgtaatcccagtactttgggaggtcgaggtgggtggatcacaaggtcaggagatcgagaccatcctggctaacacagtgaaacctcgtttctagtaaaaatacaaaaaattagcccagcgtggtggcgggcgcctgtaatcccagctactcgggaggctgaggcaagacaatggcaggaacctgggaggtggagcttgcagtgagccgagatggcaccactgcactccagcctgggagagagtgcaagacaccgtctcaaaataaaataaaataaaataaaataaaataaaataaaataaaataaaataaaataaaataaaataaaataaaataacaccaaaaaagagaaagaattttcatgtagcctggtcaataaggaatattcaagtagcacagaaaattcaagaagaatggggacctgaaaaagggcttttgagttagacaattaagaaatctttgagtagaaggtggggcatagtagctcaaccctacaatctcagtgctttgggaactctacatgggaggattgattgaggccaggagttcaacagcagcctggccaacatagtaagaccttgtctttacaaaaaatttaaaaattagccaagtgtggtggcacgcacctgtagtcctagctatatggaaggctgagatgggaggactgcttgagcccaggagtttgaggctgcagtaagcaatgatcacatcactgcacccagcccaggcaacagagcaagagacaccctaccttaaaaacaaaaaataaacgagtagaatgatggttaccaggggtggggggaggggaaggtatggaaagataaaggtcaaagtgtacaaattgcaattatgtgggatggatatgtctagagatctaatgtaccacatgaggactatggttagtaatattgtactggattctgagagtagattttaggtgctcttactacaaaaaaaagtaactatgtgaggtgatggatgtgttcatttgcttggctacggtaatcatcactatgtgtttgtaaatcaaaacataatgttctatatcttaaatatatacagtaacaaataatgctatttaaaataagtctctgataacagcagaggaagcaccactaaactcaatggcagagagattacaagcaatgctattgtttcctgataatccttcaaaaaataaatacctcagcaagaagccaaagaagcaaggaacaaaagaaaaattctaaaaagtcaaggaaatctaaataaagagtcaaaagatgaatgcaggaaaacacaagggccagaattcaaatagtggtgaatggagagaattgggtaccactggcttgcactctgcctactagactcttggtaatatttaccttctgaccattcttataaaacccccttgggatgactaggctcccaggaaaaacaataatgtcaggtaataccagttgcatgcttggatatttatcttcatccaatcagcagtacagctgttaccataataccctgatcaataatttgctacccaaaccagaacactacgacctctaagtacaacatatttcaaactaagggcaaagactcctaacagccctttctcaatgtgctgcagtgggagtggttgagagcactctcatgtttagacagcaataaaacactgttttgtaaacataactagaaatgcaaaataggcaccactttatcttaaacatcaatgcacaaaaacctgtattattcgaaacaaagaatgaacatgctgaagtggaattactgacgtatctgaagattttgatacagtcaccagacccagcccagaagctgctcaacagctcatgttacccaggtaattttcccagtcccctaaaaatatttccaatttggtttagtaatggtttagatgatcacaagttaaatgtcattcattcattccttcattcaccagctactgagtaccttttatggacataatgttgaactagaaaccagggagttgctaggagaacacaggaaccaaaagaaataaaagccattatccctgcttataatgtaggtgagagaataccatgcagtgttacatatttactgagctcctattatgtgcaaggaattgtatataagaaaaagatgaatggggcatggtttgactccttggtccagaaacaaaaaaaaggcaaaatatttctgaaaaaatgcataacacaaatgcaacatgatttgctgcccactaaaggaaggggaatgatcacagctacgtgcaatttgtaagaaattgtttatttggggaaatatacatatattccattgcattttaaaaagagttatattcctcactaaagttgtctctcaggagacttatctaacaggcatattctactgaatttagtatgaagacatgcccaagagttcaataaaagactttaaagctaggtttaagatgcattatcaatacttggtaattgccttccttctcaaccaaatgccagcaaaaatcttagtcaatcagtcaacgagtatcaaccacatacacagtgaggatgaagaatgtcacaaacagtgcccagtttcacaattctaatatatgcttttaagtacaagcctctgcaaatggaagtgtctacagctctgtggtcagtagggcatgaactgatctgttgaccagtctgtggctgaacagattcatgctgatctctccactaaataatacaaaatctacttggacaaagtcaggtcaagtctctgctagatgtttaggtagaggtggaattaatcagggaacacttcctgaatttgagaggttcctgtgattttaaaatttgagaaaattgcaaacaagaagacagaaataattccaggcatttggaaaatttgaaagaagctgggagtaggaggggatgagaagcgtagtgcctggcaatagaggtattaattgggaagcagtgtaagggaatgattacgaatttgactgttggagttaggtaatattagttcttctggttactttctgtaacttggccctgggcaagttacttatttaagcctcactttccaaactgtaaaatgaggtaacactttcaacccatcatggtgattatgagaattagataagactagtttttatttttttaattaaactctgtaaaactatgtttttaacattgtcttaagatgttgagtccagtgctgggcaagcccaaagctactgtagtattattattattggcaagaagaagcctggcgaattatcaaactcaaagcaagagaaaaatctttactatgtggggcaaaaggggatcccttaaatctttcctccagtttatttgccaaataaacaatgttcttgaagacacccctccttatcaagcactccatgacttctccagagctccatcgtcgcatattgttcatggacttccttccaatagcagccgccccacctgctttacaatctgcgcatcacattcctctctgcgccttccctgaaacatgtcctcttctcattctctcatttttgttaaccaagcccaaattctccaaatcacccaaggttgaaaccacagccatttttcctcccttttttcaccacaacatccaacctatcacttaatatgacaacaatctttattgatccttccttcgggaagtctgccatatgcattccttcctttcattgtcaccatcaccccctaattcaagctctatgacctcaagcctgaaaacctcaacagcttcctcaccaggcccctggttgcaagctctaagataacctttcttcgctgatgccaccagataacttttaagagtccctggtgtctaacaaaccccatattgtctttttttctgctcctcctgacttaaccttgatattctttatgcaagtcacttcacatgcctgggcctcagtttctccattgtgaaatgagcatgctagatgaaatctcccctcatgttaatttagtacaattccaagatcccattcacttgtatctactttctctgctgctctattagatgagtccccagtcatcacttggtctttcctcaccactactgtgttgctcatagcattgtctctatcctgttcagttttttattccaacatctagcataaatccgtgcacatagtaggtgataaatatgtgttaaaataataatgagatgaaagccgacgtctaaaatgcccacgtttcctctccgtccatggaaatctctctacaccttgaagatctgtatcttttttgttgttgttttttgagacagagtttagctctgtcacccaggctggagtgcagtggcgcaatctcagctcactgcaacctctgcctcccaggttcaagtgattctcctgcctcagctttcccagtagctgggattatgggcgcgtgccatcacgcctggctaatttttgtatttttagtgcagacagggtttctctaggttggccagactggtctcgaactcttgacctcaggtgatccacctgcctcagcctcccaaagtgctgggattacaggtgtgagtcactggacccagccttgaagatctatttcaaaggcaacctccaccacattagcttccctcttcactcataggtttcacagatctcttcccacctctaaaattcttagagtagtttgttaatatcaggccaatgctcacatgtttccttagtttttaaggacactgaaggcaggggctaattcattgtctcttttatttatatggtgcctagaacagggctttgtccacattttactatctacattttacccattgtctgattgtgtcacccgggtaagtcttgcctccttatacagctgggcatccccaaaggaagggaatcccaagcccatatacttggtctgtaattatcatggtttccggcaaaattctaggtacacagcagatgctgaaaaataatgtttggtttaacaatcaagtatggtatgtgtggggtagtataccttcaggagtagcagcaaccagccctggcaggggagaggaaggctaaatcacctaagtatgagttactgagggttcaaaggaaatgatggaggaagatggtgaacatgcactcaagaacaagaggaaagtctttcgcagcagactgtacatggagaacaaaggacagatagagacaatgaccccaaggcttgtggttttagggggaaacagcaaactggtttctgatccctgggagcacataaacaagaagttaggcaacctggtgtgtgctgtattgcagagtcagccttgtgctaaagattaacagcccgtcttaaaggggactaaagatcagcagcaagcttgcaaagcaccaaagacctcattgacagcagacggcagttgcaattgcaaccagcagttctctgcaaaaaagaggcaccactggccaggcacggttgctcacgcctgtaaccctagcactttgggaggccaaggtgggtgaattgcctgagctcaggagtttgagaccagcctgggcaacatggtgagaccccatctccactaaaaacacaaaaaatttgctgggcatggtagtgctcgcctgtaatcccagctactcgggaggctgaggcaggagaatcacttgaacctgggaggtggaggttgtagtgaaccaagatcataccactgcactccagtgtgggcaacagagtgagactgcctccaaaagaaaagaaagagtcacagcttgatccttcaaccatcaatggaccacctcagtcaagcaaatatatccttgaacatggcaatgtgactggccagcgtttctgaggattcctgatagaaaatacccatttcttctctgacactgaggagaagcagtaagaaccaggaaatctgagttctggttaaatactaagtcctaagttcctcatctgtgggaagacagaaatcacacataaccaagggtagtgattgacacttagcacggccccaataaaatgtttatgagaaggctggtaattcaggtagaatcagatctattaagagagaagacccatgcatggtgtctgggacacagtagggactctataaatgtcttaaaatttccttgggtggcattctatcaacatgggtatctcatttctgcagttcagtgacaagtctccttgaggactgaggccttgtgttagacacctttccacctcttaccgcacctggcataacaccttgcacataataatatgaactcaagaaatatctggcgattaattgcctcacaggtagcatctgcggctgaaatctatttcacactaaattggcaaatgcaggcttcagaatgtaggtaaactggtcaacctgagaacagtcttaaactttgatgatcagcagcatggtttctgatgaaatgagtggaaactagtatattgttaagtgttgtaatctacacatgcagttatatggcttaaactgagacagcccacatttattcctacacacacacacacacacgcacacatgtacatgtgcacttagaaggtggtgaataatagttgatgaagttgtttgtatacactatatagagacagacagacaagaattgacagagcaataggctcacaaagagttgtgaatatgtaagaaagaaagataccaggaatagccagcctagtgttttaaaactgcattttctttgctttctgcttttaaattacacactgcaaagtcactgaggagaaagctttaagaaaactttcatttgctatggtacagctcgcctttctttacctaaaaaaaataaataaagccctagaaacatttctttcttctcatagacattaataatgatagcttgaactgtaaagatttggttttactgaaggtaatggagtaatgtttatttccattagactaggcctataaaatcctctttttataaccatgagcctccaatttcaaaacagcaaagcttgacattttggtctctgacaggcaacacttaatattgggatgttttaaaaatctatatgaaaaaagctcttaacacaagataggccgaacattttccccgcaaatggtttgttttagctatctctcttcctccctgatggaccaggaaaatcagacagcttattggcttagtttgttaggccaggttaaagggatgcaatgccgaaagactcttacaggagcttacccttgagctaaaaatagcaggcactagagaattatcttaaatacgaccaaacttgttcggtactgtgaatgcagataactgtaatacgtttccattttgggtcatttcagagcttttttttttagcttggcttgctgtagctgactatttaattcatttctgattctatttgtcacatttgctctcagagataccgcccgggggtgcttgactcaagaatccttcttattttgctgcgctgcttttgttaaaacctaatgagccattgaactgcggagtgcaatgtagacgggacttgttagaaggcaaatttattttcaaatgttattaagaacctactatgtgtatcctttttcttgtcttcctcctaagaggtgggaagtgcagtttgctaaattttataaataaataagagggtatttaacttctgacttattgaagactcacgagtaaaaaaatctagcaacaattatcaaatttcctctcttctcacccttttcacggacatttttactcctctatgtgtgtcttcatggtacttcatttctgactttaatacagaatgcatccccttattttataattagttgccgaagtctgtctttctcactagccaaccaactcctgaagggaaaattctgtgtcgtaggcattatgtacttaatacatctttgtattatgcgcacttaaattagtgcctagcatgtagttgttgctttttaaaatagttgataaatgggtcagtttaagaatgaatgaaatcagtctctgcattagagcatcctgcataggaacatactgaattataacatgacagtcagactaaaatcctggactgggtagactgtcccgtctaaaaaagataactcaccagcttttgctaaaatagcagtgatgtccatatagtcaattgtactacagataccagaaaagggcagggaattaaggtgaaggagatcctctctctgctatttttgcatcctggttccaatgatcacagactataaatgaaagtaaggtcagaatcattcacaacttctgaaagatctgaatgccttgagaaattacccatcattccccagcccaggatttctttctagcccctaagcttgattcttccaaaaataaggcaactgcgatacaagtatggcacagtaaacttgtacaatcatgcacacttttccacaagaggtaaactgttttcattacaatcgtaaacgaggaaactacaacaacaacaacgacaaaaacagttgcaaaaattttaagtctgaatccattgagagggtcaaaaccagccaggaaatacgggcacagtgctgggaacagcgtgttgggaagctgtggccatgcatttgcatgagcttcctgggaacagcgggttccttgaacagagacacacttactttcatgctctggaaccccggtaaggtacctgttcctgagctcttcattgagtggcagagccctttcctcttctcggggagagaagagtaaatgctctatgtcttcagtagacatatagcagcgcctttacccgccaatgcacattcgcttaacacaaccacatgtctcccaactccatatatcttcatctgaacagcaagtcttgtagctgagttagggggtaagttcacagacactctggcagacacacagcatactgctgtcactattggctctgtttataaaccatctcttggagaacatgttctcagatcttggatatgtcttatttttagcatgattggtctgaatggctgggaaggtcatgttatattctctctctctttctgaatttggtagagcccctgtaaatctgtccattaacaaaaactagagagagttttaatgtgcacagctttgtgctagggactgaggaggtgatgaggtccctctttccctcatgcagtttataatgcaccttgagagatttagccaaaaagctattacttagaaagctgaaccacaattcgaaggccttaacgaaagaaaaagatgctcttttgcacatgtgacaacaaaaattcactttgtgccaaagacggccacaaatactttcctaaatttcgggacttaatagtttatcccatgcctggtaaaggcttaatgtaaacacagaccaaaacaaccagtctttaaaatagcatattgtgacaataccgtttatggaaatggtgtctatggaaagtttcctttcagttctcattccttaagactcatttccaatggcactcaaaggaagacagatttaatttctgataactcccaactgcacaccttattttatccctgcttctgcacttaatttgcatggatactctcctttccactgcttggtttcatggagggtgcagagatggcagggcagccagccttgcacacagcctggaatcagcttgtatgtcactggatgaaaggtcaggtgaaaaggctcaccactggcaccattaatctagtcactcagggaccatccagtggttcaagaatagcttgcaggtgagtgatggacagggtcatggctgcctggctgtatcaggggctattacgacagccataaagagaaaggaaaaaattgaacaaggggaagaattactcctgaaagagacatgaggaaagacacagatgtcttcgtacaaaggataagcatgagagaaagtagcaggggagctggactgctcacagtggtcgaggagggcagcattctttgaaactgccaaagtttgaatattaatgaagggttgtggcccgaccaaggctctgggtccgtatagagaatcttgagctgtgcattctcaggtgaaaggtgccagaatcagtcaagagagtttggatagagaagatacagctacagcattccctaggtttttagacagaaattagatttaggaagcccagtcctgtacattatctgaaattctttatccaaaggcaagtagcagatcttaatgactgttttgaaagctctaaggttgttcatttatttataagagtctccaaaggaaaatggcacggcggggtgggcgggggggcagttagtctctgtagtgatattacgatttcgtatgctccagatgaatatttacaagtgagttgtgcattgctggggtggtggcttatttgaggactgggtaggataaatacggaaagccatgaaggagaaaagtataggcgatttcattctaaagtaatgtgggaaattgcttacttaacgataactctactgagctatatttgtcttgaccaacgtccctgtagccaaaaagctttactattgataaggaaaaagaatccagtggtctctttattcaagaaaatttcaatagctgtatttttaagggaagatgtaatctaacagattataaaatgaagttcggtatttcatggagcattttcttctttattatcaaagtctacacaggaaacacttacaggataatatataaactccattaaaatctgttagatctaaaactacgtgtttgtgtttgtatatatgcctcacctatttcctcacatgatcaggctttaatccacataggcactggtgcagataaatcaaagaacttaacttgcttaagcaccaaactttttattaaaacttttttatggaaagatttccgaatcacgtatttacatattttccccactttaaaaattatgaggattgattttggtagcactgtctggtattgcaaaatgactgtatggacctattgagaaatataggattattttccctcaaactaaaaggccccagactgtcatattttcagggtttgtcaactttctgtagtttgtagtcttgtctcttttggtcagttgtcactgctcaccattatctttttactgtcaccatttcatgaattttctaaaccatttcttcaaatgtcatatgtgctcatagaacatcacatattgaatagaacattagacaaccggattcatttaaatcataagtaaagcaaaaggaagcaagcgttaagtgaggggtgaagaagtgtatctgggaataaaatgtgctccatctgagggaatttttctgaatctagtttggcttctcagagacattttaaaaacagtgtacttctcacctatgtttcagacaattaataatcctaaatttttaatggctacagaaattaggttttccagtatgaattataaaaataaccataaaaatgcgtactatctatggaacatacatcttctctttcaactataaaagatgtagctggaaataaaaataaaccagcaactaaaggaaaaaagtggtatccgtgtttttttttttttttcttttctataccacaaaagcagcagggaggtcacacagtcctattggagggtatcatcccttatgctgaatcacagaagaaacacatttgccattgaaagacaaattaaacagggcatggcttgcactatgtgggtccccagacttagttatctgccaagaccaggcaacattttgtaacctccaaatgtatcgaaacacagaacatttgttggctctttgtgaacagaatgtctttgtcaaaattttcagtttgaacaaatgttgcaaagtggtccagactagatttgtcccaggagaaactgacacaaagtccttcaggacaggggcagccacctcagctacattgctgggattgccggtgataggattaaaggagctagacagtggcattgtgacctaatgtaactctcaaatctgttgcacgcagagccctggaattggggaccagcaaggaaaagaagtcacttatcctatatggcattgctgtgttcaaactttcaggcatttgcccagactcttctccagtgggaataggaggtgaacctgcctatcagacagcattgcctaaatgaaaaatgcatgctgagatatgcagctcagaggagagagcagggtgtccccgctaagtatgggctggcaagacacaagaggattctgacatgggaacatatctggagagaatctgggttggcaaggatccctggacacccaggagaactatgtctggaatacagaagctctaacttcacatctgagcaaatgagatggcacccagggaagctaatgtccttaagccaagagcccatggaaaaaccaagggcagtgctataatagaggcacttttcccctatacaagagccgtttcaaagcagaaataaatttctcagaaagaactgtggagaagaggatttaagctcgagtattataggaatctgaaagagacctaattgagtaaggcttggtagggatgtaatgcctggtacctccagagggaagaggaaagggatcggtagcattcttcctgcacatgcctctcccaagggtgcaggatagcccctgaatagcattaccccatgaagcaaggagctatcacttagagatgatggatccaagagagagagagaaaagccacatacaccaagtgtctcaaacaggcaaaaagcgtgtcagtccttccagctggactgaaataccattctcaaatagaaaggtcaacagacctaaaatggtaccaaacagttctcatccatagaagccccaccaagggcacagcactctggtcaggtcagacttgcacactggttaaagaactctccactgacggtcttgctctcttcccttggttggcttcctcttgttttccctccacactccctggccacccagcacttccaatgagcaaactgttattttaatatactgtgtgtaggacatcataaatttcaggtcttccaacctcaaatattctgtcccactgccctgcatttgttggggcagtgggacagatcttggtttggaatagaatattcctctagctaggagaaatgctctccagcagaattccatttcaaggtgaaggcatttctaaagacaataagtaggagaagggcagaatttatctgctagtgataactgggtaacagacagatggagaaattccctgctctacttcctcaaacagacagcttatcttatttgtaaaaggcctgtcttcatcactaaccaaaattttcatggagccagagactaggtttacttttaaccactgtatccccctaaaatggccagacactaagcatgctaatggatgacaattatattttgatgaatgggtaagtaaataagtgagagatgaacttttaaaatccacaggcaagaagaaatgtgacgatgttgcaaaagttggaaactgagagctttagccagtgaattggttcttgtctaagaaaatgtgggccgggtgcagtggctcacacctgtaatcccgcacttcgggaggccgaggtgggcggatcacgaggtcaggagatagagaccatcctggctaacacggtgaaaccccgtctctactaaaaatacaaaaaaaaaattagccagtcatggtggcaggcacctgtagtcccagctactcactcaggaggctgaggcagaagaatggcatgaacccaggaggcagagcttgcagtgagccaagattgtgcctctgcactccagccggggcgacagagcgagactccgtctcaaaaataaaaaataaaaaataaaaaataaagaaaaaaatgtgaccagccatatcccaagtgatatgggatgaaaagaaaagtgttggtaataatcccctgtaatattgcatagtgctttagagaaactgaagtactatctcaaggtgttgaagttagcagcttaagcgggtaatacagattgcaatgcctttttgtcttcaggccattggaagaaagatgaggaaggttgaacacatctaagaatttctcaaaagtgaaaacagacttgcatcagtttctaccatgcctctggtgcagaaatatcagccactgtggaaactggtctctgagtttctccgtagctaccggcaagcacatttcattcatcctttatctttttagtaaggtgcaaatttggttcaataatttttttctgcatctctttagatgattctctatctcaactaagtttgaataaaatgtccagctttcattatttcctaatgctctagtaatacattaagagttaactggggtgaaaaggcaacaagaaagcttgccagagtatagttagagaatttcatgacaattagcactgatttgcactacaagaatagaaagaaaaaaaaagaagttttaaaggggaaaaaaagctactcacacatacacaacccaaaaagagcctccaagtactagctgaaaatgataccgttagatgacagcagaaacacaccagattagccaattagcattcacccgagaaaagctagtgctttggagggaggggagaaaaggaacccatcaacagtaatatcaactttacaatagccttgactggttatctacccaaaggaaatgctacctcctcacttttctgtgaacctctcaacaattctgggggaaaaaatgttagttcaacattatcgcaagccagaatatgactctatttatgtgacaggttgacaacatacaatttcatgcttgttgaactgatcggtgttacatattcactgtgaatattatgaagcttcaccattataaatatgaaacagtatacacttattcaaagtaactccagaagtggcaatttatagcttggttgtttgtgttctgatgaagtccaaatgccaccttaagaagctgcagctcgcagaaacagatgtgcagtgtgactgcgaccaaaatggattgacgatgacctatgtgaaagcaggctattacattttggtctgcatggcagctgacactggtttgtatttagatatgtgactcttgggaacactgtgtccttaaagctctgtttaaacatgggccaagacatttgtctattggactaattattttaccacccttctatggcaaagatcacttttttccccctaaaaaaaaaaaaaggatatgagagagtgtatatgcacatacacaggcacacactctcactacgctttgtaaaattacagcaaggactttaaaccttggtcatgtcaggtgaatgttggcaagatttccagaatgtctgcatagcaggattgtaccactttcttgatcaggtgcttgagaacaggacaagaccacaaaccatcaaatcataagctgtcacagcaactgcttttggtcaagttttttcctcctcttccctacctcctccctttctttctcttagcaagcttcaaccaatttacaagtgttcgcttccacaaggacaaatttggaagagtgaagaacaacacaatttatccaaatgtgggatgaaatgaaggaaccaggcaccttgctaaagctagatatcaaaaatttgcataagtagttttgcaaccacagaggtgctatttggaacaaaataaattgcttgtattgtatgcaagggtacaaaccttgaccaactttgcggtgtcttccctgcttgtacatttcttaagcacatccagatattcctactaagaagttcaagttagtatccctcaatagggagacctaaaaagataattgtttgtggacttagaagtcctcaacatctttatttgagaattaagaaacatcagtccaaaatatttgaaatatagaattagttctccaggatgttcttgtaattcttttgtttcttttttgtttatttgcttaatattaggtcatatccctagctctttttttgagatccagcacagaagtcagtgactggaatcctggctctcttctgaaacatttgaattacagtgttttggaatttcctattctaacaaagtttgttatccaaacctgtatctctttctacttttcctgttgggctaaagtgaaggtgttgtcggtctgtctagtaaatccaacctacgagataacataatcacatacattcatttctcagggaccttggcggctcttatctccttgcttttatgatctcttatgaacagcccggaatagcaatttgcagcctgtttgtaaagccatcttagtctgaacccagccttcttctcttttatcacccagcgatattcttcagctaaatcccattcgccacagcaaaatttgctctgagatccattttagaataatataagtattctctgtgtgtatggaacatatcaaacacgtaatggagggtaattatcatttcaatgaactatttattaatagaagatgttttgtgtgctttgcttagatttattgctatgctgcccactgtacattgtagcttgaagctatttagttcacgttcatcagcctctcaggcaagcagctctgctgttcacacagttttggtttttctatgtgcttttttcaactttattttaccattatatcacctagaacattaaacacaatgctcaagttccacgtgttaaatcacaattgctttctactaaagttccaagctacccatttttattaacagttactttattaaatccttaataacacagatagcatagttagttaatttgtgtgttgagccatggatgttaatttgtaaacataataacatactgcaatcatttgcataatagcattttaatctttttagtaaaagctgtaattccctacaaagtacactgcagtagaaactaagtgactattggtaataatacaaaaggccttaaaattctgatcctattatagtgctggagcatacccaaactgcttccataatctctgaaatgttactgttctctgatttaggtgtctgtgtcaagaataaaaatgaagtataactggtagcagtagactatttcctaaatgtaatttagtattcactaagcaccagcattttgcaaatagctctgaggctttccttcaaagttcagagctccagctatgcatattgtgtgaggaggaccctggaactcactctcaactctgtgctgaagagagggctctgataaatcatgctgatttggcgcagggaagggcatcggccaccagggatttgactactgagtctccttcctcctctctgccctaccagcctgattgctcctccttgaactgacggtttctgagcagaagttcagaaaagaatgaaaaagtgcagtgaagctttaaaaaagctagtttaaaaaaactcaatgggggctcactccctctacagcccattaacacccattgtaagactgctccccaccctaacccccaaaaaaagaaaaggagaaagaaaaaaaaaagtagttgtttaagtcaggccaagtcattttatgcaagatctggtaattcattaatccatctggctgcaaaccttgaatgaataacttgcagtagtaatggagatgggcaggtctacaaaatattagtgtttagaatctgaaactgtgcaaatcactccatcattttggaaaagaaaaggcacaaaagtatcttctatcatcactttgggacaaatggcttaatggataagaagtcatttagcttcaaacaactctgccattgccaagaataagagtgtgtatttcattgtggatctctctccccttttccctgctctcattctagctacagtaaagcataggatgctgccttgctttcaaacgtacctctgagcgcacagtcttaaaagttaaaaggaggccgggtgcagtggctcacgcctgtaatcccagcattttgggaggccgaggcaggcgaatcacgaggtcaggagattgagaccatcctggctaacacggggaaaccccgtctctactaaaaatacaaaaaaaaaaaaaaaaaaaaaaaaaaaattagttgggcgttgtagcagtcgcctgtagtcccagctactagggaggctgaggcaggagaatggcgtgaacccaggagggggaggttgcagtgagctgagatcttgccattgcactccagcctgggcgacagagcgagactccatctcaaaaaaaaaaaaaaaaaaaaaaaaaaagttaaaaggaacctgagaggttaagaagaagaaaaaaaaatggcccttactgaaattgttttacatcacaggcaattcattttataaaacccacaataaaatttttcattactcaaagaataggcacataattatagggacaaattaaccttgttagatgtgaagtctgggatagggaatggtggaggaacaatttggctctctgctttaacaatgtggtctttaatgttcagctttttatctgctttgtgtgttgattccatccagaggtgagtcatctgctgggctgtgcttccaggacctggcgtagagatagtggggcatggacaaataaacacagcaagtgtataaggtctccacacagacacatggttgctatacaaatagacagtttgtccaatgcagcaccctgaaccttgtgattactttcacctacactattatctttgaagtaaatctaagaagcaatgagccactttttcctgattctgctccaagatttcctccttgtgaatttgggtctccactattttggccccaaagatatccaggcagagtaactttgatgagccagttgagactccgggaggttggaaaaacctacaataagcccataaaatgtcccagtttactttctggagtgcctagagtatctgacatgaaatcattggtttctcctatcccaaaatacaaaatagcactttctgaaatccttgtgcctaatgaaacatacacattctcactttgcaaactgcaaatggctaagaaccgaatcaacgtccataaaaaaaaaaaaaaaaagcagccaatttcatctctcctagccacaccttccattaacaaaagccaccagcaggaaagttagtgccagtgaaagatggtcacgtaacctgcatcctgtgagttgctatttattagcaggggttgataccaagagacagagccctgtgggtcagaactcctgagccatatttttccagtggtcagcataatggcagggaagaaatagggtgataaaccagatgttcccaagataagccagatgttatcaagccgagaagtctaaaaccacagtgcttaaatgaggtgtgtagatgaacacacacacacacaaacgaacaacactatttagtctccctgcaagataagccgacaggagaggctgaaaataaagcagcacacaggctgggtcagattgttgcttcctgatttatgactctccaagatgaacatctaactgatttatacccagaatttggaattttgtggtagactacaaatgcaaagataagtacaacataaatttttaaaatactccataagtctccatgagtttcaacattcttcaatgttcttatgttacagccaattatctctccacttaaatggctattattttcttacttgaagtctatgttctctgtaagtgtcattaccaagtgtggcaaaaatctggctgtgggccgtaaatttaatttaaatgacaaacatttattgattgcaaattggaaatcccagaaatcttataaaagtgattattgtaaattaattcagtcctcccacataacaaaaaagaatttattcttccaatgattaaattaaggtgaggttgtatatacatgcattctttttttcttgtctatttgttttgttaaaattccaggaggtttgccattcatagaaaagtctgtctgaccacaggcacagtcagaagcaggaattcattaccatggaaggctgcaggatttcctccaaggagacaagtgaaaaaaagcagacaccacgtaaatttgtggattgggttaaatatgttctgtccctgaggcagtggaaagatagagggcccctttgtaaaatgactcacgagtctaggaaagtacttcagctcctaaaggtgagcagaaacttaaccaggaacgatatccacgaggttctgcttctctttggaatatctttgagttagcattccttaccacctctctctctatccgaactcagagttatcagggctgatggaattttccttcaaggtactttgaatctgttccctgaatgccaccccctctgctatcaccttgtcccttccctgtacctgtatcacattgggtttggaatgcagcactgcctgctgtctgattttccgtatttcctacttgcctacacctcttacgactgtcagcattatcactcttaaataccacctccattatgttgatctgctaaaaaatcttcaatgacatcctactttctaaacagactctaaacatttccaactgggttctcatgacccaccgtaattttgtacctaccttacatccaaacttactcccactactgccacgttcccattaatatgtattttactttgagtaaaccaagctcacctccacatcccgtctatgaaaacgctctgctcttctcttacaaggctttgtgaatttattcttgctgtttatctcctcagctagaaatacacatacatacacacacatatatatgcatgcatatatgcatacacgagctcgcaatgtttgcaaattgcaaatatatatataatcctatgtaggtacatacacatatatacatatacatgaatatacagtcttgtattgttttcgaattgctaagaactaaaaacatatgcatatacttgtatatttgtatacacagccttgcatggtttcctaattgttttacatttgttcattttgcctcccaaactagatttaaagtcctttaggacacaggccttcttttgtgctttgtatataatcttcacattacctaacgcagttcattctatcaataaacacatgaagatcaactcactcattatgcaacaagtatttgttgagttcttactttctgctattttctgagaaaatatctagaaaaatgtcagtgaacaagacaggcagattccctactcctcaaatgctcatggtctgttgaactgccaatatttgttatttttaactttttgataggtacataatatatgtccatttttgcaaaatttagaatataactgaaagccaaatgaagaaaagtaaagtatctatattcccactagaataaccaagtagccttgaaagcgtccacattcatttccttgattgcatatagcaggataatttacacacaaatacaaaaccaccactcacccttttctgctacaaagttcacagtttcaggcttcctgagagttccagcaatgaccaaacatgaacgctggctacagctgtgagagtccttctccccccatcagcaaaggcagtcctcagaacgtattacaagtaatgacctagagacgactgcattctcacttgccatcattctaacgaaccccaagtagcttcattcagaagtaacagacgaatgaatgaaagatgcccattcagttgtatcatggaggcattaaagcaggtgttaaaataaaccagggacaaggttgcccacagtgacccagaaaggccaatatgctatttaaactaaccccatgccatccatctttacagactgctgtgctgcaaaagtagtcctttattctcctccttcaaacaatgcacaaaggcaacagagggaaggaagttatgttgcaatattctgaaacataaatcttgctaccagccggtccagggacgcatcctgttttccttacacatggatcagattcactggaggctgttacctctgagccttttgctttgttttttaaagtggcttctgaatcgtacctggtcacctgcatttacacatccaaacacaggttgcgtaagcagagaacattgtttgcgtgtccagttactcaaccaacatgtgctattgcatgttgctacccctctgccaccacccagaattccctttctcaaattgtgacattcagcttcattttttatcattattaagtttgtgatgttaaataaaaattaaacttagattcaaacatatggaagaaacaaaaagaagagatacataatttactctcaacattttaagactctgccactctattatatatccctaaatcccactttctgctttgatgagaattcagtcgatggccagtttccagtggtgtcattgacgtgctacttgagtcagggaaaagcatttaactactcagtgcctgattttattctgggaatccaaagtagataatgcttgttattgtcagatcagagacagcagagcccgtgactgtttaacttactcaagtacaaggccttctcaaatgtgatgaggcagggctttgcaaattggaagaaggtgagtgcaggtgaaaagtccactgtgagtggccggccctgggaaggcacttccctgaaatgctgctttggtagaagcaacacaaacctgtggccatgaaagagttatctggtttcatacgaaccttcttcacagggaagacccaattttagaatgtcacctgtgctgaaaacacgctttcctttcacattacagaaaagatgcctgagtttaacactagagggcaaagagtggaggtgtcctcatgccatgcaaatactcctgaagctgctgctgttggtaagggcattgccacatatgactttaccctttgcctcgataaagaatgggctttgtgacatcagagaaaactgttatgggaacttacctaaacagtcacttttgccctctgacactaagaggatacctgacatattagtcctggagccccaggcatcccgatatcgttatacgacttctcattctttatatccagtagcttactatgtcttctctcagaaatctgaccaattaatcattagtaatttataaaggggaagcctgtgactttatttaaaagcagggtttttcaacctcagtgcttttttcattggaggctgaatcattttttgtggtgggagctgtcctgtaggctgttggatgtttagcagcattccttgtctctagtctctactcaataaatgctcgtagcatccccttgtccccagggataacaaccaaacatgcctccagatattgtcaaatgtcccgtgaattggggtgtggggcggggaccaaaatcgcctttggttgagaatcattggtttaaaatgacctaatgagagactaaattaaatgaacttctgttttagagtgctgaaaataattttattagcatagaatatgatacagggagacaaaaagggtggcatggcatatattaagcacctacatgtagataattaactagatgctgaaccaagtctcctgaaggtataaatgcaaagtacctctcacaaataccacaacacaaaatatagggacataaaagttatggagaaagttgtattttttttaaagtagcccaccagagaggcattgactcctatgccatctcccctaccgctaagttattctctagcctctacaaaatgcatggcattcacctgatatgaaataggtgatttttagataagaggtctatggagatggacattttttaaagcattgtttatttaatgcagcatgacttagaatgggcctgtaacttgacaagtgtactgagtgaggaatgttcaatttaccagttctaactggccaagtcctcacatgaactttctaagacccggctgagaagcctgggaaagtagaactaaccacaaccttcagtgttccctccaccttgttctgtctccccagtccaaactctactaccttaagcattcttctaaaacccacttaatctccagaggtattacaaaatctcagccataggcagaacctacagccgtctcggctcaccagctaactctacctccgtgccaaccaacactgaaaggaaagattctgttctatttttaaatatattgagcaaagaagcagcttgatatgtctttgtaaaggatggctgtcacccaaattcatgggttctctatttttatcaaggatataaactttgaagtccgataaatttggggttcaaatcccaggtctttattgtcaactgtgtgatttggggaaaacaaataacctctctgagtttcagtgtctgcatatgtaaaacaggaatgataacaataggacctaacaataggttgttttcaaggataagtgagatgacatatattaagcatgagtataccaaaatgttggccattattgtcattactattattgttatcaacattaatatattcatcattctctcatgatttaacaaacatttattcagcatgtattatatgctgggttccagcaaaactcagttaatattttaaacttggctttcttaagactcagatttcaaccaaataacatggaagtataagaaatgtctttgctgatgaataagaaaagtccagcacatagtaggtgctcagaaaacattagatgatgatgatgatggcactggcggttgtgataaagaaaactagccgatatgtcatccttcgtttaattcacttgccagagtactcactaaatgtttgttcctataaaaaataatgtatttcaagtaaatgagtactgatcttgtgggaaagaattccttttctcaaagtaacactttaataggaatagattaacattctttattatagggtaggcttataataagagtccggagtcacggaggtaattcttgctactgaaaagtaaatgaattttgactgatttataagtatacagtagattagtcaagtttagcaattcccattatataaagaaattagagatatgaaccaaaaatataattaataataataatcaaaagagctcacctaattagtaaagcaaacaaaggtagacatctacccccttggttaaaaagaaaggccttcttatttattaatttatatgaggtaccatttattgctcattctttctgtgggaaatagacaggaataaacaggtttagacttttgttcttctttgtcactaatctttcacaaccctttagtatttcaacacagtttaactcactcacagttgttgattcctagtccctagttgatttattttttaaatctttaaaaaaataaaaacaaaacatttgttttccaaatgctgtttttccataaattagaaagtatgtaactgtgatgaaaagtcttttgatgatagcaaagtaagaactcattatgcattcaggtctattaccatgttagtcgggcccaagccaaactcaatgaaaaattaatgtttccaaaggatgtccttacctcaaatatgtttgaaggctcattgttgtactgattggatattatttctgattggtcactgcaccacttgagtccacccagaaagctgtctgtatccaagtcgttcacatctagttcagaaagatcaagttcaggaagatctgggcaaagaggctggtcttcaccaaccagagcagcacactgcaggaggcagaaaaaaaaaatttaaaaaagcttccattaaccacaggaatttattaaactgcaatagcatgtgataggaattaagcctagttaattcaactacactaccaaagctagtttctggcactttaatcaccaggaaaaacatcctaaaatctttactcacttggctcctgaaggataatttccctgctttattccatccaaaagctacctccaaacacatggtaaataccaagctccacgaagctttctctgattcttccagttagaaatcaactagatatttttggacctctttgtacaaaatccttgatacctgtttgatagttactgcttccaaagttttaaactgtcttatagttaaccataatacaaacttgattttaccttggaaattttatcacacataatagacactcaataaactattgctaaatggaaaaagaacagaggaactacactaggaaaaattttctccatttacactccttttaagcattataatccaaataattcatttagcaactaatgatgcaaagccctttgactcatctgtggttctcctgaattgttatttaaatcatttactcttatttgactcttcatgactttctggacttcatccttaaaggcaaaagcaagttccttaagatgaaggacaaaaatcataattttttttctatacggcttttgtatgtaacttgcaagatgtgtgtgtgtgtgtgtatgtgtttgcacacgtatgtgtgtgtacggttggaatcacctagtacctggaaaagaaaactcacaatagcataccatcactatattttgttcattatttatgtatatctaaactgtgctctacgtgaattcaaaataactatttttgtttagagttttaaaataatttctacatattgagaggtttaaaatatctctaccatggctgggctgcttatcaccaagattattttagattgtcaaagcatttcatccccttacatgaaatagacagtctttttaactgttttaccatgcggcttttggaggcaagtggactccccttaccaatgaggtggtctcctaaacttgaattggctacctaaccgctaatgtcagtccgcagacagtaaagaacactgcaggaactcctattgcaggggtctggcattgccagaacagtaaggacttcatccacctgtaagtgggggtgtctaaatcaggaggcacacactgacgcagcaccctcatggccctgccttccaaggtcaggagagatgctgtggaattgttcacatccaggctgcagttaggcataaaatgaaagatgctccttgacatttacattttgaatgaaataagttttatgcagattttctttctcaagcacccctgttatccctggcagggattcctagcaggccacattacacaggtcatatgcagcagcgtgatcaaaagcaacacgctgagaagtaagtactgggtaatggagtcagcagttggtaaggggaggatggggggagactgaaaatcattgccatccttctctaagaccattggaccccagtgagatccctggcagcagggacaagggaatgcaaagaaagggccctcctcaccatcaaaactctttccttatcattttattggtctttccttttattatctgagttagcccaaaattacagatcagtatacttgacaaggcatataagtaactggaggctgggctgaagagatctcgttctggtacaatgctcatatttggttgtggatgtaacactgcccagactccattcttgcccacacagctgatcctccaagcccaaacacactatcttaacttttcctcaatgtcaccaattcagagatgggggagaactttttcaacggtgcaagatacactaggattttataggggcatagtctttaaaaaaaaaaaaaaaaaacatgaacaacaaaaatagcaacacaaaagtaaaaataatcaagaaaatgtaggctgtctacatatggcttaagttcctgttgtgaaacttaggaaccaaccatgttttggaatgctaaagtagcatactgatttgtggacaacttcttcctgtccctctctttaactgccctctttggcatgacttgctcataaccctttaaccttccataaatatgtatttttaaataacttttgaaaaccattgaaaagaccaggtcaatttgttgtattggtgctatcttgtcatttacatattcctttccttcctctcacttgttcgctcgtgcgctctctctctctctctcattttgcttttatgttatggttgagaaaagtgcatgtgttcttgccaatgttgacatgctaataaaatctgtgcttctgaatgtggcattatcctgctaatctaaaacacattagtggtagcaagtgttcctgttattaatttatatttggcctttggacaatgccagacttaacagtccaagccctgtaactgtcctcatctgacatgctgatatttactgtttccctatacctctgtaacaggtgtgctttattgcaattacacagacacattctactgcctctttgcaactatgacagctatttcacaactgtagcctcaattttataataagatttaagaggataaagcagtcactaaacacaaaaggctaattattgtatgttatttcaccccaacagacttttctcttagttaaggagcagacaataaattagcttaactgcactgatgataatgaatcattataattaagtataattctccattaaccttttggaggtttttgtgccattgatggtaaattttaaagagagagagagaagaaggagtggacttggccacattaattatattaatgaaaaaagaaactgggttcttaaaaaaattagttaagacaggggaaagggggtggagagaggggcagtaaagaatgacagtcttagtggggtgtatgtcatgtgaattgtctctatcaatcttagtaaccttactgtatatcaccttcattaaactgtgaaacacggggcactccaagtagctatagtgatataggcctatattaaccaatgtactaccctgtcattatgtgcaaaagggcataatacgttttaggatgacagcaaacattaatgattcaaaaaatgaaaactgccaacgctacctgctgctcgtaatattttatacaggcggaggtgattcccagagccgctgccatgtaggcaaagcttctagcagctagctgcctatagtgcaacagagaagtgactggccaatctcagccgactggcgactctatccatggctggacaagtagccaagacctttcctccttaagaaaaaaatttaaaggccactattctaaatgcttctgatgtttatttgaaaatgactgcaggaattccaatgattaaaataaatcttccttatttccatatgatctagttcctcaatcaactcctaacagcatcaggaataatacatgatggaaaaatgaaactacagcagctgagacccacagtgccagccagacaaccacccacaggacactccggctactcaaaggcaattaggactttgaagccacttataaccctgactcataatggctacagggcatatgaattatccatatctattccgccttaccaagaaatcagaacaagataacaattacaatccacaaatacgatctaccaaggcaagggagggcaaatggagccaacatttgcaaacccagcaaagagttaagaatcccgggcatgcctcgctagataggaaaaatgcattcacagacggccttggccaaattattttcactttagatgtgtatcgctgcaccacatggacatcttatttaatcaaatcacgtgtgggcttgatcctcccccttaccctacgtgcccccagctacccagaggaaacactcgcagtcttttgccagattcattgttagcagctgggatcctccatgcaattcaattcgagtccatctcaccagagtccacagaaagttttgcttgtttcccaagttgcccaaactttccttccgagagcattccattgtgctgaatgcaaacacgccgaggtcctccgtccccccactagactccagagattacgaggaaactgcttgcgttattttcccccctgtatgaattgtagccagcagagactgtggaattgatgtattgctgtctatttttacactagcagcgagcagctccacacacagtcctgcataaactctattctctctcagcttcaggcagctctccgtggtacaggaagatttaaccattggcttccctgccaccgacgcgaacggaaaaccttgcactgccaggcgtttctttttattcgctggccaaatctttcaaccacgtataggagttttaaaggaagcagcatcgttgttttgtgttctgtgggaaaagcaatctaaaatagcccagcaggattatttaggattttgtaagttctctgtctgatgaacagagagagaggggggaaaaatccggactagagtcaaaacggactatatttgaacacatccattttaatatttttatcttcgtcttattataaatagaaatggcatttttccaaccaggccactaaacaccactggaaagacttcagcttctgattcatatcaatatcttagagcataaatattgcatatgagtagaaacagtgccaaagtcacatggaaagagtttctaactgcaacagatactgatgacagcagctaagctttgatttgctcaagccatctcagagccaccttaaaatagcaaacttattggagttaagataagattgagattcttctaaaagctcctgcctggactactttcctggctcctctctttgcccaagcccatccccccttacaggaataatagcatctgagggaagcgtcagttgtggctgcagcgccgagccctgccccagctcacctcgatgtcactccatacagactcagagtcctggttgcacatgtcccacgccatccagctcctgaatgacgccagtcaagctttttcaactccaatccacagtgacacagagcacacactcatgcaggcaaccagccccttactgagagtgaactgaaggcacctgtcttactacagtccccagtcacatgacaaagctattaaaaagtaggctgggctgtcactcacccagcctcccttcccctgtgcagcttgctgctctaactcgtgacgtcactcaaaggcagccctctgcttcagtgaagtaacgctttaaaaaaaaaaaaaaagaaagaaaaagaaaagaaagaaagaaaggaaacacttagacttttggaggcttcaagcatcatgctgtgattaaagccagctttgaatgccacagactctaaacggagccctggccatataataaccaaaatcccctgcaatctttttttaatttattttccttccaaaacaagcaagtggcaaagctccctgtttcatgacagagtaactatattcttagctaaaacgtgtattccctaagaactctttaattctaagatctccaagtggactcaagctcagtttgggactaaagcaagagcttatcacatgatgcatttttatgagacattttctcattgagggagtgtttgaaagcgcaaacggggctttttttttttttttttttttttttgcttgtttaatcaacaaaatagcctgtatgtgttaaggtataaacaaactcctccacccagaattcggctgcccccatggcagtagggaataccagctcccgaagagttgctgcagttttctttgctccatataaggagaacaagccacaaaaccccatcctttcagcttccttctaattatttccatttctctcataggctcccagaaaacaagtgttagtaaatacagtcgctgctgctctgctcagatcagctttgattcccggctcctatttttcatacatgtagcgtttcctccctaactgccttagggtgcctttttgaataaacattgaattccaaccctagtgccctgggttgtgtagtttgcgttttgaaatcaagaatgtctgtgaactgagggaaaaataccaacacactattagcagaaatattcaattcctgagctttactttctattatttttcagcttgtaccttgagacaatgagggctaatgcaggtaggtgcaactgttttatgatgacactacatattgaatacataacaaactcaaggtactggacacagtggaaaaacacttcctgtaacatgacagtggtctgacttaacccttccaagttcccaggagatgtacacgtgtatgtatctgtgtgaataaacatgttttcataaaatgttaaacccaatatacttttagaatcagctcaattcttttacttgataataatttacctgaaaacaatcccccagttacctaaatataatttgtaaagcattattctactgaggttaatttacactgttcttcattgtccatctccttaaacagaaaaacatggttatttgccctaacacatattttaaatattaaattgctcaaatattaaagtgaaagaaagaacaaaagaaacaaaataccagcagactgctgcttctttcagaccatacatattataagagatttgtgtgctgtgagagctgcaacaagttgctagtaaattcccaaataatgtaaggaagttgacagtttatcattactgggcataaaaaggtggccaagagctttgacattttaagtttgctgaatacagttcaccagcacattttcccttttataaacagcagaaaattactgtagttttaattttctaatgaaagaacaggaaaatacaacctcgggaatgcttttatacaagcaattagtggcattactctgcactccccacaaagaaacactaattttcttcccaattatattctgatttaatgtaaaacttcagtaaattattaaaattcaggacaaaggtcattggctctgccctcaaggatcaactgtgaaataatattggtcacctggccaagaagagtcaatgtttattaattattatcatgtgattcttccattgtgatattcactgatacctttatttgtgtttatccaatgctagatattcatcatatttttaaaacctattcacatcttttagagatgttctttacattagaacaggctcgttataatttttgatattctaacctgcccagattgtattgttagggttttcttattttttgccatctaattctacttctaaaaaatcaaatcagcacatgcactgaaaccagaagtgatttcaaatacacttgtgttttcttcactctcactatcacaaagaggatggaattcagaagtaacaacatttaaaagactcataaactacagtatattgcatttccccctcaaatttctattactggacaaatcaaaattaaatagattcctaggacaaattagagtgctttccacgatattttttttttgtcttaaaactacaactgtaatgagagggatgttttagaggttttataattttgttaattaactcttcagattaaattttttcttcagtccagtttttttttttttcttttctcaggagaacttaaatggttcattgctcaccaaccttggtttttttctggttccccgggccatttctctatttaattctctctctgctttgactatttctcttactctctacccacagccctcctttcaccccttcgtcaactctgtctccaaaattcccaaatatctggtttcagacaacaaggatctattgaaaccttactgtgtgcacagccatgtatcacaaggactgccaagaaagcatatgacatggacacaagagagcttacaattttagggggatgacaacccttaaaaatggggaataatttggtatgaaaaaccaacgtcacttggatcaacacccagattcctcttctactgcttaaaacacaccctggtgagatacaagttcctttcattgaccactgcagttcacacccaaatcaaacccattttttctcaacaatagaaagaggtatttattaacatctgctgagtgcccccaatgttgcatatctacacaaagcctacattccatcctgataatttctcccctctgtagttctgttaacattttccagggtttcaatattagtagaggcaggagaatctatctcgagttgctaacaaagagaaaaaaaaaaacctcaagagaataattcaattctctaacaaatacgttgactgaagtgtataacatttgggtttccttcctcactcctactccaaattaaaggcttttcccatccctccatatttcagacaactgcccatttctaaaaattagaatcaaattcaaaccctcaaactcaaaaacctcagagaatagcaaaaacaattggttttgttgtctatattgaatataggtgatttcagaagcaaactcagaagagctattaggataaatatatttgttcatttgtttttataagtttataagtttttattttaataaaacaaacaaaaaactaccagactgctgcttctttcagatcatacatattataagagatgtgtctactgtgatatctgcagcaagttgctagtaaattcccaaataacgtaagcaaattgacagtttatcattactgggcataaaaaggtgaccaagagcttcaacattttaagtttgctgaatacagttcataagcacattttctctcttacacacagcagaaaattactgtagttttagttttctaaatcaagaaagaacaggaaaatacaacctcgggaatgtttccatatacactatttatacaataactacataagaatatatgtatgcagaaacttctcaagaaagaaaggtggaaagcaagacatatacagcagaccacgtatgggctagacattaagatcagcacttcatataccacatctcagtcaatttagtcctccaaactatccaataaaaatgacctgtgtacccattttatgatggagaaaaataaggctgggcaaggtttggagggcagctggaaagagcatgcaaatcgctgaaagcctttctaggaagaactaaagtttcatccataagaataataatcatcctcaaatcaaagccatagcaaagaccctggaggcaactttataactgagggacagtctacatagctggaaaccaatattcctgggaatgctgcctgcctagagcattcgtccagaaagcaaaggggcctgcctagaattgctaatatttttcaagttagtcattgttaacaggcattcaattgcttgcttttaattcctagagggactaattgatcctgataccccacatcagtttctaaacacatgctttgggcctctggttagaagcagagactgcatagaacacaaaagttggtagcaggataggatataacaaagacttctattctataaatactataaaattaaacctcattttgcttgaaaaaaatgccacagtgatgtccatgtgaacaaagaacctttgaggaaataactagaggaaaatcaagacagcttgaatgtctcctagcatttatttttatttttttaataaacaagttatgatagacaaccttagcaaaaacatctctcatctccagtaaaaccttctgcagaccggctctatggaactgagtcagcctctattttaatttggacctcaaaatgtgcttttggtgtttttcatattaaaacaaaaaataacatgaaagttaatctgagttgcagtcaattggactaatctaaacttaaagcaacaattgtacttattaagcacagagataagagataataaaagggtggttaaaatctgattttgtctgatgttcaactcggttgtatttgtgaatccacattttcatttaccttaattattccaggttaatttatctataatgcagacagttattgattatttagacaataaatgttcaataggattatctagcaatttttttaagtggaactgaacaaggcatattacatattgtcaaatttggcactatttaaaattttaaagtgctacagaacttcaatacataacataacatttcatttactaagaaggattttttttttttcacactagctgaacttagtaagtgccagggaaaattaaggtacacaaattgtttaactgaaaaaaaaaaaaaaaaaagcaatcaaaccattcccgtgatacttattttttagtgcttgagtactaattagcttagcttttctcgatcttagagaaacaaaacaaaactgtattttgcaaatagtctcaaaaaggtaacaataaatatatatatttttttctttttctttttcttttttttttaataccaccaggcagagtcttggaaagatttttggttatttgacttgtgtttctgttatgggtttttccagtgctttgatatttgaattttgctctagctaaactgatatgtatatacatatatcccaaacatgtcggagaggtagaagggaaataaattctcatcttaagaagcaattagctttgaggtctaagctcagttttgtggtgacagataaactcttactttatatttgctagcccaattagacacaagacttttgagaaaacatccttaaccaagacgaccgcttctaggattgacctctacatttagcagctcaatcgaaaaatagatgtcagatactactggtaggattatactgggtataatttttatacagagcaagcaggcaatatatattcaaaacttctaaaaacctcatagacctagaacatctacttctagaaattcatcctaaggcaataataagggaatgtgtacaaagatttttcatattaggatgcccaatgcgacattatttgcattattgaaaacttgaatgcaatgtgaatatccaacattaagtgacctggttcaataaattatagagatgtgtgtgtgtgtgtgtgtgtgtgtgtgtgtgtgtgtgtgtgtgtatatatatatacacacacatatttatatttaatattatcattaaaatcagttgtaaaatatatttaatagcataatgggagagtgttcaaaatacattagggtttaaaatgaagcttgaaaaaactataatcatgaaaagtttacctgtaaaaatatatcctcagaaagaagaagaggatgaggaggaaatgtaacaagctgttcgtagtggctgacgacgttataagtactttttacgttcctttatgtgaatgtgcctttctgtaattttcaaattttctcttataaacatgcatgacttttatattcagaagaagaagaattattcagttttgagaggaacagagagattcagtattaaagccatgcctgcttaacatactgggaatgtagcagatagaaatagcccctgacgcccaatattatatctcaaatatgcatcatatatttaaaatgaagccatttctgcctgtcataccaagtccaacagctgctccacttaggatgcaaagctcatgagcaacactgagggaagttagtacctggtatacttagaaatcccagaattatggagagaaggaagctatcagctactatcagcttgcctcagaggtagacccaaaaccactaacccccagacatgactaccatcttccctttgtttctcaatctgaaatttaatcaattgtaaagtcaattttctctttaaaaatcttaattagcccgggtggggttaaagaaacttcattcatttatacaatagtaaatattttcaagaatggtataaataaataggtaagaataattcttgagaagagggtctaccaactaactggggaaaaaaggaggggccaccagcaaaggcttagagaaagagtgtttggagacatggcttccactggagatgactgaaattgatttgaccaggaaaatgcagtcccagtttcaacccggtgacatacaagtaaatttctggaacacagcccatccctaaatgtgaaacaacctgtgtaaatgctgccatgttgcagccccgtgcttgggcagaaagctcatgtttggcttctcaaatatcacaagaggggataactcactttctttcccctggaaggtcaactatattcataggaatgaaagctttatatcagccaatttgatttcatgttctcaaatttcctgggccttttctgcagatcattcttcctacacatgggtgtttgttattttgaccattaagaatatttgtaagaagaggagtaatgaggtttaaaccaaagtcagccagccttatgagatttaaggtgagtactggagactcaagtctatctgacaggtggagtcactttgaggatcttgattcagcccaaaatgaaaggaaagtgcatggtaagaagaacatggccctcattcagctatgtcacttgccagcaatttgactttgggtgattcatgtaatgatactgagcctcggtttccttatctgtcaacaaagatggccggattcaattaaatcaaagatctctgccagatctaaaatgcagtgatgtgcctgtcttgacagagacagacaactcaggaagccttctttgcacagggtgaatccaaatgtctcatttcacaaagatactggaaatcagagatattgtacaagaaaggcaactggcgctcagtgttgctgaaagagcacagcttcatcattttccttgcaatacagatatttaaccactcaacgattctagaaaaagaatactagagaacttgtgaaatataatactttcaaccacaggtattggctctgagaagatcagcttcttagagaccagcatttcttacaaagctcaggtagctgtccagagaaacagtgggctttcatcttgtttatcattaattctggaaagtagcacgagtcatatgtaagaccgagtccctgcatgcacagcaagtgtgaaaaccacacaactgatgtggtagtcattacaagtgatttagaaatggtgtcacccagagagagaagatttagaaagaagggtggatattatattcagggttttgtaaataagaataaggtctacagcagctaaggaaatgagagcttaaaataacatcctttcttcctaatatgagaagaccctccttaaataaaaagctcattatatttggtaaaagactgtacatatttttaatttagaaggaatcagctgagatattcatgtagggtgtggagggaggaaaaaaggtcatatgcctaatattttaccataacagtattagcaaatgtattaaaccaagaccatatcacaggatagcgttaccttttcaactttttcctttgtacatacgactctattgagcaagaggtagaagatgtatgctttgatgccacctaagaccaaccagcttggaggttttcctttaaggttgagtgaattagtcacaggaaaattaacttctctaccagaaattaggagagggagcactgacaacataggagtaaggaaagtatgaccaggtaaatgataaacctcagtcaggacaatgccttgataaaccctcagctattctcacacaatgctgggttctcactagcagtattcactggcattacattcacattttcctgcaaccaggaagaagaagcaataagaaaactaacatagcaaatcttgattctgtgcttgtgagacaatctgcaaaaagaggttgatgagagatccattttaaacaagccaaaacctctattattctttgaagggtccagattgtactttgcaccaagcaggtgatcagagtaaattctttctctacctcttttcaaaacaaaaaaacaactttaacaattcctgaggtgggtatttttttttttttttttttgagacagagtcttgcttttttgcccaggctggaatacagtggtgcaatctcagctcactgcaacctctgtctcccagattcaagctattctcctgcctcagcctcctgagtagctgggattacaggcgagcaccacgacgcccggctaatttttttttttgtatttttagtagagacggggtttcaccatgttggtcaggctggtctcgaactccagacctgatgatccacccccccccggccttggccttccaaagtgctgggattacaggtgtgagccaccgcgcctagcccctgaggtggacctttctaccatccatgttagtagatccatttgcatgcaggccacctaaaaacaggccacacctaacattttgtacagccatacaaagccactaagtgggaactcccacctggggctctcctgtgggtatgttcagcttgtgtgctctctttgtcttctctatgacatcattcaatgttatttattatgtaaaaccacaggacaggagtgatctcctgcattgtgttatgctttgtaactgctgacgcaccatatttcagctttgttattttgttttagcccgaatcacacaaaactacagctaataattttctaggaaaaaagcaatttaaatattaattaatgtgaaataaacctattcattccacttagagtattatggttgttagggattttatacttgaaagtatggccaaatatatcaatgagaattaatgaacttctgctacacaccaaaatgtagataaatcccagaaatgtaatgtgaagcaaaggaagccagacacacataaaaggtgcatacgttataattccacttctataaagcacagaaacagatatttaacctaggcggctgcaaatcaggtgagaggttgccatgggtggtggtttggggcagggcagggagaaccacagtcaaccgggaggaaggctccagcaagctagttagggtttctttcttgctgtctgtgctggttacatgggtacattgttactgacaattcactgagctaaactcttatgatacatgtacttttcagtatcatatacttcgataacaagtttaaaatgcatagaaaagaaagagaaataaatgtttctataccataaatttttgaagtttgctgcctgtccaaaaaaaaaaaaaattccaaatgtccaacttacctccttaaaggggcccttaaaccacttagaca

SEQ ID NO: 1306 - DNA, 151933 bp, Homo sapiens
ttgcattaagtaagggaggtaaattcaatatgattttggaaataatgatctcatccaaagtagcttgtccttcattagaagacaaagcatgtttttttgaaaaagagctctattttaatttctctgatttaagagagggtgtgaaaaatctttttctgcatcaaaatgcaaaagaaccttaaaaatattatttaaaattatctttgttattctggctcttaattttttattaaaaaattcaaatgtgctcattgtataacatagaaaatcataaagagaaaatatataacctataaactcaccatccagagacaaccccattaacatctcagaatatattcttccaaacatttttcacacatcacacacaaaagtataagtaagcgtgtatgtatatgtcagtaggtgtttaatgcatgagtacatgcatgtgtatatatggatacaaatctataatgaaattatactagatacagctatactatttaaacattgtgtgaaatttttgaaaattatttggaaaccctaccaacaacagagttctagaagttactctgaatccaaaccaaataaaatcttataacattattttcttccattgtattaccaaactatttaaaatgtgaagaattttgcaaatgggttatttattcatttatttatttatatcgttgagtaagaggatcatacctataatctcctacaaaggctactggcctactgttcaggaatcctgagtaattctcctcaccttaatataaattttatctatatatctgtatatctatatctatatctatatctgtatctatctattcctcactcctctctgtctcttgagtattttaaacatctttcccctctggctacctccttgcagcccaggacatattcaagtctggttcatctataaaataaatctaaaaagctccactccactcttgctcttgctctctactgtaaggtcccatgtttgaaggaggctttcttttaactgtcaaggtgttttttaaagaacttgcctaaattatgggccaggcacaatggcttatgcctgtaatcccagcactttgggatgctgaggcaggtggatcacttgaggccaggagttcaagaccagcctgggcaacatagcgagaccctgtctctactaaaaatacaaaaattagcttggcatggtgacacatgcctgtaatcccagctacctggaggctgaggcatgagaatcacttgaacccaggtggaggttgcagtgagctgagatcgtgccattgcactccagcctgggcaacagagtgagaatctatctaaaaaaaaaaaaaaaaaaaaaaaaaaaaaaaaaaaaaaaaagctaggctaattttttatcacctacctatttcccactctttccctcaatataactactagaattcagtggataatttttagatgtttgtaattacatcctctgtagttttgacatgctgatcacatgtttcctaaagaaactctcttcaatctttatttccatgttgttattctttcctggtcttcttactcctctgattgtatttttgtgtgtgtgtgtttgtttccattttgtcctcttttcccccttaacatttgggtttatcagaattctacacttttttcttatctttgcattccacaaactgcttggattaatttatctatccccatgtctttcagggcttatttgacaaggactcatatattatgtgtataccttcaagacagaccactcttctgtgttataaaatagaaaactgtaagaataatactaatgatttttaaagtgcctaacaggacactttaaaaagtgtggtggctcatgcccgtaatcccagcactttggaggccagcaaccattttttatgtccatagtttctgtaggtcaagaatccaggtaaggcaaagtgaagatgacttgtctctgctccactatgttgagggcctcagttggaactctcacaactggagctgactcacgtggctggggactggaattacccggaggcttcttcactcacatgtctcatggggtagctgtgatgactcaaagtctgggctccactggggctgttgacaggaatcagcatgtgacatcttgtattagtctgttttcatgctgctaataaagacctacctgagactgggtggtttataaagcagagaggtttaatggactcatggtttcacatggctggggaggcctcacaatcatggtggaagacaaagaaagaacaaagggatgtcttatatggcggcaggcaagggggcttgtgcaggggaagtcccagttataaaaccatcagatcttatgagacttattcactaccacaagaaaagtatggcaaaaccactcccatgattcaattaactccacctggccctgcccttaacacatggggattatcacaattcagagtgagatttggtggggacacagtcaaacctctgcatgcgacttgggcttttcactgaataccttctgggttctgaatgtgcctcatgacagaacatttggagagtaggcagacagagcaatgccagagtgtttttctttgcaccatgatgtctggggcatcagatcagagactcaaacagctggagatgacttgaatagctagggattagaatgctttggaagcttcttaactcgcatggctgacacctgggcaaaaatgactcacaggtcaggctcagttgagggtgcccactggagtactcacaggtggtctccatgtggctttgccttcttcacagtgcagtggctgttttctgagagggagcagtcctagctggagggactggaggggtgttacacaggaactgagtggaatgagcatggccttttatgaaccagcctcagtagtcaggaagcatcaccttctctgtgttctatagtttacatatgagtcacttaggccagccgagatttgaagggaattagactacaactcttggtgggagaatagtaagggccatttcagaaaaatatggggaatgagagagattgtttcttccatttttgcaaaaatagataccccaatacccctaactgagcctagcttttgagtcattcttgcccaggtgtcaggcatgtgagtaaagaagcctccagagcattctaatccctggctattcaagtcatctccagctgtttgagtcacaattatgccatgtgctgaacagttttcatgaattacctcttggaatccttatatcaattctatgaaatagttaagagttttatccttattttaaattttaatattcactaattttaacaatgagaaaatgtaaggagtatttccatctagataacatacttggactaaaccaagtctagagtaattgatttttattgttgttctacatcttatccttacattttaccatttagtgagtgatatgaccccatatactaggctgctaaatctgaattcgtagttcatcattgttccaactctctcttccgttattatcatccaatttcattaaataactatattctatgcatctccctctccattttcactgctattactttatttgaggctttttttcatttcttgagtagatttttatacatcctcagataatcttgtctctggtcttgacccattccaatctacttctacatgggcaccacagtgatcattctttaaaaaacctaaatcaaattgccatactctcttatgtgaatctctttagttcctgtcactgccttcagagtaaatcccacatttctttgcatgggcaagaatgactcaaaagctaggctcagttgggggtatcggggtatctacttttgcaaagaaatgtgcatggcatgcaatgttgtcatttcttcctctaggtcagggactgagtgaagataactgggtgtaaatagagtgtacgtagtgttagaggcgatggagcctgtctctatgtaaaaatcacttctttgcatagagagggcagctctgtgaccttgtggatatcagggcccagctttgcaagactttctattttattgagaagctgaatatctttatttttgtgtgtttttgtgtatttttaaacatggtagcaattaaaaacaacaacaacacctgtaggcaaataaaagaatgtctgtggctcacagtcagacatcaccctcctacctaggtcccctttccacttcctataactccttttgatcatggcgtcaccagctctatggtgcttatttttataggattctgccttcttctctcaactgtatgttctttagaggttgggatcttattgtatttgtgtttgtatcactgtgtctgtcatagaatgagatactcaataaatatttgttggatgtataaataatatttatgaaagcattttggaaatgaatatatttctaggtatactcagcaattacaagtccaacttcatttaataatcatctctccaaaacaaaaagcagggagaggctaacattaagctatggaaatccataaaagtgaaaggtaccaaaacaaatgaaaagggagataggtagacaaggggtgagagcgaattccaagtcttcctcacgttattcctgtgcctttgctggacttgagctaaagcctgtttaaaagtctacaatgtctaaaatttctaagactgtccacactgggctgtgattgactgtgtccccatgacactcctattcctgggctgtccattgagctgtttccccaaagtggcatcagtaaagacctacagtgcctcggctctacaaatctctgtagctccctctctctgatgtcaactcactgctatagcatcatggctaatatggacttgctacaaactcttcatgggtttatggctttctttagtgaaactgcctcaacaagaatagagattaaacataattgagtgactactcaggaaaattatacattaaaaaatagtgtctgcatggttagagaaaaaaaatactgagtatgtaacacactaataattcttcagttcaattcagcactcatatacactctactgattgatatgaggattctagagtaagtcaaaattgttagagttagtgaagatgagaacatgcaatcacaaaacaaataaggagaagtttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgtgcccggccaaggagaagttttaaagaacacagtaggcactaaataaatgtggaatgaatgaatcattgatgtttgcctttaagcctgatagagattgcaagtattttatacttaagtgctgtgggaattcagattttaatatgagattgcaatatagtgagcttagtctggtaaggcttcttatagctgtagatctgaaaaaatatcatatttaaaattgcatggttgaacttataggacattctgaaagagttaaaatatggctaataatttccatgggggaaatttaatttaaatgagcacttggaaagagtggttcatttcacttatattactgggattcgaccacattttatagataggcctctttgcctcaattaggtatcaatggttcagtaataatttaatattaatatgaaggttttggagttctccaacaggttacattgaatataattgagataattctatgaaagcccaataatattgtcactctcccatgcatctgttttctttgatggaggaaatgaatgaagttacaactagaattgaaggaggacatacaagggagtgcatctgaaatgtgactgccagcatttgggttttaaatagaagagacagaaaatcattgcattagggctagaaatcttttcaatggactcatatctagatgatattgtattttttctgcttttgttcattattgtatttccagcatttaatgtagtcatgtgtaatacatatttgcttttatttttgatggcatttagttagccaaccaattgttaaacaaagtcacgtctcatatatctgcataactttcaagattcatgaattcaagatatttaaaacaaagcctggaatagaaaatacattaaaaagtttaaaaatttgcttttccctctccacccctctcctctcttcccctttctttcccttctcttccctcaaagaaagcacttgttaatatcaggtaacaattaaaaaacaagtattgacagttatcagataaagaaaaataactctaaaaacagtcataagaactatgtatctatggtatttggaggcagttactatagcaagaaatactaacagcaaggtgtagggcttgaaagggtgagccatagtcttttggaaaattcagtttattggaacaccttacgtttcttgatagtattagataaagcctaattggacttatttagtaactactagatgacgagcatcttgcttgttatgtttatgtttaagataggatgggatttgcagtctaggagaagaggcaaaagaaacacataggaaattattatagaataacataaaactatatataattaaataccaggagagggaacaaattgagtgattcttcttgtgtggagaatctgaaggtctctttctaaggaggtggaattagagaatgaatataatttgggttaaaaaagggagcggggaggcaggatggcttccagggaggtaggggaggccacagaaagactggtggtaaggtgaactgcggcagcctgtaggagggtcttgaggaatcatgcaaagtagggcaagatagatattatagtgtaaaatcaggaaggcctaatggcctattttcctaatgtttttccatctttactccagtatcacttactttgaagagagactatagttgttgcttgttctagaggcctttttaatctttaatgattgaacccattacttttaaagagcaacggagaggattcctttttcagtcagtttggtggtacaacatccaactttaggctctcctttctatattgatatctaatttgcaatgattgagtatcttgattaatagtatcctagtcatgctacttgcttctctttcattcatataccacgtcatcttaagatcttttaccatggaattgatgtggtcagaacctctaaccactgcggagattctgttgactgccactgacttctctactggccttatattatagtggccatcatgatgctgttgtgattaaaagcccaagccctatgcaaaattgcccgggtttgaaactgggctttgccatatattagctggatgaccccggacaaattatctaaactctctgactcccgattacctaattttaaattgaggatagcaataatatctacctcaaacagttgtcggaataaattaatgcagataaagcacttagaataattcctggcacatggtatcatataagggttaattattactcttgtctctaatagggataaaaaaatgtgcacttaatatttaggaaaattataccccccatgcaaactctatattaacattttttagattattttacatttaagttgcattttaagtagttcttcaagtaagaatttagctttaaaaggacttcaaataccttttaacacaatctctcctctagtgccatagcaaaaggcctggtgtggagtagactatagtatctactcaacaaatatttgctatgtgaataaataaagttgcaaaatactaaacattcaaaagacatgtaggtagttattatgataaatagagttatgcttcattctttaagaatacagagaggtgagtttaaacccaatgtggagaacagtaaatctacaaaggcttcctagaagcaatgatacttaactgaatcttaatggacacacaggagttggcctcataaaaaacaagaagcttaaagggtctagatagcccatttacaatattgtctctgatcaacctattcaaaatagggcaattagttaatgagaaccattttattggtatttataccaaacacatatatgaaatttcactttatcacctattattctaagtggaatcaaattattccaagtagatagatattcttagtgattctggttgaaaatgtgtatgttgaagccttttgaaaaatctggctgaaagaaaaataatagctatcttttattgagtgattccgtgctggccttgtaatgagctcttttcaggaattgagtaatctaaacctcacaagaagaaagttctcctactgcccaaactgataaacttggtaagtagcagagctagagcttgaactcaaggttgccaagtgcatgttcttaattattacattatgtgaagttttgtattaactcctcactaaaaatactgtcttgtcttgctttccttttatataatttgaagatatattcaaagaaataacttcattaatgatatcaatttagattttatttctggagacttttgtaaactgttacataaaatgtaatttataaatttcccttcgacactacacggataaactcatcacaagatttcttgctagtcagcactgttctccactaaaagtgctttcacatccacatctttgctttttcccctagtgaatatagaaaactacttcaataatgcatattcctttctatattccttcaacagaatgttgcctatttaaatcattaagatggattcctagtacagaatcaaaatttaaaaaataaaaacttcaattgtaaatacctggaatcatagtcgatgtctaaatatattaagtacatccaaaaacatatttacaaatctagtattcatcacataatgcctctcaagaaagcagagatctcaagcagtttcattttcacacttccttcataaaagtattcgaatgcatgaaggccatctggctatgttactacctcccctttaacattaactaatgtggcaatcaggctagtgtcccactgttccctgaccactagccaatatcaaccctctgaacattacccacttcatgcttttttcaagtccttatctttacatacatttctactgttgacaacaagccataatgttgactaccattaggtttctactaatgttttccagtcatattcttccaagtcagagaatgtaactggctccaccaggaaataaaatagaggtcattgaagcagcagtgacttccaagctgtttgctaaatttagcagcacaatactttccactctaatgaaaactgtgaactgcaattttagaatgttggaacaggatgggactttaaaggtcattgagtccaatcccctcatttttctgatggaagtgtggaggcctagacgtagccagtaattttctggaggccacagagcttgttaattatgaagatggaactcgaactaagatctgctcagccctgcagtaatgctgccctcactacaccacagatgctctgcctcctaggatgagtttaaactaaccagatcttatagcataaacatagctgatattattggttgtggcttaccctccatggccattcaactgtttcgtggctgaatgtgaaatagcaaaggtatctgacttataagttgctgagagaaatgattccatacctaaaccctgcccccaactctaaaaacttcctgcttgatgttcatcaataatgaatggcccatccctgcaatactcagagggagcttacattgcacttttgagcagccggttagtaatgtacagtggatagagcctttctttcaaatcccagggcagtgggtccttcaaggctagcattgcattttcaattagctgctgagtgaatgcttggcatgtgtattagtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcaggtatgtgaaattgcatggagaaccattcctgtacataaggtaatatgaacatgcattctggttattaattgaaaggttctttaccttttgattttgctaactctgactttcaagataatgtaaacaagaaataagttggtttttacacatacttgtatttaaattgcattgggagaactattgtctaaaatgtaacacttcatttgatacaaaattagcacctctgaggggaaaatggctctgtaagcaattcagatatggattcataaatctgttcatttttgctcattaaaataacagtttcaacatttagagcaacttttaaaaattatcaaaatgagcaacattttatttcattttttataaaataaaatgattgatttagcaataaaatcattaaatcctgcaatagtttgagactataggcctaatactttattttcatatgttttattattgtggacacaaaacaatgattataagtttatataatatattacagctaggatttgtagctttttgtacagttttaaaatcgttttgttcagacattacaaacagtgttttaacatttcctagattctttgtccatgtctaatattggtttacatctgtatcacctttcatattcagatttacttagattcttgatgcaatggcatctcttagaactgcaactgtgaggaggcaaaagcaaagaaatttatgaggacatcaacctaatccattcatttcttaaaacttaaattattcttgaatccttttccaagtatttgatataaagtcttaaaaataattatttaatccgtgactcatagtgtttcaggatgttttgaaatctgaggtagatgcacctagactcaggccagataaatgtatccttgaacatgtgtctatccatgctgaatgggatgttgcttctatcttggacaggatgtcattgataaattttattatctatcctactgacacttactttgggtatttacccataaatgaatataataaacaaataaaggatattatattcaagggattctgacaatactatgctcctgtaactcttaaaatgaaaaaaaaaaactttagagtttgtaataagttgcatattctcataagatccatatttattcttcatttgtttatttgttctaaatattatactagaaaataaaaaagttaacaaaattaattgaaattcaaagcttatgctgttgatttaactctggtacctgctagaaataggtttccaagctcttccttatcctgtttaaaaataagggtaatgaatcttgaaagcaccaccaatgttatgaggctccaagcaagccactaacattatcaggtcaaccctgtaccttcattgtaaattaattttctgttgtatcattcagttgtatataattatttcttttccgtggaaatgtagctttttggtcaaagagggtgatacttctatcagacagttcaattctgtggctttctattatttcaaaataaaattagtgagcaccttccatgtgtcctccagaaatttgcttttgcatgtggggaaaagatgagggtgagacagctttgcaagctgcagagtaacctggagcagtgtctaatactcactgatattagctgggcttttgtcgttcacagatcaggaaaagaagacctacaccagcatcacttgtgattctcaatgagcataaccccccaggtaaagaagcatgatgtgtttcacactgatggaacagaatggaattgtttaaagaacatcaaagtacatgtcgtactgaaaagtttcaatttaggatttcacagttagcaatactctagaaagctaatctataaaatggatcgtaaacagaatcagaaataaatattacaggaataatctcaagccacagcctgtatttcctctagaatatcataagtgatgatatgctatgaaatattttgctagcactggctgtcatatgttcaggtgtttgtatggaacctggattactgcttattaatgaggctggtggaaagctgtttaattaggtttaaaagctcaaattacagccctagagatgcttatatctttacagagtaagttttttatatggaaaaggttgacatggggtgggcaatgacccagcgttggcttcagctttgctgatgacgtcatctctgaataatgcaattgacaagtaaccagatcaattttcagcactgcctatttgagagccattctgaatggctgaatccatttgttgaggttttattttccatttcctgtaaaaatgaaaaccgcattattattccggataaaagactatgatctgtaatccacaaacattatttacttattgaagcggggtgatttttagtctcacatttaagtgctgcttctggatatacaagtaggataggaaaggtcatgacattaatttgcaaccaggcagaacttggtgttggatttttttgcaggtataaacaataatgggtggacaaaaggagtttaaacagtggaaacataatatgtctaataatagactgtagcgagtgatctaagaataccagggtgaaatagtccttgactttttcagactcttttctaattagagaaacatataaaaagaacgtaaactaataggctattcatcatttagcccaaatccaagaaaattttcaggtgatggaaaataagtaagctaatttatttctgttgaaaatgaataattataatttgatcctataactttagggtgccattgcatttaaaattattttcaaatatattatctcaataaatcttaacttacttatatttggttaaataagaggtgcaaatgatatgtaattataattctaaaataaatacaagtataaagataagtcttctcgatttgggggtaattttatagcaattttccatcactgccttgctcatggtagcaaacatttctgtaatgtcctaaaactttcctccctatgcctgccttaaggtgtactgcacaacttgatttccaggtgttctatctcctggagagcagttttcagaggtctataggcatcattgctgtttgaacatagtgaagtcatgtaagtgaccttcatcctctcatttgaactcccaaaatagcagctacattctcttgagtgccaaatatgtgccatttggatgaggaaagtgtgtatcagagaggtgaagtgatttttgtggctattccactagaagtgacggattccagagacaaatgcaggtaattctgatactgaagcccatacatttccactggcactggctttgaaaatatcagtttgcactacatggtgaaggctttataatgtgactagtcattcaggccctataaacaagcaaatccaaacaaagtaaatccattttctggaccacttatcttagtagattaaggaattgtacttaaatatccctgggaataagattcagtttttctctagaaacctttttttttgtcagatctcccaattactagatggcattgtcccttttctctaattgacctcatacttctctttgttttttaagcaccactggagacaaattagatgcaaatagcatctcacagagaactactttattttagtacatcacctgcctgcatcttcctccccctttatggaaactagaatagtctacaaagaattaatcagcttttggctgtgtataggacttggataagtgtgcatggcaactagagattttggactagtgatggatttttgtagtaaaacccttaaaagcttatagttttcccagtaaaaatgatctagcaccaagcttactggggaaataactctaaagataaaacaacaacaacaacaaagaaacaaacagcaaaaaaagaacactaaaccaaatcaaacttggatactggtcttaactagccatgtgatgtgatcttgggaaagggatatctccaagctttcttttctttcttttttttttgagacagtcaccctctgtcgcccaggcttgagtgcagtggcgcgatctcagctcactgcaagctccacctccggggttcacgccattctcctgcctcagcctcccgagcagctgggactacaggctcctgccaccacgcccggctaatttttttgtattttttttttagtagagacggggtttcaccgtgttagccggatggtctcgatctcctgacctcgctatccgcccgcctcggcctccctaagggctgggattacaggcctgagccacagcgcccggcctccaagctttattttctcatctataaaatagggatcatagtgttctttctttcaacctcacagggttgtagtaatgatcaaaagagttaccatgaacatgacttaaaaattgcaaagtgcaacaaagattaggtatcattaactgatgtgttcgggaatacaatatttgcatgtgatatttaagaacaaagatataacaagaaaaacagaatcttcataatctcatctgttctaaatatttctgcgcgatccaacagtttcttttccacacattatttgaacactctctatcaaacaacaaaacaaataagagtaacaacgaaaacactcataagtgttaaatgaccatttttaagcaactgtttctcctgtcccccaaaagcaatatgttgtttgaaaaacaaaagctgggtgcagctttaaatcctggtaaaactaaacaaatctcttcaattcactgaaattggccagggaataattggctgttcttggactcacctgtcattaatgctgtttaaaattcaaaaccctgcaaatctttctttattgtcaattaataaagcaaagaaaattaaattcttcattatagaaacataagtaataaaacattccaattcatatgacaagatcagtgtactgcaatcactgttaaatggattagacatagcttgcttttttttttaaccttttgaagtgtttgcaggaagagtaaattataggagtatttgaaagaatgattatatatattctgtttatattttgtagaggaaaaatagaaagatatttcaagatgtatattcagattttttgtttgctagttcatctatgctggtctaaacacatagatgagataggcacctgattagttgtattctaggggcagcataatgtcccatcagtccctttctgacaaataacctagaactctcagcagtagaagcactatgtaaacagatacttaatctgttaaggatatatcaccctctggcatgggttagtaaatcagtttaactcaaaatagtgggagatgaaactaaaatttttaaattgaaggcatgagtcagggaaagtttagtaacagaggtgtgtctttagggtagaaaaagcagaaacaatgtatttgctcctaggaataactctcaacagtcaggtggcagcaaaaagatactgaaaaactgagataggggaagtagggaatcgccaaagttccctatatttcgtctttttcaaatgttttctggggctaccaacatgagtgacctttgtagcaaactgcctctctgtattttcagttcctcttctgattaagggcctctttatgataagctctctgaagctacacaggagagcattattatctattcttatactgtgtgctgtttgcttttacttttgtataatctgtagtgaactggtttggttcctatatatttttttttatctagagagctgcttatgtgtaaatcctctctgtagggaaataaatggcaaagatactttctgtaatttattccatcacatctatagatattttaagtctacttaaaaacaagtaatgtcttaagtagacttatgaaaagactgtatatttggctaccagcgtttgaaatctagagttggaaaataatttcagaaaatacctactttaaccacacatcttcatgacagacatacataaaccaacccaagtccctgagactcgctccattttatatacctcagagaagaatccataattaaccgggcttttcaactccagctctgataatttcagatgttagaaaatgatttcttataccaaacttaaatataaattccccactttattctaaaataacttcatttgttctctgcaataaaaagtcattttctcaccttttaaaaaatatgaatgaatgattattttcttttattctcaatctccctaagggctttaataaactctatccgaattctccctattgctctgcctttgaagcccagagctggacacagtcttccagtaaaaagccagcctagaccaggtcttctgaatattaaagtttgtggcatccattgttttccatttaccgttaagcagagacaatatggttacagttatatttaatggacctgacgcctactaaacatgagtgagctgtatgaggcctggagataagtgcagatttgggtaagtacccaggagttttgacgtcatttaaaagctcactgtacatctaaaaagtggaatccgaagcataaggtaaaatagttttttgagtatatttattgaacttcctatcacagccaaattttggggaaatcgactttatctttgacccttttagtgtcaaatatcctttgaaatcaagaataaaaacaaaggttgttctcacatgcctcaggttcccaaaagttagttaataggagacataagagatatatgatactaaatataatactatctcctttcaaatttgatagcaggcctggtcattagagagaactgagatgtgcaattgctttggctattcatttccagaaacgaaaaagaagccacagtttatactgtatgtagcatattactttctaaatgaggcatacgtttcaggattctgaaactaagttaaaaaaacagattttgaagcctctagattggattcctgagacactggatgatagctaggaaataatgctggactaagattgaattgttcaaaacgcaagggggctccagaaatttctggtgattattttttaatccaaaaataacaggaagtttttcagggtcaacaaaatgaaagtagaaatttatttccagtattaaggcatcacatgcacaaaatctctcttcatggagaccctctattttgcaaaatgaatgattgtgttgtcaagagaaaattgggctccagggaccatactgagaagtttctggggactcttaaagatgagtaagacattatcaggcccagatcttgaggtaccagccacccccagggacctccaattaaatgtattcaaataaacgctatactggcccattgtccacatacttatgttgcattttaaatggtctcatttgaatgtggttgtaattcatttgaatccacaatcttgccttgtctgtattaatgacaatacaaaaaaatggtccagtgtttgaagatcattgaagtgttagctagtattaatttttaagaaattgtaaaaaagcctatttatttccctcagcatttatttttatgagttattgaatgctgaatgattttttaaaaagttacacatgtggctttcagtgattcatgtactgtacaattaattgacttattttcccttaactcttcagtatgtgcagctaaatagcccaatcagttggaataattgtgagccaaagatgaggttccagttcttgatagtgacaaggcttgctacattgtaagttttcaaagtaacttgtccaatcttcaaaataaatgaaaaaaaaatgaaagggacctgcatttcttattcaaagatggcccagcttttttctaatccagatgatgttagtcattggcaaatagttttcccaaaaaacagtagtagtgggtaagaaaaaaaaaagatctatagtaccccctaattcatcaggagaggaagatacaattgtgtaagtattatgtatcctatattgtagtgttggtttaactgagcatgccctgtttgccaatataatttttgtggaatatgagttcttaagatttttttaaaataagcatgctactgatgcttaggtttttcataaggttatgaaaaacattattgcaaataattgacatatttgtggccaatttgtgtttgaccaaaatgaaattcatattccaacagtatgtagaaagaaaaaaaatgtaaggattgagtataaaaatcttttagagatatctatcaaatactcttgttgctcaattttcattccactccatttttattcacttcttttcatacatcatctctgttctatattctggctaacctttctttatttattgaagtagttctctcatgctgacttttaagacttagtctagactgtctcatttgcataaatcagtctctgtctttttcacgaatttctcttatttaaataaacttcagcacaagactcacttaaattgcaaaagatttccctgaataatctgacccattgtctggtcatgttagtctaatattcttctcttagtttctactcttaaagctgtttattggtttatacattcaattcaatttattgagtccttattctaaatcctctgggaacatgtggtctaggtaacagagaatattatgtctggatgtaccatgatacaattgtaataacagaaatccgtgttgctgaaaccacagtaaagctaattctggccaaggcatagaggcacttatttattatgcttcctagtctataaagcatttgcatgacttattttgatctttgggctttaagctattaaggattgaggtcagagctaaaattttactgtttattccaacttactagtagagtagatgttaaatgcctgtgaacgattcaaagtcaatccttcaacctttttttggcaccagctctggttaaagcacaatgttactcttctaggggataaaacaggtaaattaattatcaatgctatccacatggagaaacttatctgagacatatttacaatctgacatatgcatttttgtagtaaaaacaatagtatatgccaaaaatacaaaatatatttcattcagtaaagaagtgtctgtcacaggatttttaaagattagattaaaatgttgtacagtacacagactagatgcctgataaatgacaatgattactttggggaggcagacatgtaatacttaagagtagaggctttggaatcactcaggtctggatataaatcttagatggctgtttactgcctgagtttcctcagaaaaatagcgcatcctcctaagacccaagaagccacatgaggtagttgggctcatgtgtcatcaaaatacatgtgttttcccacaccactaaatatagaatacattaatttcaaagaactctagtctgagtccattgaataaataggtgtctgcatagtaatagacacagatgacatcattgtcagttgttctgggtagcttaacagttgttcagtttcaaatttgatagaaaaaattactaacagttctttctaattgcttctagttgatagtcatattccacaagaccataaattaggggacctctaacaataaatctagctaagctgtgtgcttgatggaaaaagattacttctaaatttcttccttttttttttttttggaattattcaggagcaagccctggagccttgggatttttctgtcttttctctcatcattttctaggcatcacttccactaagtagtgatctgacacagtttccacaattccagacacaattccagacagaatttaccaggggcttaagcagaaatgccccgggacctgggcaggtgacatagatgagagcctgggccctaagaaggacagtaggctgtggtggggactgtagtctacttggagaacacaagctccatccaaggctttcaaattaaacagataaaactgcaaaggacattgagaaagcactataacaggttggaacacctaagtggtaagattttagagatactggaaagtatctccctaaattagtttccatactacctgaaatcttaccttttgcagttgttgctataacttctaaaacacaagtactctgaagatataacacgttgtccttgacaccttagaaaaattgcctacctggagctcaggaaggacctgtgaaagccagaggtggagggaaaggcatgtcctaaacaaatgtcccagctgtgacaatcagggggctcagaattcaccttctccctcccagtctgtgtgcggtctctgccctctccatactcatttcagatcttccctaatacttcaggggttcccagcacatgttggaaaatgttacacctatatctgtgagtcttctctgggcttgggtagaatattatctttgtgactctacttcatttagaataatttgatatagtaaaaattagtgtttaacaaagccatttgtgaaataagttgccaaaatccacatcatgaaagacatatattgacaatctgattagaacacaattacaatttgaccttggtaataatgctgaggaaaaaaaggactgtgcaaactaaaaagctagagaatttataatctttcatgtttttttcattctctgggagcaattttccatcattacggaaaacaattttcagaattacactctttacatataaatacatattgacttgcttgtgaaaatagaactggatgcacaacatagaagaatgagaagttattttggaatccaatttttagaatactttgcctcaatgatgcaatatcattttatgctttttcccctgtctgatgataaataacagagtattagaagacatatacacagccgggcgcggtggctcacgcctgtaattccagcactttgggaggccgaggcgggcggatcacgaggtcaggagatcgagaccatcctggctaacatggtgaaaccctgtctttactagaaatacaaaacattagctgggcgcggtggcgggcgcctgttgtcccagctactccggaggctgaggcaggagaaaggcgtgaacccgggaggcggagcttgcagtgaattgacattgcgccactgcactccagcctgggcgacagagcaagactccgtctcaaaaaaaaaaaaaaaaagaaaagaagacatatacacaaatatttacatgcatgaacacacgtacacatgatgcacacagaggtagatatccaactgtatgtaaaaaaaagaccccacgtggactacttaaccaagtaataaatccatatccactaagtaacctgacttacaaaagaggcctgaacctgccaaagtgtcttgaaaagctttgaaaattcaggttttaaatggaataagctaataataatttttttgtttctaacatcttgaattaaaaaccaacagattaaaagcaaattgtattattttaaaatccaaccttgaataaaaaacattgaaattattggcatggattcaagtaatgagattgattaaattattttttaaaaagtaaagagtattttaaagaataaattgcatgtattgaatattaacaatactttaagattatattctcatttgagtaggtttcatatgcccattttcatgatttacggacagaagtattataattagatgtagaaattgagctcctccagctaccacctgaaagtcaatgtctaactaaaatgcatcatccatatttgaagacaacttttcaactattgacttcagcattacagttaattttatccccattcttctaatcactaaaccacacaacgttaggatcatctctggctcctctatctctccttcatgtcttaaatatagcaatgttttttctgttaactccattctataggttgaacctgtcctatgtgtttttattgtttctgctgtgtctgtgacacatattgctttattctgaactcacactgtaactttcaaactagttttctttgactttgacactgggaggccattttgtgtaggactaagagcctaaccttagaatcagtgaacatgggtttcattcgtggcatgagtaaatgtctgagtcttagtttcctcctccaggaagcagggatcctggtaacactggcattggttgtgttgctggaatcaagtgagatcatgcatgctggcaacactattgatgctaggctcggtctttgcccattctggtttgtgtgagaggcttttggcagacataattatatgatatgtgatcgactatggcagctttactttcataattgatttgtcataagctctaatttgtatcctgtgatttatctgccctagcttgtaattagttaagataaggcacctggagtcttctcatgaatagctcatcgatttcatcataatatacacatcattctcattccttcttttgaataagtcagccattatagaatcttattacacaaattgttgacaactgcactaaagctgaggcttgattaaaaggaaacgaacagaagaaagggagatgattgttagattatggttaatgttaccacttaacttcctcctttatttttgtggagggctcataaagcagaacacaggaaccttgtttatttgccatagagaacttcctatttaaaataatttttcaaaatgcgtaaagatttccgatcaactaggaacaggcttaagctggatttgcttcccaaaacacttttaagaatatccactctttcttcgtgaattttaagcacttctcacctgcttctaatggttaaaaggttttcaagaaagaatgccagagacccactcaccatcacatttcagtgaagcaaaacagcatgaatgattggactaaaacggatcatctcaatttctaccacaggtcattttacttggtgaatagcccagagttcctgcttcacttagccaataaaggacaattttttacttaagggtctggagatgtctgcaaatattttcacacattctagatctacagtacgcagccatcattggaatcaagacaaacaccagctgtacttttcatttagacagttacagaataagcaacatattcaaaatatattttgaaacatgtttaggacacaaaagagaaaaaatgcctctaagcaacaagtaaaataatttaaaaagaaaaacataccaactcaaaagcaaatttaaagggggttacagaaatgtatcttacttttggtagatttacagtttgcaaatccatttgttctataatacatgtccttacaaactctatcaaatgaatattttaaactccattttacagagagagggtgatgggtgagctgttcaaggtcaaaagagctatttcagtaagtaggtctgtaatgtacatatagattgtgtaaccaaggtcaatgtacttcctactacattaataacatctttatttctgtaaataagcaacacagcactctttctattttatttgtctttttcatggaataaaatataagcaagctcctctttgtagcttggccatgtgagattctgtttgatataatatatcccaatatgtatttcatctttattccaaaatgagttggttttgaagtggtaattctatacttttttctttctcttcttttgtatttattagttaagaagactgctttagcattgcttatactagatattttattctataagctaaaaacaaaaaaaaaaagataaccaaatagaaaaaagtaaatatcatccattattccctcttagagatgaaccccgttttttattcatctctgtttgcttacctatatatatccatttattttaagaaatcattatcttgacttaaatcatcattagttgtgaggctgagggacatctggattctagttaactcaaaacatgaccgatttgtgcacatacagtcatcttcccttcccttccattttagttcttcttgtcctgtgagactcagatcaaacctcccttccttcatgaaacctttttggaccactccagctagaaggttttgcacgagtaagcataatatgtcatgacaccaaaccaggcttgttctaccagctagcagtaagtcagtcattgtgatggtggcctttgcaaaacagaaaagattttattcacaaggctgctgggagagtaaatgagagaacaaatctcaaacccacctccctgaaatcagggcttggtagtacttatgggatagaaacggggttggtctaaagtgtggggaaaggtgattgttgggtaggaaaggtgagataatcaggattctgtccaagtgtaatcaatctacatggctcttcataggatgcatgttccaaaaatagtggcattagcatgatctgagggtggagattttgggcctcctgacatcaaaaggtcacattttgggcaaccaggcaggccaagctggaggatcagtaatctcaactaattggaattggacaagagtttgcccccttgctcctgaaaaacaacttttagcaacagttaccatagagacatacacattagagatattatctataaggaagctaatgaaagtttagttatgtattatttggttatgtgacttttagctatctaggttttaagaccaactagaagtaagccattaaaggtgaacaaggcaggttaagcttggtgggcttaatcaggttagtcctcggtttcagtgattggatctattaatacatttgctccaatcgattgctcaatgcctttctgtcacctgataatgccctgaaggaatagatcttggaattaataaaatttaatgtggatggaaagaagaaagatccatgtatatgaggccttataattcctctctggataggatggctgcaaataaagctctgaggatggagcaaccctcactgtggaaggaaaatagaggtcattaaaactaacctgagtgttccatgaggtttattcttgtcctcccagttcacagatacctacacttgctgatgcataacccattggattattatgagctcctacataaaatatttatgggcataatttaaagtggcctttgaagcacaaaacacaggctgaccaaagttttggaatcatctcaacaagaatgaattttagtagtagaagacttgagctggttgtttcactgttttagtgtagacatgctttgagataggcatcacaggtaattagtgactgcagatgcatagacaattttgcataataatgattttgggacttctggagttttagaggacaattgaaagactgagcgtgttttgtttaatgaccaattttattcttttgctgtctttaaattattcacatctgattttaaagtgtcaataaaatggtaatgctggaaaactgaatacacaatcaatttggctgctttcttctaagaatataggagctcaagagtccaattcaatgccatcagatagtaaccatctctgtcctactggatggtcatatactttccttccatgtgaacttggtatgtgcccagataaataggggctaggttttattttcatttcctttgagttgtaaaataaacattttacaacttaaattatttcctttgttagcaataaactatcagggaatagttagcaaccctccagtcagtactgaaaatcaaacagttcattacatattaaatgcatttaaaatcatacaacttcactccaaaatccatttgatgtgttttctggtaagatttctatgtaagcagaacttaatgattgtacgagaaatcactttagagtggactttgtactatatccttcctttccctcaccttatacacaaggaatctatagaaacaacttatttttaccctactgaattatttgcagtcatatacgtatagcttcacattacaacattccagctgctatattattttctgactgagtcagataagattatgttccatgtatttctgttatctgggtgcttattaacatgcgtatcattgtggacatattgctgttatattgtataacaatgagcttatagcaggcaccagcaccctttccttatttccagcttagaatgttgatattcttcttagcattttttcctgacatactacaacccactttccatcaaggtatttttttttcttttcagtattaaaatttttctgtgtagtagctagagtttgcaattgtctcattgtttttagaactataggtctacctttcactccagtaaaaaatctgaaaaactttagtatgaaattccttatgagaaaataactttttaagatatgatataaacttgaaactgacataaaataaattgagaaggaataaaaaacgattacctgctccaaattttatactctaagaaatatatgtaaactgaaacaaaataataccaaacaataacaacaaaaacaaacctttgtttccacagaagttattggatttatatttttattaataaaaattattatgtaataatgagcaagattccttgggcttaaagtaatatttgaatcccagctctttattcataatcttggttaaatgtctgataaagaaaagaatggctaagactaatgcaccaaaatgatatttcaaagaactgaaaaacaaaatattagaggattttcatgacattgtttattaatatgcttcatgatctagactgatttacatgctttaaaatctcaaaatttaaatattctaataccctcatgaaatcccatcaaacatttgagagcagaaagatatatttgaaatttgtgtttataagatcaccccctagtatctgtacatagtcattctcaccttcgtcttccataactggtagaatcataccaccaagagtgatgccataaacctccccccccccacaaccctgaaatcccccagaactgtcatcaactattatattgggagaaaattgacctgtattctttcccatagtcaagcaaaccacagggagtttccttcagcagtggaggttaacaacattctgccaaactatcaacatataggggaaatgggcccactgaattacaaaggagtcacataaattgtcaatttttaaactactgtgataaagatatttgcaatttgtgcttacatttgagatctgctctgcataatcttgcctcatcttttccaaacagtagtcttgtatttcactacctttgctcacccattgctcctacaactataacacttagatttcttagtctgaagaaatacaaaacctgtaaatctactttgctttattcttaggcctggacctgcatctctggccagactggctaattgtcttctaaaccatttctaccttaaacctttgatagaattttttttctacttagaatgccttcaccagtaccctattttactaaatacttgcattttttaagatactcagattccattttatttcatttttggacatggacatacaagaaatatgttttcttgcagctcagagctgaaaaaatatcactaagtagagtacagttaggtagcagtttatatctctgaatttcctacattctaccaaaagaggacataaatcagtcttgtagcatctccaagctaataaactcaatagtcagcctctatgatttttgctggatgtgtgtgtgtgtgtgtgtgtagtgtgtgtgtatgtaaaatggacactaccatttggactttgcacaaatttaattattaaaaaaaaggaatgctcaatagcctcccaagctcccactaaaaccatccccttttcattaactttgaaatagattgtttcataaacaaatcaggtacacagtaaaattgataaaagcttgagtaggaacacatagcccagttttgatctcagctctatgctggattactttctccaggaatttcaactgatgattagtcagattccacttgaccatttccagtggttaggattttggctggttttgaagcatcacggctctgactggagagctctaattgttagaaaggcgtgccatatacctagttaaaatatcttttctgaagctttctcctgttagtcttggtcaattcttttaaaagatctcagaaaaagtgtaatacttcttccagttgaacacccttcctgtgtttaggggcagacatctcatttgctctaagtcctgtcttatctaaaatttgcaggtatgtttaactttacaattatgaaatatttttagatgtctcattattctactccctagcaatacacagattttcagtatagcaccaacatttcattcatttaacagatagttactgaggccaggtaatgtgctgagttgaggattcacaatgaaaggtgatggagtttgtgatggcagaaatataggatggtttaaaagcacacagtaggaacacatagcccagtcaatgatagggagggtaaggaagagtatgctgaaatcttagggtgaaggcagggaagactatccaagacacaaagaaaagtagaggcaaaagcccagaaacatgacaaggcattagagattcaatgctatgaatggagcctgttatgtgtggcatggtgtgccattaggtggagggtggagatttggcaggtgccatgttggcaggcattgtaaacatctcaaaagagttaggattaggaaccacgagatggttttcagcaggagggctcaccagcaggagggctcacatgctcattttttattttaagaaggtccctgtggctgcagaaaaagaaacctgagtgcatagagatttagtgaacttaatgatttattggatggcaaaattggaggtggtgataagaaagagtactggagtactgaattaaagctatagatgctggggccttttctaacaagacagaagccatttgggagagtggggatggtaatgaattcagaatggaacccattactctagacatggtagataaaatagccctcattctaatctcatatgaaatattcataacattcctggaagtaatggctcaataatggagctgctagtattataaactaatttattagatgtttttagagtaagcacaatgtgcttataaaaaacagaaatgtttacctagtaattattactttgataacgttggcaatatatatactataggctcaatataactatcttaaaaacaattactgctcttaatcattaaagtaaattcaattagacatgtacatcattagctaagcaatttagattagttactcatatctactgatctgctgagcagtcactgacatgctgccagaaaatctggagcatgggatattatctccgctctgacaactgctccacatataggggttctaaggaatagctaatcttaaaatgtatggcctcagttcaatatatccattcatattcaaagtctaatgggagcaacatttttcattcttctttgatgagttttatatctttcattttcaatttttaggaaagtgagcatgtgtgactgaacaagttatctaaatatggttttggaattttgaagatttgtgagttagaagtagcaaattgtttctatctgtaactaggggcatctgttatatacaacataaacacatattttgcatcatttgtgttatttatacaattattttcaagtctcaaatacgagcttactacactaaccattttcttattctcttcagtgccaatcttagaaaaattatattgcttgccaggtagtgtggtataacagaagaggttaacgttggaaccaaaaagacctaggtttgaatgtcatttactaggtctgtcactttaagcaagctacccaatcttatgagcttcagtttactcacatgtaaaatgtaactaataatgcctacttcacagggtagtttaaaagatgaaaataataaataaaaatgtttggcattatggcatcacagtattagagccaaaagtactcacagtaaataaaacattaatagtttggaagttgttgaaacaaaaagaatattctttttttctttccttagctggagattctgccaatctcatcattgcatttgttatttatgtttgatggtgattttatgaattgagggatgaagggtccccaaagatcagtagttgaaattaaagaactagcaacttaaaagtcaatgaaagagaatttgggttaattttatattattatccatgatcttactaaataaagacttcatgatatatggaagtgaggctttggttataaaagatcaaagacatacactttgatcttcactagaacctttgaagactcttaaaaatattgcctttttatttcttagccagaaaataaggattagatgagagagactaaatgtggatttaaagttaatcggatctgcatatatgatatacagcattgatgaaacaagatttcctaagaagaaaaagaagtgatacttcagccagtttgtccataatttctggtgacacacattggttctcaggcccgaaggataagtgttgctgctgaatgtggttacaatttttagcaaaatcacatggatcaattgaaaattctctagacatgttttctggctggtctgttcctttttaacaactgtcttaagttttaagcagtttcttcttgaaaggcagatgtgctgaaacgtgtgtgaagccatgtgccattaggagtataacacaaagaagttgaaacacaaccctgtacatgaaccattattgaagtatttgagttattacaaaacagcaagaatcctaaagtcttgagcaattatcaaagtgacaatcatggacattgtaatgttaggatttcaactggttaatctgccttcttattgcttgttgatagctttcagagtgttcatcatgttggtcttcaaaatgaagatgtagtagatatttccttgtataactggttaggttattttatatattctcatgtttcagctataaaaattgcttattggtttttgtttatttatgcggaggacataagggaatacttaaaaaactaaaacaataataactaatctagattttaatctcaagtctgccatgatctagctagataaagggctaattgcgtcatgtctttagagtttcattttttgaacctatgaaattaagaagtttgataagatgacattcttgatccttgtgttgaaatttaacaattttagttattgttggacacacacacatacacacaggtctatctacgtatacactaacataccacataactgatttctcatgatgtttcatcattctgtggttgtatattatggcttgcttattttctacaatatcaataagaatactaacatactactaattctatagttacattttattctacatttaaattatatttaatatccaattgaaattccattctaagcctaacatttcatagcagacaccacttgaattttgatccccaaatctgtgttgtacatagtgccttatttggaattctatgcttttgagaataacgccacattaaggcatatggtggtggaataaaagagaactagatagtagtggattttgtcctgacttccactaaccaagtaaccttagtaaggcaatttgtctttcttttcccaggccatgttttccccattaggcaacagaggcaaagtgcctggagactaggagttttatctggacctatcaaaaaatgtaaggcctgaaaattttcagtgcattcagtatatgtaaaaatgtatcaaaatagaaatcaaggctaggcgcggtggctcacgcctgtaatcccagcactttgggaggctgaggcgggtggatcacgaggtcaggagatcgagaccatcctggctaacacggtgaaaccccgtctctgctaaaaataattttaaaaaaacttagccgggagtggtggtgggtgtctgtagtcccagctactcgggaggctgaggcaggagaatggcgtgaacctaggaggtggagcttgcagtgagctgagatcgcgccactgcactccggcctgggcgaaagagcgagactccgtctcaaaaaaaacaaacaaataaataaaaaaataaaataaaatgaaatcaatacttttgcataaatgtctataaacagattacatttagtgtgaggtatgagtgaattgtattatgcttgatgtaatatgggatagacccctcaaggtcattgccaatgcctttggttaaggcaaactggtagagagggacagactcaatagtttcaaaggacccttccatctttaacacttcatcattatattcactgttttaaaataatgtttttattatcattcttgatggcttacaataaaaaaaaacagaaaatggacttctctgataaatttactttgaaggtagtagtgtaaagcaagaaggttttgatgtgagatagatgtgggtttatatctcagttttaccacttagccatcgaaggatcctacaaaagcgacataatgtttgtgaaatgtagtttctttttagaaattttatttttatgggcatatagtaggtgaatatatttatggggtacatgggatattttgatacaagcatacaatgtgtagtaatcacattagggttagtaaggtatccatcacctcaagcatttaccattcctttgtgttacaaatattctcgttataccatttaacttattttaaaatgcacaataaattattgttgactgttatcaccctgttgtgctatcaaatactagctcttattcattctccgtttagtccccactatcattcctagtctctggtaaccatcattctactctccatcaccatgtgtttgtttcaatttttaactcccacaaataagcgggaacatgtgaagcttgtctttctgtgtttattccacttaacataatgatgtccagttctatccatgttgttacaaatgacaggacctcattcttttttatggctgaagagtagtctattgtgtttacgtatcacattttgttatccattcatctgttgatggacacttagattgcttccaaatcttggctattatgaataatactacaataaacatgagagtacagatatctcttcaatacactgatttcttttcttttggtacaaattatcaatgggattactgggtcatatgatagttctatttttagtttttttcaggaacctccatactcttctccaaagtagctgtacaaatttacattcccaccagcagcatgtgagggtttccttttctgcacatcctcaccagcatttgttattgcctaacttttggataaaagccactttaactggcatgagatgatatctcatagtagttttgatttgcatacctctgatgatcaatgactttgagcaccttttcatatacctatttgccatttgtatctcttcagaaatgtctattcagatctttcgcccatttttaaatcagattattatggtgtttgcctatactgttgcttgagttccttatatattctggttattatccctttgtcatatgagtagttttgaatattttctcccattcggtgggggtgtctattcactttgtttgttgtatcctttgctgtgcagaagctttctaactggatatgattctatttgtccatttttgcttagttgcctgtgcttgtgaggtatcattcaagaaatatttgctaagaccaaatcctggagagtttccccaatgttttctcttagtttcataatttgaggtcttagatttaagtctttaatctattttgattggatttttgtttatggtgagagataggggtctagttttattcttctgcatatggatatccagtttttccagaactaatttattaaagagactgtccttcccttgttatacgtttttttcactttggtcaaaaatgaattcactgtaggtgtgtggatttgtttctgggttctcaattctgttccattggtctgtgtgtctgtttttatgctaggatcatgctgttttggttactatagctctgtagtataaagtcaggtaatgtgattcctccagttttgttctttttgctcaggattgtttgggctattctagctcttttgtgattcctgtaaattttaggatagttttttttttctatttctgtgaaaagtgtcattggtatttttatggggattacattgaatttctagactgttttgggtactatggatattttaacaatatttgttcttccaattcatgaacatgaaatatttttgcatttttttgtgtccttttcattttctttcatcaaagttttacagttttcattgtagaaatcttttacttctttaattaagtttattcccaggtattttattttatttgtagctattttaaagataattacttccctgattccttttacagattgtttactgttgccatatagaaatgctactgatgtttgtatgttaatattgtatcctacaactttactgaattagtttaccagttatactagttttttggtggagtcttcaggtttttccaaatataagatcatgttgtctacaaacaaggataatttagctgcttcttttacaattcagaggcactttatttctttttcttatctaatttctctagctaggatttctagtactatgttaaataacaatggtgaaagtggtcggccttattgtgttttaggtctaagaggaaagcctttcagttttcccccattcagtatgatactagcttgtggatttgtcatatatggctttcctgtgtggaggtatgtaccttctattccaaatttctgagggtttttatcatacagggatactgaattttgtcaaatgctttttcatcatcaattgcaatgatcatatggtgttagtcctttattttattgctataatgtatcacatcgtttgatttgtgtatgttgaaccattcttgcatccctgggataaatcccacttggtcatgatgaataatctttttaatgtgttattgaattccatttgctagtattttgttgagaatttttgcatcattgttcagggatattggcctgtagttttctttactttgatgtgtctttgtctggttttggtatcatggtccttctggcctcataggatgagtttggaagcattcccttctctgctgtttttcagaatagtttgagtaggatcagtgttagttctttaaatgacgggtaaaattcagcagtgaagctattgggtgccaggcttttcttagttgggagactttataatggcttcaatctcattacctgctattgctccattcaggttttggatttcttcaggactctattttgataggttgtatgtgtctaggaatttatccatttcttcaaggttttcaaatttattgacatatagccattcatagtagtctctaatgatcctttgaatttctgccatattggttatgaggtctccatttttgtctcttattttatttatttgaatcttctgtcttttttccttcatctggctaaaagtttgttgattctgtttatcttttcaaaaacccaacttttcatttcattgattttttatttactaattcatttgtttcaattccattttctactgctttgttctttatggtttattttcttgtactaatttcaggtttggtttgctcttgcttttctagttccttaagatgcattgtaaggttggttatttgaagttcttctactttgtatgtaggcacttattgctatcaactttcctcttagtactgtttttgctgtatcccacaggttttggtatgttgtgtttctattttcatttgtttcaagaaattcttcaacttccttcttaatttcttcattgacccattggtcattcaggagcttattacttaattctgatgtgtgtgtgtatagtttccaaagtttctcttcttattgatttttaatgttattccactgtggtctgagaaatatttgaaattatttcattttctttgaatttgttaagacttgttttgtggcctaacatatggtctctccttgataatgagctacctgctgagaagaagaaggtgtattttatggccattggataacctgtaaatatctattaggtccattttatctatagtgtaaattaggtgttatgtttctttgttgattttctgtctggatgatctgtccaatgctgaaagtggatgttgatgtctccaggtattattgtattgtgatttatatctctctttaataatatttcctttctatatctgtgtgcttcatgggtgggtgcatatatgtttacaattgttaaatccccttgctaaactgaccccttcatcattgtataatgaccctctttgtctcttcttatagtttttctctcaaagtttgttttgcctgatataagtacagcatatattgtatgtcatttctggtttttgttggcatggaatatcttttttgatccctttatgttcagtctatgtgtgtctttataggtgaagtgtgtttcttgtaggcaacatagttgggtctttttaaaaaaaaccttttagccactctatgtcttttgactggagagtttagtccatttacatttaatgttattattggcaagtaaggacttgctatggccatttcgttatttgttttctggttgttttgtggtcttccttcagtccttgtcttcctttcaatgaaggtgatttttctctggtagtatgcattaattcttgctttttattttttgcgtgtcttctgtatgttttgtgatttgagattatcatgaggcttgccaataacatcttataagacattattttaagctgatgacaacatcacactgattgcaaaaacaaacaactaagaaacaggcaaagagaaaactaataaaaactgttgattataacttcatacacccccaccgctttttaactttttattgtttctatttatgtgctattgtactttctatgtatttaaaaattgttgtaattataatttttgatgggtgcatcatttaatcttattactcaagatatgaatagtttgcacaccatagttacagtgtcataatattctccatttttctgtgtacttaccatttccagtaagttttgtaccttcagatgatttcttattgctcattaatgttcttttctttcagactgaagaacttccgttagcatttcatataggacagatttggtgttgttgagatctgtcagcttttgtttgtcagggagtctttatttctccttcatgattgaaggatttttcactgtacatactattctagggtaaaagtttgcattttttcccccttcatcactttaaatatgtcatgacactctctcctggcctgtaaggtttccattgagaagtctgctgccagatatattgtagctctgttgtatgttattttttgtttcttttctcttgctgcttttaggatcctttctttatccttgatctttgggagtttattgtcttgagatagtcttctttgggttaaatctgcttggtgttctataccctccctataattgaatattgatatctttctctaggtctgggaagttttctgttattattactttgaataaactttctatacctatctctttcatcacctcctctttaagaccatcaactcttagatttgcccttttgaggctattttctagatcttgcaggcatgcttaattcttatctattctttttcttttgtctccccgattgtgtattttcaaatagcctaccttcaagctcaccatttctttctgctgcttgatcagttctgctattaagagactcagatatgtttttcagtacatcaatagaatttttcagctctagaatttctgcttaatttttaaaaattatttcaatctcttgttaaatttatctgataggattctgaattccttttctgtgttatcttgaatttcattgagcttgctcaaaacaactattttgaattctctgtctaaaagtttacatatctctgtcactcctggttggtccccagtaccatatttagttagttgtcgaggtcatgttttcctggatggtcttgatgtttgttcatattcttcgattttggggcactgaagaatcaggtgttgattgtggtctttatagtctaaccttgtttgtacctgttcttcttgagaaggctttccaagtattgaaagggcattgagtgttgttatctacctggtcactgtagctgtatctgcattaggaggcacccaaagcccagtaattctgtgattcttcaagactcatagaggtactgccttgggggtcttgttaaaatctgagggactttcctagattacctagcagaagctcttgttatctttcattactttcccccaaacaaacagaatctctctctctctgtgctgagctgtgtagaactctgggagaagtgatgcaggcgtcgtgtggccaccactgggactgcactggttcagacccaagccagcacagcaccgagtcttgcccaaggcccatggcaaccactgcctggctactgccaattgtcactcaaggcccaagggctcttcagtcagtaagtggcgaatccagccaggctgatgtccttcccttcacagcggcaaaccctactccatcccagggtagatctagaaatgttgtctgggagccagagcctagaacagggaacgttagtaacctacttggtgctcctttctactgtggctgagctagcaccctagctgcaaaacaaagtccttcccactcttccatctcatttcctcaagcagaaggagactctctttgtggctaccacttccccaggtccatggtgagtactgcctggctaccaccaatgttcactcaaggcccaaggactctttagtcagcttgtagtgaacgctgccaggcctgagtctctcccttcagggcagtgtgggctcccatcttgctcagggcgggtgcggaaatgctgtccagaagccatagctagaatcaaggaccctagaagtcctcttggtgctctactccattgtgactgaactggtacccaagctgcaagacaaagtcccctttagtcttccctctcctttcttctagcagaaggagtccgatatggtttggctgtatccccacccaaatctcatcttgaattgtagcttccataattcccatatgttgtgggagtgacctggtgggagataattgaatcatgggggcagtttaccccgtactgttctcgtagtagtgaataagtctcatgagatgtgatggttttataaggttctcattctctcttccctgctgccatgtaagatgtgacttgctccttcttgccttctgccataattgtgaggcctccctagccatgtggaactgtgagtgaattaaacctctttcctttataattacccagtctctgttatatctttatcagcagtgtgcaaatggactaatacagagtctctccctctgtattagtcactgcagctgagattatgttgggtcacatctaaagctgacacagcactggctctcacctaaggcccatggtgaatactgctggctccagctgatgtttattcaatgcccaagaaaatgtcagtcagcaggtgatgaatcttgctagtactgcttccttcccttcaaggcagtgggttcctttctggcccagggtatgtctagaaatgtcatccaggagctagggcctggaatggggggtcttagggctctgcttggtgccctgttccactgtggctgagctggatctaagtcgcaaaaaagtcctctttattctattgtctgctcttctcaagcagagtaaaggggtctctcccagagctgcgagcttcactgcctgtggttaagggatgggtgatgactcaagcactcctttggctgccctggctggtatctcactaggtcatttgcaccccatgtgtgcgtgtgccggctccgagcccagcacagcactaggacttgcccaggaattgcagtctttgtggcctagattgcctttcaaacatacttaggaccccagagtgctttagcttgtgttggtgggactacctgagtctcaggattccagccactgggatgagtgcttccccctctggctagggctggtctaaatgccccctccatgggcatccaatgcgaagactcacaatctctgaactctctctcccacaagcacacagattctctctccccaccatgtggtcactgctggagaatgggggaggggtggcatcagcaattcaggactgtcttttctaccttcttccatgcctctttcagtgatatgacattaaaaccagagattgtgattgctcatttgatttttggttctttcttatgaagttgctttcttgtgtggatagttgttcaatttggtattcctacaggtggggaggggatgactgctagaggcttctatttggccatcttgctctgctacctcttgaaatgcaatttctttatctggaatatagtgtagtattattcactttatgtaaatattaatatgaagattaaatgaaataatacagttattggtacatggtagtggtctaataaaagttttctttttccttccattttaaacatgaaagtccattgaactggtatttttatacaagtagttatgcatatatttgaaagagaaactgatttctagtcttttctagctgaaatatgataatactacagcttctataaaacataggaaccatttagtcagaatacacatctaattttgtccttgtttctgataacaaactgtgagtctgagttcctgattttattgtcagttgtacttatccttctgttagcaacttaaaagtggttagacatctgtttaagttttatgtcgtttttatagggtaggccctaaagtatctaatttgtgtgattcatagccaaatttccaattacaggagtaaagtttcaatcttattttaatccataatccaaaaggaatttttccttgtcatcacaaattcatgacagtatatagtttacccatctttgaacaggttgagccatctttgaagtctttgccaaatacttggtaggccaacaggctttataagtttcttctaacagtagacattctaagtgaatcaactatatctttagtgcatttatttatttatgcatgtattaagtatacatttagcaataagttaactgattataaaaattacatttctggaaacacactcatatatgtatgtatatatataatcaaaatttatcaatacattttagagttattaatttatattgggggactggtctaagtccatattttaactctataaccactatccagctaccttttcatattgttaaatcactatcaccagaattttttaaattcactctaatttttatataacttacttcaaaagttatacttatttctccttgctcattgtttttgcttatatggcttaaagtttgtatatcaacaaaaaatgagtgattttagagttaggtaagaggctagcagtacaattgcacagtagaatgttaacatttaaagaatataggggtgaattgaaataatttttcacttatttaatcaattaataactattaagcactaactacatgttctaggtactgtagatgcagtgatgaagaaaacaatttattctgtgagtttgtgttttgtcagcaagagaaataaattaaaacgtatagtgctatatttgtcaaaatacattcatttacttccatgtatttaataggagtttactgcagaacatgttgttttcatagaactgtcatactgtacatctattgttagtctcaaaagagatgtatgttgaaaaagctctagatttctgggataagtcaacaaagggaaagatcatacttttttgttttgcattgtaaaacaatgtgctgtttacattgaggaatgatcattattctaaattaatgtcagataaaagaacatggttataatttaagttatagtttgagactttatgtattatacattcagactaatcaataatagttatttctattgatttccttcaaattttatatttgtaatcctgtcttcttaaatatttaaagcaaaaaatggacagtaatgtgaaaaaacgactttatactataaagctctcagctataatgatctacctaaactaagaccaaataaaaacattgagagtataattcctaagtctagtttctatgctggatgtgttaggataaaccagatctctgattagcgagcttacaaactagtttaaggaaacaagacaaggaaattagaacagctaacagaaatgagaaacaatataaaggagttgcaataagtagatgattcattatttaataatgatgtcaacagtaaatgctgtaagtgtttggaagagtgagaactctaagaagattgatgtttttagaattgacttcatggaagagttggagttacattccaggcatagcttgtggaaaatcatggagggagaccttataaagtttagattgttcaggccagttagactagagcagatggctaacacagatcagtgagaatttaggtgtgtggggaccagagggttcaggatgaataattctgaatttctcttgcaaaataaaaattattgtcattctatgagctagaacatgatgtgattaaatgaggttcagtcttgcagcatgcaatttgaaacatggagtggcatgaaagtcagttaggagaccagtggaatagtgtaggaacgaatgataaggatctgactgggggatgggaaagcaatcgattgaaaaagactaatttctgaggcactgagaaaaatgaatcaactgatgacttgaatcattgattggctactgagtataaaatgaggatgatgagagagtcaagcaggagtcttaagtatggataattgggtaattagaaacctggaaaaggaaaatacttttgtggtgaaaattaagttagtcatttacgaaagtatagtgaacatatatatctatattataatatattaaacacagatagtgaatgcaacattacattactgagatgttattataagtatatttatgccatgaaaaaattcttatacacaacaactcaacttcaaaaataagaccaaatgtagagattatttgaaagagtaaaggtttgtatcattatagatacagcttgaagttatctaagtcttgtcaatctgtggagctagatgtggtcttatttacaataattcctgaagtttctttgcatggtagccattacctgctaatgtgggccctccagccccatgcaaagtactttctctcatcaaatatttttgccatcccttgggtggagtatcacatgtgtacaatttcccatgatttttacagctctactgggcacagctgctacaacttcacgccatttcaaccagaaggcacgtattttcttagttggtggccaccctcagctctgagcctgctgatgatacaatggtactatgctgtttgttcaaaaatgattattctttttattaaccctttagaagcgtcccaaaatacttagggcaggtttattacagagaatgggtaagtgtctcattcagtttttacttatagctcttttccccatttttgaagagaaaatgagttcagggaggttaagtaatgagcctgataccatataacaaatcagtggcagagctagagtttgaactcagagatctgatcacaaatccagtgttcttaaacacagaatttttatgaaagacatccagtttcataagacagcattgaaataagctccagggatcagatccagaagtttatcaaatcagcaaaacatattaaatagaaattcctgagctgaagccaagcttagcaactaatttgatgaagtgttcttcagagtaagcagtggcatatagatccatctctgtaacagcgacttgagaacatcagatatactaaataaatgagatgcttaagaaatcagttccctgaaactacgaccatttgaaactggtttaaaccagttaactatttgtctgacatttaatattgaagcctcattagagacataattagttttcagaggagcaggagattgctgatgactgtaaagatttaaaggactacagtgccctatgtgtatttaaattaaagtagcatcattttgatttggtaagctattttagtatatttaaaaatattcatactgtgattcctgataagtaagatctgaggtaaacagattatatgttttaattcccacattataactgcatagaattagatgaaagaagagtaatatcttagataaaatatcttattagacatgttcatgcgttctggaattgggggttagagaatgagaaggactgtgcaacttgtactttcctatccctctgtctttttgagagccacatgaggattctctttgagcatgaagggcctaagggtaaaggtaaacgtttgcagaagcctagagtagaataagtcgttccctagaggcccctcacattttgaacactgttttgcatctgtttccctgacagcctcagaagaaaccacaactcttctcaacatgaagtttcttctaatgttctttgattctttttctcttctctttccataaggggtttaaagtcctatcctttctggtatcctgatcctctctttccccactgtcttcctttcttctgctttttaaagtgagtaggagcccatatcttaagagaaagaaaaagaaaatacttttgttctgaccttccccaaccttttctatatggtatttcatttctttctggctgtttatgagtcagctttccaaaggttagtctgactttgtttttggattctcattagtcactgaacccacttcaatttggctttctctaaatctcctctctagaaggtcactttatccaaatacacttgtctgtgcttatctgtcttgatatctaagcttctgttgaaaatgctgacagttttcttcttgaaattctctccaccctttgttttcatgatcccacgccctctttttctgtaataccctgggtgacttctctttctcaatattgttggctggtaacccctgtccctcctaccctccatcatgggaaagaatgggctggagtgtaaatgaatctttggtaattcaggcagaatctagattgttgtctctcatgcatgtggtagaaagagtccttaattgtttaggaagaagtgaggagtagacctttgtgaagtttctttggggtataagaagctattcatatggcccaagccatcaaattttatggttattctttctctctctctctttttttttttttttttttttttttttaatggagtctcgctctgtcaccaggctggagtgcagtggcacgatctcatctcactgcaacctccgccccttgggttcatgcaactctcctgcctcagcctcccgagtagctgggactacaggtgcgagacaccacgcctggctaatttttgtatttttagtagagacagggtttcaccatgttggccaggatggtctttatctcttgacctcatgatcctcccacctcggcctcccaaagtgctgagattacaggcgtgagcctcacgcccagccaaaaaaaatggttattttcttaagattttagattccttaatataagaaagaagatgatggcaatttctctctgccttttaaaaactgctcctgaaaagaaaaagtatcagacagaaaagagctaaagaggttaaaggaaggcaggtaaaggagcaactaatatggtctagaaagtatcaggatatatttatcctttcctacacaaaacagaaagtggtcattttaaagaaatgaacgaacactttagacattagagctaatcacctgacacattgcttgatacttatctgtgaggcagccagaaatagcagggggaggagagaccccagtagaaacgctctaagccaatagggctacaatcagagttaaaaagcaagaaagattctaaaatgcattggcaatgaaccacttatgagtagatatttctttcagtcatgatctaaattgtatgttttcttaagaaatgtcaaactgaattagtacctagtgtttacttaacttgtgctattgtttaaattaaacaaataatttaattaaagaaaccactacatgctgtaagacataaattgatgaaaattttttggttaacaccatcttcacctgaagtcaatttatgttttcaattaaattaaaaaatatttagtgagcataggctaaataccactttgcaaggctctggggggaaatcagagataaagcaaaattcataaatctgggtatagacaatttaataaagttgccttcattctttgtgaaattaaaaaagtaaaacctgtaggaaagtaataagataaaactagcagcaccaaaagaggcaaaccagtaaatctccatgccatgaactttaaaatgtggcagtgaaggaaagaaatagactctatcccaactcagagtggctgtttactcctactccatccccacacacatacgtagcacaaaataattctgtgaatttttatttaaaacatccaatttgaaaagactttgattaaaggtgatttctatacagatttccaaatcttacaggagacaataaaaccctgaagagtagtaactattaaccactactgtagaatctcaggatcttagtagaagcttgagagaccattagaaatcatcatggccaggcttccataattaatgagaagaataagtgtatctcccttataaataatgaatgttgctaacaggtggagtgaaccctaatgcaagaaatttaacagtatgttgaagaaatatcagagccaagaccagtgatgccctccttccccactcatccttagacatatgcttaggttatgcaaaagtggatgtagaaatacccaattctcacttgtaacttgtggcaagaagataataaattaatgtggaaataatatcaagaatgatctatagtttgtcgtatcaaaatataaagaaatggaatagcaactttgtaaatataacacatagagacaaatgtaaaaaaccacaatgtagcttgctacaggcagattaagtaggcaatatagaaaaattatcatgcaagaaacagaaaaaaatttatttgtcaatgctcagtgatgcagaaatactgagtaacaacatgactctcatgatcccacagctaaaaattcagatgataagaagaaacagtgaaataaaatggaaagaatataccaaaatggtaccactactgaattgatgaataaattacaaataaaaaggaaaatataataggcaagctaaaagtgaaattactgatctggatgaaaagcttgagttcatgtgtagggaaaagacatggaaacaacttgaaaaaaagagtgagggcaaagacaatccaacataaggacaattggtgtcacccttggcaactgccccacctccaacaaaagaaaacaacaaaaacaaattatatagtatcaaattttaaactataatactggagttgaaaggacattgatgatccaacaacaacttgcctagtgtgcttaagataaaatattattattaaattattgatttttttttaagacaggattttcctctggttcctcaggctggagtacagtggcacaaccataactcactgcagccttggtctcctgggctaaagcaatcttctcacctcagcttctcacatagctgggactacaggcatgcaccatcatgcctggctaatttttaatttattgtttttaatttttttttgtagaaaccaggtctcactgttttgccaggctggtcttgaactcctgtgctcaagcaatcctcccaccttggcctctcagagtgctggggttacaggtatgactcaccgttctctccctgaaatttaataataattattcagatgtacaggcataaaaagcaaatttctccttctcataatagcgctaaattacagaatatggtaggagcaatatccacatgattttaaaggaaagtgtgacccaacatatatttaaaccagacaaattatttttgtatttcaaggtacagatattctcaagcatgtaagaattaaaaacagttttctatgaggctttctaaaaaataattaatgatgaaattcactaaatctgagcaagttaaaaaggacttagcatgaagaagctgtgatacaaacagtatttgtgagtgtatatcaatccttagaattaaggttaaataactatgttttggaagagaatgtaaacattatatcccgaaatataagaattagaaccaaaaaatttaagggttacaaaaacagtttgaggacaaattaaagtactaatttttaaaatatttcagagcacagtcaattgataaccactacacttgaaatattgttaaaataatattctctattttttcacaatgtaaaattatctttaaagagctgttacctctcggtgaagaaatatttatttgaaatttactaacttctagaaatttacatcactatctttttgttcattaaattgaagaagtattatagaacctgtaaaaactagcaatatcttgggaggccgaggtgggcagatttcctgagctcaggagttcgagaccagcctgcaacacggtgaaaccttgtttctactaaaatacaaaaaattagccaggcatggcagcatgagcctgtagtcccagctactcaggaggttgaggcaggataattgcttgaacccaggaggcagaggttgcagtgagctgagatcatgccactgcactccagcctgggcaacaaagcaagaatctgtctcaaaaaacaaacaaacaaacaaacaaacaaacaaacaaaaatactagcaatatcgtggatagtagaaatccattaaattaaaaaattaatatattcttctttttttttttttaatgggtacaatgtatgttatttgggtgaggaatatacactaaaagctatgacttgacaaccacccaatctctgcacataacaaagttgcacatgtactgcataaatttgtgcaaaaaataaaacaggttctatactctttataaggcaattattgacttaaagagtaaattgtttctctttctctttgccaaacctcaagtaaataaaattattattattattattattattatttatttatttatttatttttattatactttaagttttagggtacatgtgcacattgtgcaggttagttacatatgtatacatgtgccatgctggtgcgctgcacccactaactcatcatctagcattaggtatatctcccaatgctatccctcccacctcccccaaccccaccacagtccccagagtgtgatattccccttcctgtgtccatgtgatctcattgttcaattgccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggagtcgccacactgacttccacaatggttgaactagtttacagtcccaccaacggtgtaaaagtgttcctatttctccacatcctctccagcacctgttgtttcctgactttttaatgatcgccattctaactggtgtgagatggtatctcattgtggttttgatttgcatttctctgctggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctcgggtttttatggttttaggtctaacgtttaagtctttaatccatcttgaattgatttttgtataaggtgtaaggaagggatccagtttcagctttctacatatgtctagccagttttcccagcaccatttattaaatagggaatcctttccccattgcttgtttttgtcaggtttgtcaaagatcagatagttgtagatatgcggcgttatttctgagggctgtgttctgttccattgatctatatctctgttttggtaccagtaccatgctgttttggttactgtaggcttgtagtatagtttgaagtcaggtagtgtgatgcctccagcttcgttcttttggcttaggattgacttggcaatgcgggctcttttttggctccatatgaactttaaagtagttttttacaattctgtgaagaaagtcattggtagcttgatggggatggcattgaatctgtaaattaccttgggcagtatggccattttcacgatattgattcttcctacccatgagcatagaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgtgaccatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtctgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatctattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcagaatgatgctagcctcataaaatgagttagggaggagtccctctttttctattcattggaatagtttcagaaggaatggtaccagttcctccttgtacctctggtagaattcggctgtgaatccatctggtcctggactctttttggttggtaaactattgattattgccacaatttcagctcctgttattggtttattcagagattcaactacttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttcttagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcattatgtatccagtagtcattcaggagcaggttcttcagtttccatgtagttgagcggttttgagtgagattcttaatcctgagttctagtttgattgcattgtggtctgagagatagtttgttataatctctgttcttttacatttgctgaggaaagctttacttccaagtatgtggtcaattttggaataggtgtggtgtggtgctgaaaaaagtgtatattttgttgatttggggtggagagttctgtagatgtctattaggtctgcttggtggagagctgagttcaattcctgggtatccttgttgactttctgtctcgttggtctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttcccttggcttggtagatcttcctccatccttttattttgagcctatgtgtgtctcggcatgtgagatgggtttcctgaatacagcacactgatgggtcttgactctttatccaatttgccagtctgtgtcttttaattggagcatttagtccatttacatttaaagttaatattgtcatgtgtgaatttgatcctgtcattatgatgttagctggttattttgctcgttagttgatgcagtttcttcctagtctcgatggtctttacattttggcatgattttgtagcggctggtaccggttgttcctttccatgtttagcacttccttcaggagctcttttagggcaggcctggtggtgaccaaatctctcagcatttgcttgtctgtaaagtattttatttctccttcacttatgaatcttagtttggctggatatgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagggtaatttgatcgtctgaagccttcttctctcagctcgtcaaagtcattctccatccagctttgttccattgctggtgaagaactgcgttcctttggaggaggagaggcactctgtgttttagagtttcccgtttttctgttctgttttttccccatctttgtggttttatctacttttggtctttgatgagggtgatgtacagatgggtttttggtgtggatgtcctttctgtttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacacagttcgagcttcccagctgctttgtttacctaagcaagcctgggcaatggcgggtgcccctcccctagcctcgctgccgccttgcagtttgatctcagactgctgtgctagcaatcagtgagactctgtgggcgtaggaccctctgagccaggtgccggatataatctcgtggtgcgccgttttttaagccggtccgaaaagcacaatattcgggtgggagtgacccgatttcccaggtgagtccgtcatccctttctttgactcggaaagggaactccctgaccccttgcgcttcccaagtgaggcaatgcctcaccctgcttcggcttgcgcaaggtgcgcgcacccactgacctgcgcccactgtctggcactccctagtgagatgaacccggtacctcagatggaaatgcagaaatcacctgtcttctgcatagctcacgctgggagctgtagaccggagctgttcctattcggccatcttggctcctccccctatattcttctatatgtgtttatgtaacaagaattatctggcataagattcacctgataatgatgattatatttggatagtaatattgagtggctttcttcactatagtggactgtcttgcttgaattttaagaagtggacattatttttatgtgaagaaaaaagtcgttaagttgctaaacattcggataaaaatgtttggaggcaaaaataaagtaaaaaaatttaaatcatttacttaacttagttatagcctggagaatttgtatttatgacttaggatgtcatcatttcttcaaacacattttttaaaagaattcaacaatatgttaaaggagaaatcaaaagccttgctgtaattacttaggcataatttgtattacaatagcctcacttcttattttcttatcaaatatcattttagtcccattgcaatatgaacactgatacagctctttgaccacacacattgttttcccatgatcaacagctgctgaaatgttttactagaaacttcaaaatttataaattctataatttatggtttatatattctactatgagtaattctactacttagccaaacctacctagaagattttgttaaaagaaaaaaagattgatattcacttaggaagcatgtatgtatgataaagaaattgtaccatatcttattttttccacattccagatcatagcccaatcttaaactcgggagattgttggagagagttagaaattttggtgccccttcatggggaagtcctatgggtatcagtttaaagtttagtatttatttttgcattggtagaaggtaacttgttctttcctaaacatttaaatttgtggttacagtgatgtaatacaccaacaaatcatagcagataaacatggaaactggccttctgaaatgttcatagttcagccaaaagtcaagggggccatccctttcaactgagctaatccaatctaaagaagagttaacatattggtttcatcagaactgaatatcaactattgcatttgtttctagacgtggttaactttttcacctctttcaaaccttgctttaatgtcggtttctcaatgagacctaccctgtctaccatatttagtttgcaaacccattactctgcactactggttcgtttttccataatacttattaccatccaacataccatataattaacttatttattgtgtttattgtttatgtctccattactaaggggaaaagatctttgtcaggtttttgttcactggtatattccaggagcctagagcagtttctgatacatagtgggccccaccacatacttatttttgatgaatttatttccattatgttcagtgtctccattcgtgctgaaaggcagtatagttagcagtgtgggctcaaagttagactgcttgggttcaggttctagttccactacttacaagctgtgtgagctgccctggattatacaatgccagaggttcaattttctcatctataaaaatgttaataattccactacctattatgaggattagaatagcgtgatgggatgaataatgcccaacatactaagtgctcgataaatattaatgctttctccttaagttatcaatatattcaagcctcttattttaaaaacaaaacttctcttgagctctctaggcattacctcatcttctgcccttcagagacaaacttcttgagagagttgttgcaaattctttatcttttatttcattttagcctgttgcagtctgactttacccccaaattcactccactccaattgctttgttaaaagttactattaataattatccaataattgccaaatccagtaatcatttttaaagtccttgatccctctctactacttaacattgttagctatgttaactttcttgcaattcttttcttccctgatttttgtgatgtcctcctttccttgccacatcttgctctgctcctaagtttcctaccacacaaacaatgatctttctagagcttgtaatacctattctcctcatgacacctatacttactctcttaattttatttactctcatagtctaaaactgtcagtcatatactgataactttcaaatcagtgtcttgagccaaaaatattgcctgatctttagacgtccatgtttaaaaatcatctggatgtttaactctggttgtcccagaggcatatcaatttaacatgtctaaaagtgaatttatgacttcctttaactttccaaacttgctccttgttatgtattctttaaaaaccaactaataatcaatttttgcccattttgtctcttaaaatatttctcaaatgtggcccacatctcccttatgaccactgcttaactcaggtccttatcatctccattcttttacgataaccttgtctcactccttgtgccaactttgccgttacccttctcttttccaacagtcatattcttaaaatacacatctgaccacactattcctctatttatgaagcccttcaaaaattttctaagaagtgcagaaaaagttccaagctcatttgtgtgatattaaaggcccgccacaatgtttcctatttaccttttcaatctcatccttacgctaaatcgctttgaactgcttctaggtaccaggacgcagaaaagttttagaaatgtatcattgtattcatgatattctctgttcctgcaaaactcttctgatctttcagtggctaattcctcctttgtcaagattcaggtttagaatcaagaaggctttttaactccaggctataatgtgtgtcttctagaattttctagaatgtgtagtgttttttgaccccatgagcacaccataatacatttatttattagtttattcaatcaatgaaatatttttgagtgcctactatgtctaggaaactgccctattcagaatagaggcaaaatcattttcttatacattgtgctattaaggacaggaagacaaagttaaatcaatcactacacaaatgtttaatttatgataattgtgataaatgctatcaagttggattaaaaggtggcatcagagtatataacaagacagatgtagcttagtctaggtggtccaagagggctcagtcatggaattaatactttcagtgcaaaatatggaagagatagagtgtatattttttaattagaaggaaaaatatgtacaaaagccctgaggtgggaagaagaataacatgtttgaggaacaaaaagaaggtcattgaggctggagagcagagaggtggcagaaaaagcagcatgacatgacacattgatgtttttatattaaactgtttctccacaaatagactataaacttttaagggcaggactggtttgactgatgttttaattactcatacctattcgaattaattctggtcaatttaagtagaaggcttaagttggaaggatgttaagtcagaaatgtgcgaatgtcaataagtgggcaggccacaagtagatccaggtatctaaaaggcagtctcatcaaacttatccaaagaggaaaaatgtaactcctcaaaagttattaggttgctgttggaaagaaaataggagggtaggccaccaaaatcagcaaatgttcacatcatttatcatggtcctaggcacatattaggaatacaatgaatgttttatggattgaactgtactcctgtggctccttacacacctttaatgcactacattgtgattattttgggtctgtctctttttgaaagaaaggactgtgtctgattgcactttttattcccaatacctagcccagtgcctggcacctccttgttgctcaataaatgctttgtgagggaatgggaagtgactgtatgcccatgtgcacatctgttaaatagttctgtagtcttgactgtgaatctgggctcttcatcgccacatcaccttgcttcctcccatccccatcattgaatagagtgccgaattcacagtgaaagtttatagcatgaatgaatggcaaaaatggttgttattatacaaagctgcttttacattcaaacattcaaatgcctaagtaaaatattttttcacaatatttcatcagcttttagtaactatttaattctcaatttttcaactgtaagcctctaacaaatcatgtaagtgccttacttaaaagaaattgccatgaggaattatgcataatttgtttcttcatagaatttacttcttggcatttgatatagtttgtctctgtgtccccacccaaatctcatgttaagttgtgatccagagtgtttgaggtgaggcctggtgggaggtgattgaatcatgggggtggtttctaatgttttagcaccatccctcaagtgctgtctcatgacaaagttctcatgagacctggttgtttgaaagtgtgtagcacctcccccttcgctctctctctctcatgctggccaagtgaagatgcacttgctacccctttgccttctgccgtgattgtaagtttcccgaggcctcctcagccatgcctcctgtgcagcctatggaactgtgagtcaattaaacctctcttctttataaattacccagtatcaggtagtgctttatagcagtgtgagaacagactaatacagtattcttgctaccaattctaaatatcccaaggggaaaaagcttaattgtttctgactaatcctagaatgattatactataaagactcatgctatgtatgctatactccctcatttcattgtgtgtttatacacacacacacacacacacatttgcttttccacatacagggattgtgactgagcagcagaagagaaaacgggctctccaaaacaagtcctttcaacaaagtgagttagaaggctgaaactacaaattcaacctgaatttgatttcaatttatttggtaacacaaaaagcccttttccttcttacaatctctgtaactctatttagatagtttctcctcttgaggactcagttgctgtgctttgaactggtttcaaatcctggtttctccattaattatgtgacttgcttcttttattgcctgtaaatggaggctgataataaccactcaatagttttgttgagattaaatagaatataacatgttaaaatgcttagcacagtcctgatacaaactaagtacttattaaatagttactggattattactattattatttgttgcttatttcatgtatataactaaaatgcacaaacatttttaaacatgaaattactacacaggtatactaatacttaattctgcttttctgcataaacataatttttagtatttagatagttaaaataactacatttatctaggtgatctctaaggtatctctgcattctactatcaacatttcataattctaaatttattgagaatagaaaccgttattattataacttaacctgatatatacattctctctgtctctctctctatgtgtttgtgtgtgtgtgtgtgtatatatataaaacataatggcaaataccacaattacttttgcaccaacctaatatgtgtgtgtatgtgtatgtataatacatgtactattaaatgacacatttgtaagttgtaagttgcattttcaaggtgaactcactagaagcctggatttttatcctacccttctgttatattagcatgtttcaataaagataagaccttagatgttcagtttttagaaataacacaaaggtgaaaaaaggaacacataacaacatgtgaatttcaaagagagagtggatttgtagcaattgtattagagaggctaaataccagaacggattgaggcttgaaaataacataccattaaacatatacataaaatagcttttagattctctaggagcaaaaagaagaagggcattcccagttgctttgttacaatgccagaatattagattaaaaacaaaaacaaacaaaaaaggcagaggttgttgactcatatttctttcacagttttctacaagagaaattctcctccaagtgaggatgaaatgtaaatattgttaaagaagacttgaatctaagttcagtaataaaataggagagcttgttatttagccttctaggctcaggaagcactttgggaggccaaggccagaggatcacgaggtcaagagattgaggccatcctggccaacacggtgaaaccccgtctctactaaaaatacaaaaattagctgggtgtggtggtgggtgcctgtagttccagctactcgggaggctgaggcaggagaatcgcttgaacctgggaggcagaagttgcagtgagccgagatcacgccactgcactccagcctggtgacagagcaagaatccatctcaaaaaaaaaaaaaatgtgtaaaaccaagcaattaaagaatagcaattataatcaacaagctattgatggcaacctataaagatacaggtgaaataaatgagctgcaagtaatcatgatgtttatgaacaagaaaacctcagagtttagaaactatgaactgttaatttcacctgaatttgaagcaaaatctattacagacatctcagtaacctaaaatgtcatttcctagaaacaagagtaggctcattaaaagcaaatcacttcctcacaactttatttctacacttttattagattattctattaattgatcaaagtcatgctgaaaccacatatatatcagtaagatatttggaaaatatctcctgatagctctatatttactgtggagaataattgggttataatattaatatattcaggcaatttctatttatatttatatgtattttattttatatatatatttgagataaggtctcactctgttgcccaggctggagtgcagtggcctgatcatggctcactgcagcctccacttcctgggctcattccatccttccacctcagtctcccaagtagctgggactacaggcacacaccaccatgaccagctaatgttttgtggtttttgtagatataaggttttaccatgttggccaggctggtcttgaacttctgagctcaagcaatctgcccgcctcggcctcccaaactgctgagattataggcacgagccactgcacccagccttattcataatttttaaactaactatccctgtagattagtggatacatgggcacctggagtaaactatcttagtggtttgcttcttctgtctcaatatttgcatccttatatttgtttgatattttttattgacgactttaagtgaagtgttgttaatgcccccaaactgaaaagatatatgtaggcattgaatggcaggatcaaagctgaggagatcctgacaagccatttagataggttgaaacccttcaagattagctctatcagggaagaatgtaagatcttgtttttaactagttaaagtcgactgcatacagaagaaaggaaaagggtttttgtgaatcaaatccatggatttaaaaaagcaataggctgtgtgtgcctaatgtgtttggcagctgatacagtccttcatgacattaagagagctatgacacaccctcatcaggaatgtagtgctcagttctaaggatcagcttttaagagtcatcaactgctataagtaacaaggatgtgggcagaagctccaggcaggtagattttagcttagaatagaaaataattttctaattgttatttcatttttttatgagaggttgtttcaaaagtccttaattcactcccttttatttaaactgtgtaagctgttattgaaagtctgttaagacacacagaaaggatccttgctttgagtacgagtttggagtagatgttctttatgttcttccacacaattctaaacttgtatactctatttgtccataatattgcaacatttacttttcaatttatataagtattgatcttcttttctatggttgctgttaagcagaaggaatatttccactaggatgagaaatatgaacttgttactggcctattttgaattcctttcctatgttatcatctttgattgttccatataattttgattgaaagtgtcatagaggtaatctgcaaatggtactgctcaaaccagcttcctgttagagatgtctcattttgtagcttttggagtataagtgggttttgggttgttgttgttgttgttgttctttgtttttgagacagatctcactctgtctcctaggctagaatgcagtggtatgatcatggctcactgcagccttgacctccccgactcaggtaattctctaacctcagcctcctaagtagctgggactctaggcgtgtgccatgatgcccagctagttttttgtgtatttgtagagctaagatctcattattttgcccaagctggtcttgaactcccaggcttaagtgatcctcccaccttggcctcccaaagtactgagattacaggtgtgagccaccactcctggcacaaggggtttttggttacgtagacgaattgtatagtggtgaaatctaagattttagtgcatttgacatctaagtagtgtatattgtacccaatatgtagtttttaatccttcacccccctcaccctctcccaattctgagtctccaaagtccattatttcactctgtatgtctttgtgtacccatagcttatctccaattataaatgagaacatacaatattagttttattcattcctgaattacttcattcagaataatggcctctagctccatccaagttgctgcaaaagacattatttcattctttttatagctgagtagtattccatggtgtatagataccacattttcttcatccactcattagttgatgggcacttaggttggtaccatatctttgcaattgtgaattttgcaacaataaacatatgcatgtgggtgctttttgatatattcacttcttttcctttgggtagatacccagtagtgagattgctagatcaaatagtaaatctacttttagtcctttgagaatactccatactgttttccttaaaggttgcactagtttacatccccaccagcagtttttaagcattcccttctcaccacatccataccaacatttattgttttttgactttttaatagtggtcattcttgcaggagtaaggtgtatctcattgtggttttaatttgcatttccctgatgattagtgatattgagcattttcttcatacatttattggccatcggtatatcttcttttgagagctgcctattcatgtcatttgcccactttttaatgggattatttattttttttcttgcagatttgtttgagttgcttgtagattctggatattggtcctttgttggatgcatagtttgcaaatattttctcccatttcatgggttttctgtttattccaatgattattattttgccatgtacaagctttttggtttaaataaatcccatttatatatttttgtttttgttgcatttgcttttgaggtcttagtcatgaattctttgcctaggccaatgtcttacagagtttttcctaggttatcttatagaatttttatggcttcaggtcttagatttaagactctgatccatcttgacttgatttttatatatagtgagaggtagggacccagttttctctacatgtggcttgccagttttcctagcaccatttattgaatagggtgtcttgtccctagtttatgtttttgtatgctttgtcaaagattatttagttgtaagtaactggctttatttctgggttctctattctgttccattggtctaggtgtctacttttataccagtaccatgttgttttggtagctatagccttgtagaataattttaattcctgtaatgcgatacgtccagatttgttcattttgcataggattgctttgctcttcaggctcctttttggttccatttgaattttagggttgttgttttctaattctgtgaaaaatgatgttgatatctttataggaattgcattggatgtgttttaatctaagtttcttcacaattttaaaaaatggaatatgtcatcgacattagatatggacttcttatgaagcacttctcttactaaaaattgttccaggcctggcgtggtagctcacgcctgtaatcccagcattttgggaggccaaggtgggtggatcacctgaggtcaggagtttgagaccagcctggccaacatggtaaaactctatctctactaaaaatacaaaaattagccagttgtggcggcagctgcctgtactcccagctacttgggaggctaaggcaggaaaattgctggaacccgggaggcggaggttgcagtgaactgaggtcatgccattgactccagtctaggatgacaacagagagactctgtctcaaaaaaaaaaaaaaaaaaaaaattgtcccaaatgtagccactttcggtatataaactgtatgagctaagaaaatgcaatcaaaaaagtttaaaaataagaaaagaaaagcaaaaaaattatcatagtagaccaaaggggtcatataacatacgtccgtatgttctttcatgtgttaatatagttgccctttacccagcaacaaaatgtcatcatgtttgcttccttctccaaattcataacctctgtttattctgcttttggcagctttatagtgcttaaagtttaatttataatgtatttatctacattcctttgatctaatatgtggttatttcgtatatgtgtttgtatcccatttttccaactattttttgaacttctggtaatctgggtcagtcatactttttccttttccgtgtatgtagctccttctcttccacttatctgtcagtatatgttgtatttaacacatcttactcacgttgaattgtgataattgaattatgtagttgtattcactgaagaaggttttctggaatagaatagaaagtatgactcctttttttactctacttatttggtaaaatttcaattaacattaaagaagaataaatacttcttgatctttgttcaatgaagttcaaggatgtattatttcatgtcacagataaatatgaaaaatgagtgacttaaagtctctggaatgcagagactagaaaaggatttggatggaagtactttatctgggatggaatttcagaaagcaagaataagtgagagaaggagtaaataaaagactcattatcaaggtcattgctgtgaaatgaaggcttgactgtgttgggacctcctaagatgcatctagcctaccttgctggggctgcccactgaaaacaggaggctgaagttttcactcactggcttcagtcctctagtggttgtgaactgtcccccaagagcattaacttcacctgcatttgattcttctagggtcagagaatgccctagggagaaagaggaaagatgcatgtggcatgaggttgaggtggaatgaagtaaacaagagcctattagtcctctgctacaatagcagaattgtaatgccttataccttggtctggaatgttgtgttcagttctgtgcaccagcttttgagaggtggcatcaagtcatgagacaaacaggaaaacatggtactgaaaccaagtcacattaaaaggtaccagggaagctggaggtattagctttaagagaagaacagaaaatgagatatgttcggtcaactagagatgattgtgagcctttctggatgcagggcatctgaaacatctgctacaataagaatccttaaaaaacttgaacaacaatatttgtttaaaaactttctccttaaccttaaaaaatatgtaagcaactgcaaacaatgagccaccagaaaaatttttaaaaaattgactattaaaacataatggccaaacattagaaaagcaaaagagcacacaactcagcatttttgccagttcactactcacagagttatatttagatgaatgcaaaatgcatttggtcaaccacttcgtattcaaattcatgtgtgtggaagtaaatttgatccatctgtgtctggattattttcttaaaccaccaaaattttattttacaagaacagatttccaaagagtcttgtgataccctcaacttcctgccaagcctcctcaaaaggtctgaaatatggttattatatactgaactcaaaatacttatttaaaaactttaataagcaaaataacaagcaaaaggatatctgatttatctgccgtaatgttatttatgttgaaatcgagcatagaacatgaaaaaaataggagaaagctctataaagtatctatttttttccacatatatgcccagacatggtatgatacaaatgatctacctaaacagcacgccatgtgtaagcagtttacacatgtgccactcatgtaaatgtggagtagctgatccgggacaacttcatgcctaccctgaagagtatgctgacgtaagttgtataggttaccatgaggtttcccctcgaatccttggtttctcttgtgtctttttacaggcctcttccctgcagtctattccttatttgttgctattactcagagttgctaccttggccctctgcttctctagtcctccaccgtcttcctgggcattctcatcctctctcatggctttattgaccccctaggtgctgaagactcctaaatctgtgtcttcagctccgctttcactactgagagtgactatatctgaattctacccacttggataatcagtaagcaccacaatatgaacaattccatgaactcaaaatctaagccagaaactgcatgtaatgtttgactcacttttcctgtcacctgttcccccaccctcacctatgtcgagtcattgtgcaagtcgagtccattctttctcttaagcatctctctcacctggttccaccttcatcatccatcacctgaataactgcaatgtcttcctaactgagctacctgtatccaggatggactcctccaattcattctccacataactgtcagaatgatctttctacgaaagaaatctggtcatgcctctttctgcttaaaacccttcattggttttccatcacttttggaataaactacaaacttcatacagtttcaaatccctgaatcatctagtcttactaaatcttcaaccccttctctctgaactcacccctggcattctatagtccaaatatttgagctttttctaatttctaaaaaacgtcatgctctctcacacctcagggagattcccacaagctgtttcatctgatgaaaatcttttctcatctccagtcttaccccacccaacttccttgcccactcacctttgctggccatctcagcagcaagcttataaagatttatttcctttaaggaaaaaaatgataagatagatgcccctgatatatgcttctcgcacactcggtgcttcgtctgttgcagcacttatttatcatactgtactgtggttgctttttaatcatctgtctttttcaatagagtttaaactccccaggagggtgggaacttagttcctaaaaggatgcatagcacagagtatatatgcaataaattattgttaaaatattgggcacattttgatccatagtgacagacaaccttacatataagacacagattatcataggcgttaatctacaaactgcatttaaatgtgtttttattctatttttctcttttatcaccattatgagaaaaaaatggttagtttaaggcttatacaaagataaagttccttttccttcatctttctgtctctctatctatagatatatgtatattctgttttcctatctgaacttggtgccaaacatattgagctggtatcttgttacatgtctgtcctttcacagttcttccatatagctactagaaataatcactacagtttagaacacactgtgcaaccctcaagtaaattacatttgagacaagaaaactgagaaactgcatgaaggttaagattttcgggataggtaaaaatagcaagagctgaaaacagaatccaattacacaggtatttaatccttcaatctttaaaactcaataaataaagcattgctttttttgaggcatgttatttaggatgaaaagtgaatgtttatttcagatgatcaagtgacaaaaactaacttctatatttttcaagtcgataaaaacttatagaaagtgaaataggattttaaggatatttttccattgacctctctttctgttagtaacaaaaaaaaaaaaacttccattgatgataggatgccttcagttgattaagccatgaaaagattaccactttgtttataatcatccatatgtatttaatgtgtacagtaacatcttgtgattttaagaataaattttccatctataactaaaaaataaaagttttcctcttgttatacagagttctagttaaagagaatgttgctttattttatgttatttttataatggttggtttactcataatagtgatactcagatacaattattttgaaatttgcaatggttatatctacacagttcaaaatgcaaaagggtttggaaaaaataaatgattcatccatgcaagatataaaatagcatagctataaaataagaatatgacttaaatgagcaattctgtgatttggcaatttgatcaaagtagaaaagcttcaaaattatcaaatatccaatcatatttgtctttataagaatacaatgaaacctaattttattttaccttttactgtatatatatttaaaatatacaacatgatgttttgatatacttaccttaatatacatatgcatagtgaagtgtttactacaatcaagcaaattaacaaaccaagtatctcatatagttacttttttctttctctcccctcctacatttccttccttccttccttccttccttccttccttccttccttccttcttccttcctttcctcctttatttcatggtaagagtacctaaaatctactctcttagcaaagtaccagtgtgaatacattattaactatagacctcctgttgtacattagttctctagatttacttaacctacataatgcaactttgtactttgacctatatcatcccattccccctgcccttaccccatccctagtaaccactgttccactctctgtgaaacccaatattaaacatagctttgcttcagtttttatacatgaatgataatccccaaattagtcatagaaattattaactagcaattcaaaggcgaagtggctcatgcctgtaatcccagcactttgggaggccgaggcaggcagatcacaaggtcaagagatcgagaccttcctggccaacatggtgaaacctcgtctctactcaaaaaaaaaaaaaaaaatactaaaagtagcctgacgtggtggcatgcgcctgtgatcccagctactcgggaggctgaggcaggagaatcacttgaacccaggaggtggaggttgcagtgagccgagattgcgccactgcattccagcctggcaacagagcgagtctctgtctcaagaaaaaaaaaaaaaagaaagaaatacgttgataataattttaagttggacaatcatggcaagtaattaaatgtacaatatataaagaaatattttacaagtttacctttatattccaatatcttctctagaaatgaaaatctgttacatgtgctctggctgactaatgcaagttacaaagcagatttagtaagtcactgtcaatgttagcgacctatgtggaaaaaaaaagaaaacgtttctgtgaagtaaaaagagaactaaatatttcaaatagtggtaagcagctaattctattctaattccagtgcctctcagaaccatctttaaagtgaatgctctcaaaatttcctgtcatcatcattcaaattgttaacgtttgaataattttctcatgctcacctcaattatttcccctacttctacttgtaaggaaattggtcataagactttatttggagactctgatgagaatacttttgtgatatcttatgtagaaaaatgaaatattagtgttttaaaatgactaacacctaaattattcaaatcctatttaaaggaatctatagatcaaaatgacataaaaatatattattggaaaaggattaaatgcacattgaataattacatcattagttttccaacattgcctaaaacatctaataattatttctaatctgtaaaagttatgttaaaagtatgtttacaatcagttctctactcaaaagaagatacacttttttaaaaaactagaattactggaataaatattgctgtttaaactgatgtcatccccaaagaaaacccatccattaagtgaaccaacttatttttctggagcaaattggcaaattcaaactccaagaaggcagaaaaaattgtaccagtgattgaaaaatcactactgataagatgatgcaatagttctttggctctcatataaaatggttgtgtggtaggataaaatatgtcttataagagaaactaagttcataaaaattgagaatactaatgaaaagcagactcttgaggtttcaaataatctgctttttctgctcttcttttactgtgcttggaagtggcagcagaaattatgaaatataagcagaaaggtagtttggaagatttccaacctgaatcatgagataattactagttgagagttctttttgaataaatcaacataatccatcttgtgttttctttgtcatttctaccactatttccacagagaatatcttataccaggttcttattggcatcccctaaaatgagccattttagggggttcagagagataaaaatctattaagtaatgaggttgtgttcccactttcatcatttaaaatggaaagctataaataatattgaaagaaaaatacagctgtgtgaatcttggcacaacagggtaaaactattcttaccattttcttcttttctccacattcccctttccagtgcatataactttattattctggtggtttcagtttgggccccagttttgactaactctaagaactcaaagaaaaacacaactgaaaccactacctagtggcttaacgtgaagccccaaatgataggccttcaacggagcccagcaaagggcttataagcacagctcattttggaaaggggagagtttgataagtcaggaagacaggcttcactatagctggcttaggagattttcatagccctattacatttagccttactaaaaagaaattataattctaatcctctgctatacgtaagaaatacatgatagatttctctggcactttgaacagattgattttatgctagaatgctaataacacaaggaaatggcaaatatacatgcaaaatgaaattgagctgtgcataacaatttctttcatttctctttgatttattcccattcaattctgaaggctcatgggtcaatgattgtattgaattagtagatctaaagccttctatggaattttttgtttttgtcccctccttatattgttcaactgtagatgacctagtcaatagttgtaatccaaaggtcgctgtaaagaaagagattctaccttcaaacatgttagatacagtctactgccctaccaccctgaaagcgccccatctcatttgatcttggaagctaagcagtgttgagcctggtgagtagttggatgggaaacatgttggatacaaaaatggagaatctgctgaaatgtgataattgagatttcactgttgttttcagagatctgatggtaaattcctttggagactgtcaaagatagcaccgatgtccttatgattaaatctctgaggcaggccaggcatggaggctcacgcctgtaatcccagaactttaggaggctgaggcaggcggatcacctgaggtcatgagttcgacaccaatctggccaacatggtgaaaccccatctctactaatacaaaagtgagctgggtgtggtggcgggtgcctgtagtcccagctacttaggaggcagaggcaggagaatcacttgagcctgggaagtggaggttgccatgagccaagatcatgccaccactgcactccagtctgggtaacagaatgagattccatctcaaaaaaaaaaaaaaaaaaatctctctagggcacctcaaaaagaggaacataaattgtttttctccgttgctacttctctacacaattatttttttcccacaaaatagtgcaggaaaagattataaacaaaagctaatgaaaatatactaaggttttgaatagtgtcccagtttgcagccttggctgaatataatcccttggctgcaaactgggatactattcaacttattacacagaggggtggaacatcaaactgagagatatgctaagcattctttcaggccccaaaacatgcaggggtttaccttttcctctgtgaggcaaaataggaaactgatcatgtattccaataataaattgtgctaggaaagtcccaattttagttttaatacaattcagtttacctctgatttgtatattttctaggcctttcaactaatggtctgtggtctttgtattttttaaatttacgttctgttttcaagagatttccatattatttattcacttacccagtatagcttcagaaactctcaaatgtcttaaggcagagacaaattgcatgttttaattccctgaagtcttcaattttatcactctagtattacacaattgccaaaatatcttgtggattttctgttctcctgtagtggggctctgccagaggccaaatttgaatagtgagcctctagttctgaatgtctctgctctctgtagttttctttgctttgtcaggtcttgctgtcttttataatttatcctatttttatagttctgttaaacaatatcattggcctgctgtaaaccgatccatactacttcaagcaaaactgcaaaatttaatatcaaggcaagttttttgtttgtttactttcctagttttatatagattatcccctatagtttctactcagttttctagtaactattctcctctcacagccaggctgtcagtggctgtgtctctgatgctaatgcttgatttcatagaagtttatcttcaccatctgtttataccaccttgctatcttgtaccgttctttaaaaagcctaattttggtctttaggactaaattatctctcagaactccactccatctgctgactttatttcagtttggtcttttggatacaaaagtgctgcctctgcagcccactctccaccctccaagcctctgcttgtgtattctgttcatgtgttaattctgaacagcatgtcaggactacctgctcagatgccagccttacctggttctctgatcatagtgtcacactgtagcaataagtcatccactgatttcacagccttgcctatttatttgattcttccagatcctagccaaattaaacactaatcttacctcagtcatatctgttcacctgtcatccacaagccaatacttaaacttcggcaaaaagcacagtataaaacacatgcaaaactgacaggaaatttcaagagaaaaacattttaatatagaagatttttccacttcatttattaatctcagtgtactctgcatacatttcctagagtatgagtctcagaacacattgtactacaatttcatccagatttttattacagcagtcaacattttctcttgagtaactttaaaaagagaatcaaacacatcctgccttcagacaaaaacaaaacaacagcagcagctgagcttctcatgatgcagcgagatacacaggctggatgtgaaaataacctatcctcacctgaatactttgaatttcatggaggaaattgatggagaaaggtgcggtattttgttttaagcactaactcaacagaagagtaaaagaagtggggaaagaatatatgcatgattgagacttttattctgcaatcttattagtgttttttgtgcaaaatatgttcttagtgcctcctgaaagatagaagaaaaacttaaatgctgaccagtgtttaaagtctgtggaattgtagccatcactctcttgttacagattaaaggaggtggagaggtaaagaatcagcctccagtaatggttaccatgagaggtgtaatactgtagttgaatgaatgacttttccagtgcaggcctatacagggagaagtgataatattcataaggcttagccatggtttttttctggtagctaaatattaccaccacatcagttacagtatttccattgatagacatttaaaaaaaacggtcacgaaataactttatcaccatacttcataaacttacatggcctctatttttcaatttaaacttcagtgtgaaaagatgtggaattttcacagctgtgctaggtgagtcccactgccttagaaaacaattagacaacacttcttaatcataaaatttactcacacattagagtgaacttgatattgacataatgacctctctatgtttattcccactgtttaaatacagttaaaccatttgttttttgatattagagtgtatatgagatgttttaggtttagtggagattgagagttaatattttacaaaacccttttttaaattgtgataatactggtgcgcatctgcaatcccagctactcaggaggctgaggcaggagaattgcttgaaccaggaggctgaggttgcagtgagccgctgagatcgcgccgttgcactccagcctgggcgacacagtgagactctgtctcaaaaaaaaaaaaatcatgataatacaatgattaatacttaatatttttgacaaaattattaagcatcaattctagattgatgatttttaaataatacatttgatagaagttaaaaggtatcaaataccgttgtatctaacaaaaatgctagcaatataaataaaaacttagcttttagtttttctttgtggctccaggtaattcaggaaatttctctaacctctttcctaggattagttttaagggatgggataaaagtaaatcatcagattaaaaaagtgtcaatggaatggtgagaaaaacacgtatcattgaacacaaatctagtctctgtcatggcaagaaaagaatattgggaaatctcaatttcctttctcctgttagagcagacatgcttggctctatcagctaatagttatttttagacaatgccaaaggaatgccttgataagtgaaataatcaagtttatttcttttgtgtgtcatatcatcccacacagcaatggtagttttgtgaaatttaattcgatttcggtgaattctacctaactaactggtttaggattgcccacaatcctacattctcctctgacactcacctgcttatgtatctcacattaatatgacaaaagtgaggccatcaccccaacacagcaggctgccacttcactgctcaacttgccctgttgtaaattaagaaaaagatattatccacttaatcttaggattagtatttgtgttttaaccttttgttgtaaaattaatcgaaatcacaaaacatacaatttttattaacatgtttgaatatttttagtaaaataaaatcataatttattgacagatgactaaaatagactgacttcctgtcagctcattagaatagctcccaaatgagtgagccaagaaaaaaaaatcgtatgtttgaattctaaacaaaatatggcaatatgtttcccttttaaaaagaaattttctgtttcttggtactcaccaaatattcagaataaggaggaaattgaagttattttggaaccaagaaaaacaggcttagtacacaaaacaaaagtgtatgtttttaaaagaaaggacttttatgttgataatttcatccgttcaagaaggatattagtatgaaaaacaaaccaattctgctcttagagtaggacaaaattagctttggaaacaattgtctgcagtttcctccatcttccattctgtttgaagatgtataatctagttgtggtgaaaaatgttttcagctaaagggtttatacaatgtacaaatatttgttttattcactttgagcgaatagttgatcttttatttttaaacactttggaatgtataaatataagttgatcttattcattgataaaataaaggtcattgtaactattgatctttttcgattgtctgaaaatggctgtattttgtcatttttgaatacaacttagtgggtagaaaaatagttttgtttacttccatgcctttgcctttgccatttgttattgcaggtgagatttttccacagttaataattgtcctttctagctctcattacccttaagatttctctttaaatgtgatgttataaacttttacttccatggtctgggcgtagagttattttcattaactttcttggcatctgttttatttataatatttatgtatctcttcacttataaaacattttctaacatttcttttatcctctcattctaaatctgctcttttatatgattttgcagatttttatttatttatttatttattttatttatttattcttttgagacagaattttgctcctgttgcctaggctggagtgcagtggtgtgatctcagctcaccacaacctccgcctcccaggttcaagtgattctcctgcctcagccttctgagtagctgggactacaggtgcctgccatcacgcccggctaattttatattttcctctgggattagtgctgggattacaggcgtgagccaccacccccggccagattctttaatctcttccttatgtctgtttacctttgtttcatgtattttatatctttatattttggtattggatttgggtaaatttctcagtaacatttttgatgtattaattttctcttaaattatttccaatcttgaatttttgttgtcataatttgtttcttttaacttttaatttggaaataaaagattcacagaaagttttaaacatagcctggagaggttccaggttcctttcactgagttttctgtaatggtaacatttatagtacaataacaaaaccatgaaattgacatgagtacaatgtgtgcttatagttttatggcattttatctcttatgtagatttgtatacctactatggcaatcaaatagaattattccatcaccacaaagatctccctcttgctactactttatatttatactcactccttcctcctctcactattcttgatccctggcaactactaatctcttctccatcttgaataacaaaatgtcattcaagaatgttatatgaattgaattacacagtatgtgaccttttgaaattggcttttttttttcactcaacataatgcccttgtgtatagttagattattttgatttttatccactgtgccaatgtgtgtgtgtaagtgtgtgtgtgtgtgtgtctttctttttgagacagttttgctctgtcacccaggctagaatgcagtggtatgatctcagctcactgcagcctctgcctcctgggttcaagtgactgtcctgcctcagcctccttggtagctggaattataggtgtgtgccaccacacctggctaattttcatatttttagtagagacagggtttcaccatgttggctaggctggtctcgaactcctgacctcaggtgatccacctgcgttggcctcccaaagtgctgggattacaggcatgagccaccacacctggcccagtgtgttttttaattggtttacttgggccatttatatttaatataattactgctatgttaggacttacatctaccattttagttttccagttgtcattttgtttttagtttctggttttttttttatctttgcctaggttacttgaacatttttataattccattttgatgtatctgtaacatttctgagtgtatctctttgtatggatttttagcaattgtgctattatgcatacatacttatcacagtttgctggtgccaacttttatcagagtatagaaacttccctctaagtgtctttacttccctctaagtctctttaccatctcttacttatatgattgtcttaaatattccctctatataggttgagaaccataattttttatctacttggcaaacataatgtagacaattcaagagaggtagcaaaatctatgatatttactcacatttttgctttttccattattcttcttttcttcctggtgttctaagactccttttttcaatcctttttcttctggttatagaggacttcctttgccattcatttagggtatatctgctagtgagggtatatctgctactggcaaattctcttggtttcctttgtctaatggtggataaagaaaaactttatttctctttcattcctaaaggatgattttactgaatattgaattctacagttgatagttcattttgttcagtacttgaagaccgttgtgctgcttccttctggcttcatgatttctcatgagaaattatgctttcttcttcatctctttgtaagtccaaaatatatgcattttagagacattttaaaactgctttgatgttttcaaattgctctgatgttttcatttcacctggaagaattcatcttccacttgctttttaagcagcattcctaaaaaagaattttcattttcttcttatgttttgaaattttaattttcaactccttgtgaatgggagttttctctcctttatgctcattcttccttgttaatgttcttgagtctttctttattcaatactatatacttgtcatctagaatgagatcctaattgggacatcaaggactcctgttttatgatgatactagaagtaaagcagaggcacttacctggcttgtggtggcttgttctaaaatgaccactttctcccgtctcgctagatacacagatgagtgcctttctcaacacagatgagagagccctgcttccacttccaggcagcaagtctggcctttgtctttcacacgaagtcagttctgctgagagattagaagttctagttgcctcagtcgacttctggatctaaagactttcaggccccatggtttccaacctgcttattgcattttgcttttcttgtatttatggtccttggagatgtttaactaatttttgactgtggctctatctttttagtcatctctttttgtatttagtctgccattgctattgcttttgagcagaagagtcttcaaagaatgaatttacaagactgtttttattggaagccctccaatttccactaaactgacttttttcctcacatttccaaaataggtgcctaaaatgaagattcaagtgaccctctgttatctaaattcatcaaaagtctgtatctttggggtttagtctaagaaattgagtctcttcttaccaaagcattctatatatgggtcagtgctctttagcagccaatatccagaataaatcattcctttccatggttttagttattgtctaaggctagtttctgtaaaattatatgtttgatttgaccttgcctaccgcttatttttaatttgtcttatacatattgtacttgaaatagatatcttctcaatctctagaaaccaacagagggaagtcatacatccttatttttcctctaagattccctttgagccacttaggcaatatttataagaatttgagtgtctgtagcatttgaacctagtacattgatttttaaaaatggaagtaatggattctgccttaaaaagtttgcaaactgaacacttaaaaattgttaaaagtatgtatttagcacctactatgagcaaataattgcactactattgtaatttggaatgcagagaagcagcaaacagatggtctggttttatgaaacataggcattaagataaatttatttgacaggttgttattgtgtgtcagctatgctattgtgctcagagatgtggaaaaatcaaacatagaggataatcctcattcttttgcaggttgcctggggagataaaaacactaatggacatgatatagggaatatggtgataagttctatgagacaggagtaaaggaagtgctgtgggtgttggttggggaagagatgagttccaattgagcataggagagacatgaattgggaaagatttcccagaggaaatgctgtttgaacagaactctgagggatagtagtatttggtatgagggcaggagttttctggatatggggaataaatgcacagaagcagcaagctgggggatatgtataatcaaacagatactagtggtattttattttatgctttgttccattatctccccacattcagtcagtaagtaaatcaaggtaaagtgctcccatcattatggacttatttgaaaattgtttaactccccattttttcctctaacacatttttacttgcatcagctttcaacaacttcaactaaactttgaaatattctctttgtaagctcactcttgcccttccttatacctctttaattggccctatataacacttttaaatgatattttcatgaccttgtttttagttacattgtctactttctaatcatgactctctgttgctcttcaaaatacacgcagaattctgacagtaagaacaaaaatgtactcttagggtgattttatttggatttagtgattttttatttttcaagtttttattaatgggcttaatttttttaaagagttttagatttacggaaaaattgaacgaagggcacattgagtcccatggagcaccttcttcacacacagtttccctattcttaatattctaagtcattactatttaattgttacaattaataacccaataatgatttttttaattaactgaaacccatagtttattgagatagttttataatgcctttttttctgttccagaatcccatttaggatacctcattacatttaattgtcatgtctccttaggctcctcttggctatgacagtctctcagacttttcttgtttttcatgaccttgacagttttgaagagtactagtcagcaatcttgtacaatgcccttgtattgggatttatctgatgtttttctcatgactagactaggcttaaggggtttgaggaggaagatcattgatataaagtctcgtcttcatagcatcatagcaagggatcaacatgatttatgacttgtgttgcccttggtcacctggcagaattaagtttcccaccataaagatactcattccctcctgctccttttccatactgcactctttggagggaagttatagtctgtacttaaggagtgggaaattgtgctctcattttttcatttttttattcctcaaaacaaacttatgagaaaatgaggaaggcagagtaagaattattatgcttcctctttcccatttcacacatgaggaaaactctgtaattcaggaattttacgtggcttaagtgtggtcacgacagacaaatggaagaaacagtattagatattatgtatgctctacagtgctttctccaagacagatttttctgccagcctcaaccatggctctttaggctttccttagcgttgtctctgcattctgcccgtttcttagtttttatagttctcattctattatagttcacttttccttattttttgacaatgttctttttgtttcctttgctcttacacttcatttttgtaggcatttaattttttattacaactagttttccaaaattgaatgagatctcattgacaaagacaaggagacgctgggtgtttgtagttcacgtgtgtatccacatgcattctcagtttgtcctgttcctttcatgaatttaaatatcttaagggcattctaactaatcaatactcaaaacagaaatttctgtttctatcttcatctttaatgatgacaatatttcttaaaatgttatacttagatgagttttacattttcctcccaaaccaagaaatttcttctttcagactaagtggtccttgagaaatggagaaatatagacaagatatggctggaatagctacaaaagcctctttcagaaaatttatagtttttgattatgggtaatctactaacacactgattttgttcaaccctactccaaaatagtattttttttttctggtttgatgagagagctaaacaatatttgaagacaggggtatattcttatgcttcatgtgggatccagtttcctaaagacttctgggactgccaacggggtcagaatttgaggccctgagggaaaaaaaaggagacattattaagaacattttgatgtttttgtttaaagagctggcaactatgatctgttattggcttccgttgtacctttgtctgagtcaatttgacctgaaaagttagttatttaattttcacttttcaatttcaagacaagaatataagactgaatttttttaatccttgccttcacgacataaataattgattttatcagcagaactcaacaacaacaacaacaacaacaacaaaacaaaccttttttcattgaaatatttaacagtgaggccctcataattgccttgggaaaacactgttttagtgggcattgtagtgagacagtagggaaagtaaaaatctgaatgatcagatcccattgtgtttctaaaacataaagttataggtcctgggttggattttgtaaactcctaatcaaaagcaaaatattaaggaaccccactggcatttaatcatccaatggatcacagtacattgttacagtggatcatatttgatatttaataataatgtgatagcaaaaaatagtgcacattgatagacaggattgttcaatttagtatatccatagctgcctgaaaatgccccacatacttacagtcattgcatcagacacttgtgattgccatactaaactgtctgtcctcccttatataaagaaagtacaatgtatcagaagtttccataactttttaacatttagtaagcaagatatcagattagaataaacaatggttccatatactattcccattctagctgtttagccagtttgttctcttactatatgaaatatcaacttcaggcatggttggatttatagagaaattctactacatatatgtatatatttgtgtgcatatatatgtatatccacatacatatgtatacactgcttttttgttgcaaaagtaatacatgcttgttataaaaagaaaagcagtacagatagggataaaacagaatgtgttattcaatcaccccaggataactacagttaacatattggtagtcttctatgcatatatatatcactttatctacatacatctatcctttattaaataaaaataccattcatttagttttgaaatatttttcacttatatagcatgtattttcatgtcaatacagatctacatcattgtctttaagcagatattatttgatgaacttctcattcagtttttggatcatggggttagtctttgagccttgggcctagcataaggatcaggaaagaggaactaggtgaagaagccaagaggcagaggccatacaatgtaggtgacgaggtaaaaaagaaacccagcccagaacatcttcctgctgtggaaggggcatgtgtaagcacctcttcctccatctcaccgttcctcacaacccttcatacacagcacaatcataagaagccacccaagcactgtcataagaaatatttgatggagcaattagttctttccagatacatatatagagaggatactgccttccttgtagtcatggtgattggactgagtgggaaaggagatttgatttgggtagtgacaaacttgaggaaatttgacaaaggctctcattaatggatagtggcagaggagaggaggttcctgacaccttaactgtgaggctgatgacacctaactttgttccaagagtcacttccctggtcccctttctggactgctgaaaggtgagaaatctgggatgtcaagaggaaagctttttctataccttttttgaaactttgggagaaggttatatcaaaaggaaaccacccacctctgtcctcctctccttcttagctgtaagttgtagtttttgtataaggcaattattaaatcatttttatccgtgttgttgaaaatgttaatatatatattacaagaaagaatattacatgcctaatacattctacctacttctcttacagaaatagatgacaagagggggcccaacacacaaggggaagtaagtttttaaaaatattttgtataaatgtgttcaaatcaattaaaaatgcaaaaatttgcttgatttgatgtgatataaataatgatacaactgtaataaaactttagattgctccttctgactgaataaacagtaatatagtgtcattaaaatctctgcctctcagttacctttattctctacctatgtaatgctaacccctgaaaaaacttttaaaataaaacatcacttttaatggcaaaatgtggtattgacaacttcaatttattgagtgattatatatgcacaccacaggctaagccaagtaatgctggaaccccagagcaaggagatggggttggagggatgacacctcttacagggtcttctggtatgtggagccaaaagtctgaggccagagtctagggggactgaagtctccaaagcctgagtaaacagatccaacgggttcacctagaaatgtactcagatttaaattcagcaggctgtctgaacactgtcactctctattccctccacatacatgtgtaggagtttatatagaaaatagaaaccaggagaggccaggagagcatataatatagaatatatgaaacacaaagtgaataaactagttcccagaaatgaaataaatattgaataggatgctgtgcagggttacctaatcaattcccttgatcgtaggtgtaggcaaacagcaatacttaaagagaaaaatgtagaatggacaaaatatcaaatagtatatcacaagacttttctgaaaattttgtgaaacagtaaaagtggaaaagctttcaaaactaaactcttacataaatataaattagtttttattagtaagtttacactgtgttactaaacaacaacaataaaaaaatttctgtagatttaattttctatttgatctttaaatatgtgtatggaagtaaatattaaaaatccctaaactgattcgttctcaaaaccagccagatgtgactgaaacagtagaagtgccccagaaatgtcaatcatccacatatttaacattaatgtagagtcaccctgtctacacctgtgcatagtatgtaggtatcacaaaactctattctggagaaatttgcttacactatttgctcatctgctatggatttggtaactgttttgttgaaaggtttagtttttaattgattgcttttgcatcagataaataacatctcgatgatacctttgagggcagttaatctttagcaagcacaaggaaagaggcctcaagctctatttacaactttgtaaaacagtttctagtttaaactttgtacattatgttcttgctaatgtgcatagcaagcctggaacaatcttcaaaaagtatgttgtaactatttacacttgagcttttcaaagcaaaaataattgccccagatgcaaaaactcattgattaagacccgtacacttgccacattaaaacataaatcaacatgctattaaaatggagtctttggcattttccgattgggggttagaccatgtaatttattaaatgaataatatgtatatccattatatagggctctgtatccttatctgtattttgaccctgaaataagttcttatttttgtcattttgaaatgcaaaatctcttcaataactttatcctgatccaataatgcttaggtaagagtgtcacataacagttttattaggaaaggacttatctttttttttaacatatgaagaatgttacctcaacattataattccaagtaaatggaggtaatagttgaacatgtcaattcaagagggttaaagattgctgttactttccaaggatcttcattgttcctcttgaatcactcaataaccccacgaacagatactattattccctggacatagcttttggaatatactttgtcatggaactcagactgtttttctctcaaatgaaaaggattggtgtctctttttctctttctttttaaaataaattaatgttattaggtgggaaagtaaaatgatttcaaggctgccatgaatgaagaattttatgattaagtagaccctacaactccatgtatctcttaagtctgtgatatcactaacatgtatataatttctcattaattagattctatttcatgacagggagaaatcagaaagcttttcataacatggcacagtatttatttccctcacaggtctgatggcatcgtactttgtatccaaatctaaggcttttacttttttctctttctccacagttacagaatgcatcccctaagcaaaggaagcagagtgtgtacacaccacccaccataaaaggtactgttcaggtactgtttcgggttgtcatgagtggtgaatcatggctggtcggccgtctgttctctaggaccacatatctgatgataagctagatctagtctcagctctacaacttaacagtgttatgttcagtaagatatcttatctacttaaaacttagtttcatcaagagtaaaatatggggttgaaaaagaaatagctagtgatctcagaatttcagtctagaaattcagtttccaaaataatgacaaagatttttttttaccgttattcgcatacttccttaaagagattttcccagaagccctaattactcttgccagtgttggcagatgattactgtttttctcttggctaaagcaaagcagaataacttgaatttcagggagactgaggatgaagtgttgcctcattgtattgtgtcaggagcagctctaagaaactcaatcaaaccagctattcactgtacatgtaactactgttgaaacaacaactaagaatctagttcagattctgaaattttccccagaattggaactgctaaaagaagacctgtcagtatcttgaccaacatcagttccagggaaagcatctcttatttctcacactgaaatgttcttgatttgaggtagagtctgtccagtctactctctcatgttttttccagtctggtgcttgggctgtgggcccagtggctgatcatactcaatttgtccagctcagtttcaactgcatgagaggccagctgagcagcttcctctggagtttggagagagggctaaattgggagtgaaatttcccactctgtatttgctctagatttggggcctattcagggaggcgggatataaatggacacattaatagctactttcagtagacttccttcctcatgcagctataaaacaccatgtttgcttgttcataagactgcagaacataatacaatcatcagcattgtagtttattccagggtaattattgagactactaggcatctctctctgaagataagtttaatcattttaaagatattttccccgttgtaagtgattttgtactttcaagacacatcagttttggcatgaatgggcaacaaggaaaaatatatgttcactcatttaatgatttcctctgctctattttaggttcacttaaactaaataaagtaatactgttctcatgtcctcagagaataatactattatttttaaaggaaaatcttaaaccgaaagtctcaagggccgatgatgttcattatatttagttctcaaatatcaaaagaatgtgggatcataacatttagagaagttagtcctgttacacatttttgcataaagccttatactctcaagtctccccgagatactcatttaatgataatcatttgtggtcataagttaatggcttgagaaagcacagtaattgtttcaagaggatatcagggtattactacaagtcacataggttctcatttataatcagaaatgatttggaagtcccctgcttatgataaaagaaaagagaaagctaaatgcaaatattttatttggtttacctgtccctaagagctagaaataaatattttaagacaaaatgaagcaatggtaacatatggcatcttgtgagcacatcaagaggcttcaattataaaaaagatgaaagaacaaaggaaatgttattaagatcttaaatataatgatacaattgctctgaaatgtataattcttcaaattgcagttgaatggaacatgcagttattgagtgtaaaaacatttgctgagggcaccatggtacatgcttatagtctcagctacttgggaggctgaggtaggaggatggcttgagcccaggagttggaggctatagggcattatgattatgcctgtgaatagccactgcatgccagcctgggcaatatagtgagacccagtctctaaaaaaaattctaaaaagaaaaaaagaatttgtactcacagatccttgttctacatcttgtcatttgtgaatttttaaatgacagatatctaaatatttcaagatatctattaggtctttgtctcatgctaaattttcttttttccaggttgaaatatcttgatgtcagttatacctgttatttagttattttgccttcattcttgatcttataataagctccactttgcctgtatcattctagaagtccatcattcaaaatgaatctaatggttaagatgtgttctgatcagaaacttgtggagacttcaattatgcctgaaacctccttcaacccagatactttaattctattaatgcaacccaaaatcttatcagctttttgtggcagcattacacattgttggcaaatagtgagctgactataaaatcaaaatgtccaagtattttacaggtacagctttccatattattcaccatgtattccccatactgatgtcttaaatttgtttatatcagaaactaatacagtactgtcatctcaattgaattgcctatgttggagacagattgttacatcggcatgttatattttgtatcctgactctattattcattctattttcagctatctcaattgtgtgtcatcatagataagataaacctattttgttatttttatctgatccataacaaatgtatgaaacaaaacacagctaaaagagagccctgcagcagcccatatatccccttctaattcacattgatccccttgtcaccatcattaaaccatttatcaaatagacttattatatcagggttccatcccttcatcagaggttatcatcagcactcctattagataaattgttgtatttcagatgccttgtgctaaccatgagtcataaatttatgatatatattgtgcataaaaatgacagaagttgaagtttgcatagaaaacagactttttcattatcttgtgtaatattgtgtttcatgattatgcacagaaagttcagattatcagaaaaatgacagctgatgactaatacccacgtacatttctctggtgtttatatggtggtcagccctgtaatttacagaacagccaattaaattattgttggactgcttgaatcatgttttcagaaaagtggatttggatgttaggacaggaaatggctgactcatttctatcccaattttgtgtgtgtgtctgtgtgtgtgtgtgtttgtgtgtgtgtgtgtgtgtgtgtgtgttttactggaatgcaaatgccttctactgaagaaagcaaagtaagtgctattgatttaaacggaaattggaacattaaacaaagcagctgacttaaaaatgactttgtagagcagggcctattagtattgcattaccattcttaatgcatagccagtcagatttttcatttacttctgtaaaacatctttttcctcccattcttcatgatttcttgtaaagacttcagtatctagatatttttcttctaagtcaaacagacttctgatatgtcaaaaatacctttgtatgcttacagcattttaacactgaagcttttttttttctccaaggatggctatgatcttgatttttttttcaaccccttctcataataaagaaataaatacaaatacagaataaatcagagagcaaatcaacctggacaaataagaaggctaacatggattttggagggtggaagatgaaagtggcaataatggcaagaataagacgtacttcagatcaccaaatgaaacatgatcttccaatcagggaaaactgctgatcatggtgatttcctggaactcaatatgaaaggacatggactttggcggacaagccatcacggttccaccctcaatgccaccacttattagctgtgcaaccttcagaaaatcaatgggttgttcaccccacaaaacaacaacaaagaaaaatatattcaaatatgctggatgtatttgggaagtagaaatgaagattatgacccaagacgcacagttaaggcaagccacatatgcatccgcagtgggaagggtaaagggaagttttattggcacagggggaagttcatgtaaggtacttggaaacagagtttattagtttcggacactcagagccagatttggcatcagttaattgccaatataattgaatggcaatttaattacattgctggacatacctgtccagtaatggctgcagatgccattactgaaccggtattcttttgagaacatcttatctgaattgcagtagtcctaaagaaagaatttcttgggaggttattttagcaagtccttgagacagtctttatctcagccatataacatgaactcctccttttggctttttgctttagtgtgtttgggcctgacaaaaaagtgatttcatcctagtatctgcaactttcacaggattagcctgtctcacttctctcatggggaaaatgaaagtgttgtttaccacatatgattgctgtagggactgaatgaaacaaaatgtgtaaagaaaatgcttagatcaggcacacaatatgtggaactattttgaataattatttgaaccctgaattgagagtggcgaatactcctcctccgtttctgcttcaccctgcagcatgaaggaatgattttgagagagacagaggagaggtgaaaggacttccaggagaataaaatagctttgttttcatcccagtgagacttgaaaagtcgggtttaagatgcctagatgtaaaatccatgtggattaccacgcttgcaacattcactccacttttgtttagcactaagcctcaggtcggcgtgtgaagtttatcttcaacattttgctttcttttaaacaaatgtggcttttccctcatttcacctagctccggtcctcagacatcatgtcctttattttccgactattataacattcctgtaagagatactgatatttcaattaataagccttgcagttcaaaaaagttgaaaaacaaaatgatagctgatgttgaattttggggtgctatagcagattatgcaataaatatttcttgccagagggatgagaaggaaatcatcacaccatataaatgcagcctacgcttaggcaacataggtaaattaaccatggctgtattggaatgtgaccagttcactcttcctgatttcaaatctccttaaaattatgactcaaaaaaactctcaaaaggaatagactgctgtaatatcctgttctcattacccgtcgcacattgaaaattgaaggcaggaagagaaggcagcaagatctcttagcctctcatcaggccatctccaccacactacattccttttataaacactcctgtccctctgtgggtgttcttcaggtattcatcacattttcctttctaaatcttggcttttttgtttgtgctggctcagtttgtttactgtgtagggtggggcatatttatgcagctcaagaaacattttgacagatttctagataacaaggaacattctaaatatatacaagtctcgctttcttttttttttttttaaacccaagtatgctcctatttccagacccacttcctctggttctctttaatttcttccactgagttttatgctcatctttcctcacatctttggatgtggagggtggagtcaggttggagaagcaatttgagaatgtacctttcttgcaagtcactaaggtatctttttttttttggaggtcaacattgagagagaatgaaggaagaggaaaataccagcaagtatgggtgaacttcatcttttatgacattgtcatggattattaggttaaaaggtttaaaagaccttgagataaatcaaattgaattgcaaatttaaaacagagtccagtaacttaattaatctcatgtgatgccacttaaacattggaaaagaagagcaccatttgtcaatatggttccattcatttgtctatatatatgttaacctattttaaaattaattaatcttttaaatttatatttctctgtataaataacataacagcttttaaaattgctttctatttgagaagcagggaaaaagataaacttttgcattgggtttgaatagctgaatcaagaatcagtttctttaaatatttcccaaataagcaaatagcaacattcaattgtgtaagtactaataacacactgccacaatcacatatgagcctttgccatgtgtggaatgctgcattaaagtggggtggatgcagaggtgaaaagcagagccctggccctgtgggagaccagtctggaggaagcaacatacaagtggatagagcatagcatggtaagtcctttaatagggatttagacaaagacatctggagatgggaggagactcgccacaggcttactggacaggagggtaaggccactttcagatcacagaagggacagtcatatttacatataagtctggagagtaaaatggactaggtcatggaaaagtggaatacgtggctcataccatgatcattcctcctgctcatgcacacttgtgaagcatttaagatgatgctgtaatgtgggcagttaaattctgcatggaccatcacaaagaactttgctgccatgcaaagactaaataggtctcattaatgggactatgtagataatatcactttccaaagcatttgaagcccttgttcatttgattccaatttaaaatttctgcttcacatctttgtctttcttcttaataatattacctttaaaacagaataaatcccaaccaaaattacatgttttaaagttagattttatattttagaacaggtttggatttgtagaaaaattctgaagatagtacagagagttttcatataccccatatccagttttccctattatttatgtctcatgttagtatggcacagttataattggtaaatcaatagttgtataaaacagttcttgcattgctataaagaaatacctgagactgggtaatttataaagaaaagaggtttaattggcttatagttccacaggctgtacaggaagcatgatgctagcacctgctcggcttctggggaggcctcagaaaacttgcagtcatggcagaaggtgaagggggagccagcactttccatggctggagtaggaggaagagagggaggagggggtgctacacactgttaaacaaccagatctcacaataactccctcacacactatcaggagaacagcactgagtgggtggtgctaacccattcatgaaggatccacccctatgatccaatcacctcccaccaagccccacctccaacactggggattacaattgtacatgagatttggatggggacacagatccatgccttatcaatatgtatacgttgttattaactaaagcccatattttcttggtatctatttagtttttttcctaatgtcttctcttctattctaggaatctatccagcataccacattatgtgtggtttcatgtctccttaggctcctctgggatgtgacaatttctcagacgtcccttgtttgtgatgaccttaaacgttttgaggaatactggttaggtattttctagaatatccctgtaccgggatttgactgatgtttttctcaggattatattgaggtagtggatttttggaagaaagacagcagagataaagtaacatttcatcccatgatacgaggggcacatactaccaatatggtttatcgctgttaattttgaccttgatcacctggctgaggtagtagttttggagattcttcactgtaaagttatcctttttttactccgtttccatactgtactctttggaaggaagtcactgtgtgtagtacccatttaaagagtgggaagctgcactctacttccttgaaggaaatgtcctgtacacacataaatcatttgaaattcttttgcacagatttgtttctcctcctccattgatttatctgttcatttattttcatcattatggacacatggatattcattttatactttggattataactcaatactatattacttactttgttgctcaaatagttcctgttttggcctttgggaactttttccattgactcctgtgtcccattgacatattccattaatgtcagggtgttggtttgttttagaatatctttactttctgggactacaagattctctaggctcattttatgtatttcttgtcccagtcctagaaccagccttttctccaaggagctctcaaatataatttgaattcctatttgagtcagtattctacaaaatatatgtgtgaataagcatgtggttgctaaaaatggagaaatctatctccttgcaaaaatgtgtgtacaccacgtccattaatgtaggcgctatcagtatgctaaggtgtacacactccactcatactaatgctaataggaatctcaggaagtaaaaacaattcctcattactagaataggcagatgccatttttatggacttgctctcctttgttttatgcctaatggagtgttccctgatgttttctgagatgagatttgtattatccctttataaatgtggaattaataatagactggcagccttcttgacgcttagctgtttgctttacttaaatcaaagattttaaaaaagatgtttataataccttacagttgtgtagtgtagtgcttcaacatatacaatgtgcttttgtataattatttggcttttatagaaaactatgaaaggtaactaaaatagtttattttggaggaaagtgtggattacagaggagcagggttcccatgttaagtgtccttcccctttacaaaactaagtcatgacctgagcctttttttagggtgtcctatgaagttttgttagaatagcaacgggcctcattttttccatttgcccatctatcctgtttgccctaactaaaatacagagaccatgcaaccttatagcttgatggaaaatttttacaagatctttttataccaatgtttttacaaaatgcttggtatctttgtttttaataattttaaactcgtgttattgatccttatgtaataacagttttgtactcaaaccaagcttgcctttaatcttgtctgtctccagcttctctccctctcccagacagctgaccacacaaatctgactgttttgttttagattccttcaagtgttcactaattcctttagagtaagtccctggaaatgatgtacaggtctctttatgaccttgcctcttcactcctgtcctgccttgcctccggccacagccttcttttttccatgctgcagcaatgctgagctgcattcagttctttgaaaataatacgtggtttctggcctctatgcttttgttctgcagtgttatttacatagaggcgtttcttcgtccgccttcctgccagttctaaatccttttagctgtgcttctttgagactgagaatgcattttatatacctatatatgtgatatctgtaattccttctagctagactgcggagcccttgagggcagggcccatgtcctatttgtcttccaggagcattctgatctgtcttctatttgaattttagaagactcctagtcaatggtgaatcagtgagtaaataatctttctgatttaaaaataagcatcattggcttaattttagccacattgaacaaaattataaattcattcactgactcacaccttcattctagactctaataaaatgcttgctgtctgtcttccaggtcatttattaggctcttttagttcaagataagctaatacagtccctgtttatatgaaaaatgttgtcaaatgaaaaagaaagttatttaaaaaattgtaacttgtaagttccctgagattgatatggacaatgacattagaacacagagaaggaaatagctggcacttcctgtcacagctagggaagactgtacagaagaaatgaatggcatctgtaagttgagggatgagtgagattttgctagagaaatatcaggggtagattccagaaagagggtttggcagacctgaaggcacagaatgtgaatgggcacgtgaactttgaacactgtggggtgggggcagaaactgtggaggagaaaacactgaacagatgcaggggacttgtcaaaggtctcctgtgtcctgtgcaaaaaagttgggattgtatcccgagacaatagagcacttttggataattttgaagattgcttgacacgttgccatatttcttgtgagtgctttgaagatttgggaccagggcaaaaggacaaagtagttaaaaattcttcttcttttttttttttttttttgagacggagtctcactctgtcgcccaggctggagtgcagtggcgcgatctcggctcactgcaagctctgcctcccgggttcacaccattcttctgcctcagcctcccaagtagctgggactacaggcgcccgccatcacgcccggctaattttttgtacttttagtagagacggggtttcaccatattagccaggatggtctccatctcctgacctcatgatccgcccgcctcagcctcccaaagtgctagggttacaggcgtgagacactgcgcccagccaaaaattcttctatgataagttgtatttgcctcagtttatctgcttgttcccagtgctcttatttctacaagaatggacaactgttagcaccaatctttctttttctttcatgcatttagactttctaagtagtagctatgactttgatatgccaaaatactcatcatattttcttccagaatagatcaattgaaatccttgtaaaatgtgttaaaatataaaaatgtcaagataaattgagaaattggttcttagtggggcaaacttaagattacattcttcacaaacttgtcctggtctataacattttccctcctaaaactttatattcttgcctgaacttcaaaaaggagcctgatctgcaagataattttaagaacagttttattaattcctttctcaataggctgtcatgacaaaatacccaacacctcagttgtggcagaactagatgcactctttctgttgagtgttttctgtgggacagtaaagataccagcaatgctgtcaaacagtatacaaatatttattaaacttgtactctgtgcaacattctgagatctgtgttactttaaacaaattaactaccaaattctaaacaccctaggtcagattttgaggaaggtttacagttttggatttttcattaagagaaaaaataccaagcaggataagaatgttcaaaggttagaatttcaggaaattgctatgtgcacaatataaaaattatgtgataagcattgaatttatgatctgtattctacattgcatcctttctggtataattaccaatgggagctatgttgtactttcattatccttggtaggtatactgaagctatcattttattcttttttatgtataaatttgtcacattttattttcaaaaccaaacttaaaatgattttaattgacttccaacaggcgatcttaggaaaagattctcccatgctttcatccatgtaatacccacaaggcaactcatttccaaatacagctaaagctagaattgttatagagcctctgagagcttgaaatggctatcatttgccttctgaatctgaggccatcagcagcctattactaaatatttaattcttaaaagccagttggtcctcttagaccatggcagtctaagaaccaatgaaaaggaagtaggaagtagaagtaaggcacaagatggctgcaggagatatgagagcaggctgcctgatgagcagaggcagaaacacataaaatttacacaccatcactgcgtaggacaaagatgatcaaaacaatgattcagtcactaagaaaataattacactatttctattgtaatgcatattttaaaaggcaggaaagtggtttgaatcccacttttcaaaagcatttttaaattcttgttgacaattaactctatgcactactctatgtccatttcaggttaaactatgaagtctgagcatctcacttcaaattttggagtttccttttgggtttcaattgataatcttgagatgataagctttgcctcaacttacagtacttctgtgaaaaaatatattttatgtatcaaaaattgtcactggatgataatgctcacattatgtaaaaataggtctcaaaacatatttttgtgtggcaaaaataaaaaaattaaagtagtttaaatgctttttttagtatatgcttataatgtattattttatctttaagttttacatttagtcccacagcttattatgttgatttttgccttgaaaaagtttactctgtgattgtaggaattagtctggatcttttagaacagttcttaatatctctaaagttatctataaatcaaggattttgaacttttttttttcttttctttttttttttttttttttttttttttttttttttttttttgagacggagtctcgctttgtctcctggctcactgcaagctctgcctcccaggttcacgccattctcctgcctcagcctcctgagtagctgggactacaggtgcccgctaccacgcccgactaattttttttttttgtatgaacttctataatagaaaaaagggaccaaaagagaaatcctctcctactgtctgttcatcttttttaaaaatgcaagcaagaagtacttgttcctgcctttgatgttattgaagaaataatatatgtaaaaatcaggagaatggagggaaagagcattggatctgtgatttcatacactgcactcatttatgctttaagtcctgatggttaatgaagtcaatcagaacccccccaccccaaacctcctaactctaccattattccttgatgtaattccctctttgtgcaataagttaattagtacttttacaataattttcttcaaaatacttttctattaatctttctcaattatgtatggctgtagtatcttgcttatgctattttcttcaacattttaatttttctactattaacaaacttaattggattttaaataacacatctgtaaatcctaccacgaagaaatatggaagagtgttgtttgccaaagattcttagcctatctgatgttgatccctgtatactcctttgtaccagtcttactcatcctaaactttgtaaaaataataatggaattagtttttctttgggcctttcttagaagatggtaggcagtgtcatttgattattattaattaattttttacagttacttgggcatacaaatgtgtcctagacataatgaaaacttctagtctaccttcaaatttttagaaaattactacgtgaatactcatttgtgtaaatgaaaacgaaaactctcttttatgacctcaaagaacctcaaagaatggcaaaataggtttcaagtttcagatatgtaaacattgctacattaaactgtttgttttaaagtaacataaaatgtcataaacttactttttttggattaagatacattttgtgagagctgaaccatgataaaaaggagaaacgcctgatcgtcttaatttttatgtgaatcgactttaattaacatataaatgttttgaaaaatatcacagggcctcactggcaatgtcaaagctttatttcattttattaagattaattaattgttgaatcaccacatgtcccatgttttacttataaggccaaaccaaagaattctttgcatctatatcagcatccttagcttttcagacaggcattttaatctcttctgatctctgagataaatatattttttcacgtaattatgtaattactcaatagaccagagcagatcccatggagccactgcagtgtgtgctgtataaataatgttctgttctacccctgataattggccagtagagcctcctaggagagtttttatcccttgaataaacactacataggcaaggagggttgactcagtattttcttcattggcaatgaaacagaagcacttcacactcagtgcttattagatcattttaaaaagaacacagtgcttatgaccctacagctccctctgctggttcacaaagtttaaaaagtacaagtagaaaataatgtttaagaagtggaacccttgccgggcgtggtggctcacgcctgtaatgccaaccctttgggaggccaaggaggacggcttgagatcaggagtttgagaccagtctggctaacatggtaaaacccctatctctacttgaaaatgcaaaaaaattagccgggtgtgtggcgcacacctgttgtcccagctactccggagtctgaggcaggagaatcgcttgagcccgggtggcagaggctgcagtgagctgagaccgtgccactgcactccagcctgggtgaaaagaacctgagccccttaggagaaaaatatgtcatttttggtatgaaatggggttaaactaagggaataagcaacagaaagtcttcttatttttatgattattaaattgtgagccaccttactcaccatctgtctttaatcatccaagcatatgtattcctgtcgtgtcttactttttgcagtaaaaagcaggctctagatagagtaggcaggtatttttttcaggacaaccgtaaccaaagtgagcttcatgagtctatcagccccacattaacagctctattccttcataaggcagattattattcataggggtccttaaggtacctttactccatatgaaggagtggcaaatgaaagatgtaaagaaatgaacatcttcttcagactgactagttaaaatcctatgtatctcatctttctgatattgataaccaccttcatttggtacgggaaaaaatagcagaaagaaggagaactggagtaggagaaacgtgggcttgaatcccagctctgacaattcaaatctgtgtcgtcttcttccagttatttaacctttatactctttcttgttcacatctataatttgaagataacctcagagagtcatgtgagtgaaaaataaagtaatatatgtatagtgcccaatatgtagcaggtgtgttttaattgtagtaaacactactcctgagaaatctgggtttctgccccaaccaacagaatgacacagagaatgtcaaagagaaatcatttcccttccaaacattctgaaagtatggccaggcaacatacagtcaatcatataaaatacatagtttttatttaaagaagttaatgtgatgtgacttttccatagttacacaatctgcaatcaaattctatttattttttgatatggagacaagatcagaaatatagttgactctacagaattgtaggttccagaaaccattaaatcaggctataaaagaagctatgtaaacactatattctgatgaagaggatttagataatgagttgtagaggttgtcatagattattacaaataaattcacgtctctgatagctctctattgctacttacatagcagatgtgtttattttagtatattaggttttgacaagacagtaaacaatggttttataatctaatagctagataaggaaaaatggtttgagcctaatgtcttacgtattctgaacaacagtttgccttcaggtaatgctgcgctgtgtcttgttccctatacacaggttaggtcattctttattatcaggtaataaaaaataatagaggaagtataagcagtggctaagtgcaaaaatctgaagcctgagaatctcagtttgaattctagttccatttaactgtctgaccttgagagagtgggttggatgcctcatctgtgcttcattttctttgcttctaaaatggaggtaataaaagtgtgcactttgtatcagttttcaaggactgccttaatagattcccacaaacttggtacttaacacaaaagaaatgtttcctctcacagttggtgaagctagatgtctaaaaaccaaggtatcagtagggccatgctcccactgaaggctgtagggaagattccttccttgcctcttccagtttctggtggccccaggtgttcttcagcaagtcctcaggtgtttctgggagtggaactcgtttctgtctcactcttcccgtggcctgctcttctgtgtctctgtgtgttgtttcctcttcttgtaagtacatcagttattggatttagaatattggctacttcatcctgtcgagcctcattttaattacatctgcaaaggccttattttcaaataaggtcacattctgatgttccaagtggacatgaatttttggaggacactattcaacccaatacatacctcactggttttgaggattaaataggttgctatacataaagcactagaacaatgcctgttgcagaagttttagttaaggtgacttctaaaatgccatgcatagttcaagccatttccagtttcacctaagttacagatttcccattgcatatcttctcgacagcacatcccccaatagtctgctctatcttaaacttaagccatctaaaactgcctttatgttcatccccaaacgaaaaccaggggatcctccaattcctgtaaatggtatcactatcccccatttgctcagattcaaagcctcaacatcatttataacgacttcgtcttctttgttgccataactaatcaaccttttggtcctgtagagtggatcttgagagaagttcacttgttatattctcatttctccttttccaggtcaggctttctttaacattcacccagataaaaagcagagtaataccgtaacacaatacatcacgtaatacacattcacacatatttcagatagaaacagaactatatttcctctaattcagactatatgtctatttaatgacaatgagaaatatgaaatatccagtaagttggccttatttagtggccctgcatacaagctgactcattgcagaaaaggagaagctttaaggggaaaaaaaaaggaaaatattaactgcttctaacccacaacatttaaataaagccattttaatatgcattgattatgttcagccattttatagctctggcctcagttttcttattggtaaaatatgaccttgagaaagttatttaaattccctaatcataaaggtacatactcataaggttttcgtaaaaatgaaatgaaaaaactgtatgtaaaatgcttcagcatagtactatgcccctcatccatggtcaagaaatactagtcattagatataattttagcatcatattgacataaactctttaaaactcttacacttatttggttgctacttcatttgatgattaacttcatttaaagcatatttccaggtttgattgcattttaacaagagagtgaggtttgtgctcagtgtgtgcagttgttgggaagaatttggtttctacatctttagctgctattgggcaaatggagaggtaagtagtatactctttctgagcatagtgccaactggtgtccatatttatacaaaagggggttaaagggaacgagaaaaagcacacagtaagcattcaacaaatagcggctatcagtattgtataattttttttcaagtttcagtttccgggtgaatacaaatgagtgccttaacctcttttcagtcttctttcaaagagaagattcaatacattgcagttgcagtagttatagaaagtagctaaacagagaagagtagaaaattgtgatagaaaatttgaaatccttatatttcttttgctagattaatcaacatatattcagcacctattgagtgttgattctgaaaagcattgatcagataaaagtgatcatttagtaaagcaaatgagagaaacttaattctaaaatacagctatcagagttaacttacaaatgaacttcgataacttctggatgcattttgtaaaaaaaaagtattgtgtcatattaaaatatgtcataataaaaactcctgcacttagcaggaattacattaactatgtctaatgtgtgcggttgaaaagccacttcaaccactcatcacgtacacctcatatcctgcctgcataaaaggctgtgcccatttcactatggatatagatttgtttatcctgcatattaccaattccgtatgtccacataaaaagtcataaatatcagggagaaaagcttcatgtgcagaaactttgtagttaatgggaaagcaaataccaagttctgactacatacctccctatgcctattttttttaaaaaaaggtcttttttattcctgaagcttaaagaaataaacaaaagctattactttgacaaagcagacaccaacataatgagatttgagcaggattctgtatttccctttatctaccactctgttttccataaggggacacaaagacattttttacacttaatcttgtgagctagttaggaattctcacttcacccatgcaaagaatagaaacaaactcataaagcaacagatgaatgcatgcatgtgaaattggaagtcatttgcatttaaagtgatagaacttaggtaaacagaggggatgcatttaggataatattttctttcaggactcaaagttctcaaaagaaaatatctcacctggttttcaagcaggtttcaaattatgtttgacaaacatgggacatcgtctctaaagcatgtgtgcacgtgtctggcataaaatcaagggtggaaagttaccctgaaggtcaaacggacaaggttttctgagtttctgcttggcctggtaagacagccttggtcatggaggaggcctgattctgaagactgggtcaattctgtcacttgcatttgtttactgccctgccttcgctggctctgcatctgagtcgcggaagaacatagactcaataagtactgaatatatgttgattattccagcaatagaaatataagaatttcaagattgatctattttaacaaaagcactgttaaacattgaagacctaagtaatattactagaggatctctctgatcaactataacatacaggcagaaagggcatcctttcctgtgttgccccagaccaccctttgacttggtcacagaaggattccagttagcaatgctttatggagcaaaaaggtacctgttgggaagctgcaacacttggtggagtctaataatacccagcgggagaccacggtacccggtgggatagaatcaacacagcccaactggaatacagatatttgggaacactgttagatatgtatactcagaaaagccttggaacatgaccagagcataatagattcttaaaggggccttaggtgagtcctagagtcaaaaagaagtttgaggtatttgtgatattagaatctcataaattctccaggctgctaaagtctagaagtcaagttacaaaagaaagattagattattgtcatactttcaattgtgtacaagtttttggtttcagtcttcaaaacaaagatttgaataattaggttgaaagtgaattttttcatatatatttatttttatttcaatagttttagaggtacaggtggtttttggttacacggatgaattgtatagtggtgaagtctgaaattgtgatgctgccatcatacaagtgctgtatattgtaactgatatgtagttttttagctctcacccctctctcatcctgcccatttctgagtctccaatgtctgttatacaactctgtggcataatgtatacccttgtggacctatagcttagctccctcttgtaatcaggaacatatggtatttggcttcccattcctgagtcacttcacttagaataatggcctccaactacatccaagttgttgcaaaggatattttttttcttttttaatgcctgagtagtattctacagtgtatatacaccacattttctttatccgatcattggttgatgggcacttagttttgttccatatctttgtaattgtgaattttgtgctgtgataaacacatgtgtacaggtgtctttttgctataatgacttcttttcctttgggtagataaccatcagtgagattgctagatcaaatgatagatctactattagttcttcgagaaatctccatactgttttccatagaggttgtactaattaaaatttccaccagcagtgtataagcgttctctttcaccacatccaaatcagcatctgttactttttaactttttaataattaccattctggctggggtgaggtcgtatttcattgtggttttaatctgcatttccctgattattagtgatgttgaacattttaaaatgtttgttggtcatttatgtatatcttctattgagagctatctattcatgtcatttgcctaatttttaatgggattatttgtgtttttttttattttatttgtttgaatttcttgcagagtcttgttactagtcctttgttggaagcacagtttgcaagtattttctcccattctgtgggttgtctgtttactctgataattatttctttttctgtgcaggagctttttagtttaattaggtcccgtttatttatttttgtttttgttgcatttgctttaagtgtcttagtcataaattctttgcctagccaatgtccagaagagtttttcctaggttttattttaagatttttatgatttcaactgttagatgtaagtctttaatccaatttgagttgatttttgtatgtggtgagagagaaggaccctgtttcattcttctacatgtggctatccagttttctcagcgccatttattaagtagggtgtcctttccccattttatgtttttgtatgcttcatttaagatcagctggctgtatttggttttatttctgggttacctattctgttttattggtctatgcatctacttttatgccaataccatgctgttttggttactatagccttgtagtataatttgaagttggctaatgtgatgccaccagatttgttcatcttacacagagttactttggctattcatttttgttcttattaatttaaggattgttttcttaattctgtgaaaaaatgatgttgatgttttgataggaattgcattgagtctatagattgctttgggtagtatggccatttcacaatattgattcttctaattcatgagcatgagatgtatttccatttgttcgtgtcacctataatttttttcaacagtattttatagttcttgtagagatcttttacctccttggttaagtatattcctaggtattttattttattttttggcagctattgttagagattaaattgttgatttaattctcagcttggtcattgttggtgtgctactgatttgtgtacattgcatcatatagtgatactgatttgtgtacattgattttgctgaattcatataaatctaggagtattttggatggatctttgggattttctaggtatataatcatatcattagcaaacagagattgtttgacttcctgttttccaatttgaatgccctttatttctttcccttatctaattgctctggctaggacttcctgaaggtaaaacttatttttttcttatctattttactttgcaagttttccctctgtacatccatctgtatacacataaacacacacactagtctctaaaaaagtaaaatgttatgaatattcatcctttaattgtagaaaatgtgtagttacaaatttttttctaaaatgtttatcaaaagtataagtagctttacccttcagcccccattcgagtatgaacgtgaatatgggtgccaaagatggtacttctagaagataattaaattctggttcaatttactttagacaaaatgggaaatgtcttatcttttgttgcctctagcttttcacactaaaaacaaaccctaaagaatttgctgcatgtaatgtttttgctgcctaaggcaactgtctgctctggctatacaacagaatctattctagttatatttgttgaagttcaaatatttgtagtttattttcaatgaagaaatgacactgcaacatgccacgggggaaacttgtaaaatggggcgggtgagcagggaacagataggaaagctaatcacataacacacatgtttgttctactttgccctccagaatatcttagttttctggtcaaatggaaatgtattgataaatccataagaaaacccctagatgggtcataaagtaaaaaattttaaatgatatcacaaaataacacagaagaaatatgtatactaatcagatattagatctggaaatataaatatatttacaaaatgtgtttaaaatataagtgcaaagttaagattttataaagaaaaaaacatgagaaacaggattatagataccaagaggaaaatattgcaatagctaaaacattattgaaagataaatgacagactagaaaagaagtagaaaaaaatgttatcatcattatatcaagagctgtcacaagttaagctgtcataagctaacactttaaaggaaagatgaataaaagttgtaaacaggcaatttatagaaaaatgattgtgttcccaaaataaaaaagttaaatctcatttataattgaaaaaatataaagcaaagcaatctaccaattttgaatttttctttaaaaggatcatacttaaactttgtaagagtgtgggaaaagatacactcatgcattgttacagaaatggaaatcgataccactttttcaagaaacagaaaaacaagtgacctcttgttataggattctgcatttatgaatctgttataaatgtgatgtgaggaaattgcataccagaaaacattaagtgaaaaaagctggattcataattacctgtatatttgtattatctgctgtatgatctcaattttatagagaaaacggaagaaaatacagcaaatatgcacaatagttaccagtatgagagactgttttacaccaagataggaacttaagaattaaaactataaggctctatatatgtacactatactaatgaatacatatatgtatccctgatatgaaacatataaattcattaattaacacagtaactgtctgtgtaagacctgctatatgattggtctgacagagatcttaaacttaacacgtccctgacagaaacccagattttcttctgtcccctaccagtatcttcactacaggggagaaaataccaaaaaaaaaaacaaaaacacttctttctctcagttaatggcctcttcatccttctagttgcacaggccaaacactttagtcttttttatatttctttttaactctcacatttcacatccaagctaccaggaaatcccactggctctaccctcaaaaaaatatacaattacttctcacaaagccagttgttatcattgttgtttgagctgtcgatagttttcacctggactactgcagtaacctctaaatgggccgtattgtacacctttgtacactgcagtttattcttaatacatcagagtgattctttatagtcctcgtaatgcctgcaaggcccaggagctgtagcctgtgacctgtctgacctcttgcctgccactctcccaccagcttgctctgcctgaagcacctggcttctttgttgttccttaaaaatgccagtcacccacttgcctttagggtctttgcacaactgctgaattctgttcctctactctatattttcccatgctgctttcatctttttaacaaattttatcatttacttattaatcacatatgatgcttaatatctggactttcccactaaaaataaactccataaggtcaggaatttttgttttttgtgtgtgtgcatattccagtataccaaagtatgcctggcacacagtaggtactcaggaaatatctgttgagtgaatgaatggactctgagtgactgtgactataagctccttgaaaaagtgaccatgtctgttttggtcattaatggatccccagatcccagcacactatttagcacttggcactgaataaatgaaggagaattagatgtgggttgttcaaccgtgacacaacttttggtcagagtccatagtttataatatcatgtatttttctttgttgctcaaaattggaaatacttacaaagctttataagctacacaaaggtaatgcataatagttaatgagctctcacagggcataaccataggctaggaagtggagcgatggcattctagtgctgcaaatgatgcaatgaaaatgacctgatccaaatgctgtcaccatcttccagaagaagaatgatctcttgctggctttcttttaagtaataagattatttttcatagctttcagtagtttttttttttaactttcatggaagtttccctctgactttttattttgaaaaatttaaagcctacatccatttcccatctgcagacagacactgcatggtatttaaagatttacgggtagatctcttaggtaattgccttgaatgtttccctctgtggtttgctgggataaccagtgaagatgcaagcaaatcttataacaattctccatttcctactcagggcctttactatcagtagattttgagctcaatgctttaggctattaaaaacaaatacttctaacatgttctcggacctcttgctgtgaaaatcttctagtcaatgattaaatttcaagagcctgaaccatcactaaactagtaaccattgttggataaatttgggaagaggtttgttgatgctcatctaagcagccccatatgtggagtttgtttttctccttggttatcagagtttgtgggtagcagtcaaggcgatggggacatagaatgaggctgtaaccaaggaatacatgttggtgacttccatgactagtaagagtttggcagtgaggcaaggctaatggggggtttggcagttttcttatcacttgattctttttgccttggaaagttgcatcggtattccaactacactgactatttctttttctctacttcttagtaatgtgttcttcccttagtcctatgtgtttggtttaatgtaattaagactaatacaaaccaatttgctaataggattactagtagcaagcacactataaatatgcttagcctaaatgaatcacaatcattccctggtgcacgcaacattccttattcaacattccttattcaaattcatttactctatcttaataaaatcccaataggaactagaaactctaggccttttaaacagagtcagataacctcaaatgctagagaggaagaataaatagaaatttggaccttcttttatctagacagccaggtcaaactggccctgtgcaggaccaccatttatttcttggttttgtaaactgaatcctgtgattacagtggaaatccagctctgttcaagaatttttttcaaaggcatgtccagctggagccagacaattctgaaatagatcccagctgtttggatcatctgaacccgagaataactaaatgctgccactgaaagcactatcagtagtaaattctcatttgaagttgtaggtagctagaatgccaaatccttaaagaccacccctatttagcagcagcttggaaagggtagtagaaggaagagattaattcttacttgtggttttaactggcccaactaccacaatccatttggtaactaaaatttgttccaagcatgagcatgcttagatgggcatatttcaaagttggaaaagctggcccttttctaggaaatcttcagatttttctaactttgagttaaatgtttcatgtatatcttcaataatcataattgtttatggattgtgtattttgtctcatatttaacttctttatctttttataaatgcaagcaggtatagatatttccatagctaaagtctcattttcattacacatacaaaacaggtattatttaaaacaacgatattcaaagagtaacatggtagataactagagggtagtttcctttattcacaataatcatcactacactgttaattaatctgattgtattttgtctcagtcatatgctttgttactaataagataaataacagtacatatcaatttctaaaaattaggttttataattttgttctccaggtaaataagcctcataagttttactctgtactcatcattatcttctaatggcataaatattttacagcaattttaatatatttaaatacaatttttaaatgcttataatatattatctttttatacttacatattcataagtaatatatttgaatttggttttcacctgaaagtctaaccaaaagcaaatcttttcaaatataaatatttagtctctcaagaaatagattcattttcctttagtatacgttctgtacacttaatttgttcattcctatctatgtagaattaataaacctatcctacaaaaatactctgtgtacagatgaatgctaattctaattgggcagccgtttggaactaaagccaaaattcattttattacctgatattatgtcaaactacagttaaacaattctcttgaactataaattctgtgtgtgtgtgtgtgtgtgtgtgtgtcagagagagacagagagcaagagagaaaaactgagagagagacagaaagagatgaagctgtgtagttcgatatgctttcttaaaataaggctgtggggaggtaattggtaaagaatgttttcccaatcttaaacaagtagtaaattaggtgatattttctatttataaccggtaaaaaccagacaagaatttctttctgctacaacttgctgaacagagcatttaaaacctttaatgactagatgagttcattttctttaaatgctgtgcttaatatttaagctacatcttatttgaaatgttagtttaggataaataaataaaacattccagatgcaatcttccagcaacgacattccagcaatttccctgagaataaagtcagagaatattccaggttttgaacgtcaagtgttttcagatgataactagtaagttttccaaaacatctaaagtttcaaacaaaaacttttaaaaagccttttcaaaaaaagaaaagaaaccaaattctccatttacacatgtacagtcttcacagttgaatgagaatataaaccattacttaaaaacataaaaactttaaagtttgagaataaaaatagacaatctacttcctagggcaagtggaattgtccacaagtcctaccttcctttcccagaaacaagtaatcaaaactgttaaccaagaccaggattaaaaaagaataaatgagctaatagttttggacatgttgagtttatagtgcctgtattgatgaaggacttttcttcaaccttaaaggagtaataaattaccttgagcaaataatttcacttaaatctatgtaggaaaagcagaaaaacagagcacaaaggagactgagaaggagaattaattaaaagtagtagggagactgccccacacccagaagaattatatctcagaagccaagggaagtcaaatattcaggaaaaagtgaatacttaacagtggcaaagactgaaatatgatgaaatattaaaatgtaagaaacactagttgggttaagtgaatcaaagtctatctataaacaatttcagtaaagagattggggtgtaaatcacactggataggtggatgagtgaacaggcggtgagaaagagaaagtggagccagctgcaaagacagctgtttttcttaaaaaaaaaataataaaaaaaaaaggtaaatacactagtaagaggaatgtgcagggttaaaggatttttttatttgcttgcttatttctaggatagaagatacttgagttatgttttgtaaactgaagggaagaagggagtagagaggatacaaagaagttctacaaaaccctgaggagactggagttaggatgtgtatggacatcccacccggcaccatcagcacttccaatgaccccatgccctgcttgtttttcttttctctgtagcactgattaccttcaatagtgctatatacctcacctatttgttccaattattctttctctcacttacctttccaccctcaatctcctttgggatattctcatttcccaccatttccacttaccctttagatgcacctgacttcccagggctttataaagtttacagatctttgtcttttgttctttcttatattttaagcccctagaacatagtgacactcaataattatgtgttaaataaaaatatgttggattgtagaatttaaaaaaatgtagggatgagtctgaaagtctgcattttttacctacaaagtaggaataattaagctgcatggaaggagggctagagagagtgtattagtccgttttcatgctgctgataaagacatacctgagaccaggcaatttacaaaagaaagaggtttattggacttacagttccacatggctggggaggcctcagaatcatggttagcagcagacagaaagagaacttgtgcagagaaactcccatttttaaaaccataacatctgtgagacccattcataatcatgagaacagcatgggagagacctgctcctatgattcaaccatctcccaccgggtctctcccacaatatatgggaattatgggagatacaagatgagatttgggtggggacacagaaccaaatcatatcattcagcccctggcccctcccaaatctcatttcttcacatttcaaagcccatcatgccttcccaacagtctcccaaattctcaactcatttcatcattaactccaaagtccacagtccaaattctcatctgagacaaggcaaatcccttccacctataagcctgtaaaatcaaaagcaaattatatacttcctagatctaatggcggtacaggcattggtaaatacagccattccaaatgggagtaattggccaaaacaaaggtgctacaggcccaatgcaagtccaaaatccagcaggatagtcaaatcttaaagctccaaagtgatctcctttgactccatgtctcacatctaggtcacactgatgcaagaggtaggtccccatagtcttgggcagctctatccctgtggctttgcagggtacagcctcccttctggccgctttcacaggctggcattgagtatctgcagcttttccaggtgcacaatgcaagctgtcagtggatctaccattctggggtctgaaggacggtggccctcttctgacagctccactagttgatgccccagcagggactctttgtgggggctttgaccccacatttcccctctgcactgccgcagcagaaattctccatgagggccctaacccctgcagcaagcatctgcctggacatccatgcatttccatacatcctttaaaatctaggtggaggttcccaaaccacaattcttgacttctgtacactatcaggctcaacaccatgtagaagctgccaaggattggggcttccaccctctgaagccacagcctgagctctacattggcccctttcagccacagctggagtagctgggacccagggcaccaagtccctaggctgcacacagcatggagaccctggacctggcccacgaaaccactttttcctccaggaaaaaggctccaggcctgtgatgggaaaggctgctgaaaagacttctgacatgtcctggagacattttccccattgtattggggattaacattcagctcctcgttacttatgcaaatttctccagccagtttgaatttctgttcagaaaatgcgattttcttttctattccattatcagactgcaaattttccaaacatttatgctctgcttcccttataaaactgaatgcctttaacagcaccctagtcacctcttaatgctttgctgcttagaaatttcttctgccagataccctaaatcaactctctcaaggtcaaagttccacaaatctttggcaaaagcaaaatgccaccagtccctttgctaaaacataataagagtcacctttgctccaattcccaataagttcctcatttccatctgagaccacttcagcctggacattattgtccatgtgactttcagcattttggtcaaagccattcaacaagcctctaggaagtttcaaacttttccacattttcctgtctttttctgagcccttcaaactgttccaactcctgcctgctacccagttccaaagtctcttccacattttctggtatctgtttagcggtgcaccactctgctcataccaatttattgtattagtccattttcacactgctgatgaagacataccagagactgggcaatttacaaaagaaagtcatgatcttcagtaggctagtcattattggacttacagttccacatggctggagaggcctcacaatcttggtggaaggcaaggaggagcaagtcacatcttatgtggatggtggcaggcaaaaaaagagcttgtgcagagaaactcccacttataaaaccatcagagacccatttgctattacaagaacagcatgggaaagacctgcccccataattcaaccatctcctaccaggtccctcccacaacacgtgggaattacgggagatacaagatgagatttgggtgggaacacagagccataccatatcagagagatttcaaatatactgaaagttaaacattcagtacagactggtccccaatatgacaatttttcaagtttagcctggtgggaaagctatatgaattcagtagaaaaagtactttaaattttgaattttgatctctttccaggctaatgacaggaagtatgatagtctcttgtgatgctgggcagtggcagtgagctacagctctgggtcagccatatgttcaggagggcagacaaccgacagtctagagtgaactgtgttgtgatacgattttgcccaactgtaggctaatgtaagtgtttaggctggaggttgcacttttttgaattgcagatgtgtaaaaaatcagaccttgcgatgaccttgagcagtaggatatatataactcccacatgcttagtgttccaataatggaacagtaggcataaatggattaaggtaggccaggccaagctatgatcttcaataggctaggtatattagatgcattgttgactagtgacgtttcaacttactatgggtttatcacaatgtatccccattgtaagccaaggagtatctatgtatagatcaaaggtcattcgtggaagctcatgaaccccatttaagaagtggcatgttggccaggagcggttgctcatgcctgtaatcccagcactctgggaggccgaggcaggcggatcatgaggtcaggagttgaagaccaacctggccaacatggtgaaaccccatctctactaaaaatacaaaaaaaagaaaaaatcagctgggtgtggtggcatggacctgtagtcccagctgctgtggaggctgaggtgggagaatcgcttgaaccccagaggcagaggttgcagtgagctgagatcgtgccactgtattccagcctgggtgacagagcgagactccatctcaaataaaaaaattaaaaaaaaaggagtgacatggtttacttaccctatataatctttttaaaattagctgctatcattaaacattatttaacatgacattttagatatttggcttgtctcagaaagtaagaagatgtagccatatggtcgtcatttacaaagttcccaccattcattattgtatccctaaaccctaagtttaatgtcagctgtcttttattattaagcttgtgctattgtcttttagtgtggctcctttatcacttctgtcactcccttggcctctttatgtggtagtgtctataatccataatattggtagttttcaatgtataaataagttgtcttccaatggggctgcagaggagaaaaagtaatatcttttctttacccatcagatgggtagtaactggccaggagcagtggctcatgcctgtaatcctagcaccttggaaggccaaggcaaaaggatcccttgaagtcaggagtttgagaccagcctggccaacatagtaaaaccccatctcttagttgggcatggtggcctgtgcctgtagtcccagctactcaggaagctgaagcaggagaatctcttgaatccaggaggtggagattacagtgagccaagatcgcgccactgcactccagcctgggcaacagagcaggactctgtctcagacacacacaaaaaaactctaaaaaaaaaaaaaaggtagtacctgataccccataaagaaagacagattaaaaagacaaaagcataatacatttatttaaatgaagttttacaagccttcagaaatgaaacccgaaattctagagaaaactgtgtatttttatgctgtctgatgaaagaagtaggtagttgtgggaaaacataattggacaaaaagggctataatttaatggtaaaaacgggggaatttagcaagccttgtttgttcagatcctttttggcttctgggtacagggtgggacttctctggattgagggtcatatgaccctactttcaggcaaggaaggtcagagaatttctttatgaccatgtttcagtggagaaaggcaggagaaagacagagtgaccttgcttctgtggatttctgattcgttaaggtgccatcttttggggtattgtattctgagtccgtacacggctttccaatgcccttagaaatagatcaaatttcttagcttagctaatcaggccctacatgatctggtggctccgactcccgtgacctcccctcgcaaatctacacctggctttaaatgcgctcctattttctatcttcagtggtcctttttcttgttcttaaataggccaagcagcttttagcctttatattttcagtttactttactgggattcccttcctccagatgattaacatggctggttcctttgttatctcccaacagtgagagtgaaggccatagttctctttccgcaaaaccctgattcctgtcctaattttgccacccacacacacatttgttatcaagtagctccttctgtcaaaatcatgcaagttgttctgaaatttcaatacaactcagccttctgtcctttcaagttcttctaacttccatgaaaagcttgctcaagaaacagctgacaatttcttggtgtcaggattaatttaaacttttagtcagaatcaggtgacaaagactgcacacagaacagactggaatcctaaaactgggttgcagtctgaagaacatacactattactagacttttaagcccatttatgcaaatgcaagggtacctattcgatatgtccagctaacagacatatctctgataccactcatttctccaaagaaaaattatttctagcacactatatgctaattaataaactttctggtcttgattggagttacaaatattgctcttctggaggaggtttttcattagagtcctttaaatgttcactaactagtcctcgagtggtagttttcattaatgtacttgaaatatttacctgccacccctaatgtgctaggttaaaacacagactcactcctgaacacatacactcacacatcacacattctctcttctgatttgtcttctagtaagttatagaaaacataagtattgggaatcgcttctgtatagtacaaatgagtgagaatccttccactgctacccccaccacaaacaaccacatacacaccagttctaagtgaattgacaggggaataaaaacttagtttactactgggatggggactaagaatcattggttcacccctttagtctttccatgaaactggtgagatttaaagaaattgtttctggcacctcccatttaacttggaatgtattttgtgacagaaacaaggcctgtcttaatttggcttgaaatggatctgttggttgtgcatttctgtatctttatgtgttaagtagctatttcagtcttcccagaatgactctcataaaacctagattatgattctccacttcttctcttcctgctctctcagtaaatcattgcacacaggtgtacatgagcaatttataatatactgatcattttaaagaataaactgaagagagggtttcatatcaaatactccaaggcaaactcttctaaaatcatcttgagacatatctcttctttcaggtctcttttacctctcacgtgatcaaacagatgtttttttcttcctcttttcttcccccagacactgctcagcttctgcttagtccttctcttcttctcttccaaaagaaaaagtgtttcttttcttttacacgtgtaataatcctaccatgtctccatatcctagatgacaattgataacagacacccccaacccctggcctctaccatgaacaagtttattgaaacagcaaatgtaggcctttccttctagaagatttgtataccagcagcctagaaaaaaaaattcctcacactgttgcatttgtacttgtagaaatatagattgagttctctgcaccacatgtattttttgaagcagaaactcattttaatttggagatttcttgagtaatagaaacaaaaaatgctcattaactttggattttcttcaaatgtgatggatgtggtttcttatgatgatatttcatgtataacaaaaaggcacaagctattctgtctcaacacacactaatctaaagttatttatgtaaagagtattaacttaagaacaaatatctaaaataagtaagagatcaccacaagctttctaaaataattttgttgaaaaaaatgaaaaatgtgattctaataatctacttcttcgacagatgtaatctgtctccctacattcttctggtgatcatattttctagaaaaaaaatcagaattaagaatatttgtaattttgtaataatattaatgcaagaagtagttcagatattggatttcctgggacatttccataatgtatgggaaaagtacttcagaacacttgaaattagtactgtctttgaaatatgtctgccttattccaaagtaagccctacaaatagaaaacaggaagctatctaaatattatgatctaagggacagtacaaagtcctatgccttgcattatctttacctatcatagtctttctcaatgcctggactaaaattgccattacttgaacgtttcttctcaggtatgagaaagtaatctgtattcttcagaaaaatattgttaaaatgtttactattttttattgcaaggtgatgggggaggtcaccaaattagtaataacttgtgactagaaaaattaagatcctggcagaatgagaaattacaccatggggtgggggaaaactagatttgaattcaggaactttgagttccagtgctagctgtgatgttgacttgtcaagagatcatgggcaactcatgtaatcttcagcagccacaatttctccagttttggaatagagttagtagcagtagtacttcccagtttgatttttgccttaaaaaattgaaaagtgctttaggatcaggaaactaataggggaagcagaagggaatcgactttgggttggctaatgctaatcataaatattgataatatagaatgaaggtgcaaaggaaagaaggaggatgaaatttccaaagtcatccctcctgcccccacaagacaggttagctgtctcatgggaacgctgaggtaagtcatgcttaaacaaaacctcactcttacctagaattggctgtgaccataatacaaggataatttaggcaagtgggagaatacagataaacaacaacaataaaaatatgtatggcatcaagaattatagaatcatggatcctggttacttatattttcaaagccaaattgaaataatgtgttagataaggaggaagctcaaagactaatttattggaggatttaaacaatttttctttgctatgtttccctagagactttaggagattgcttttaaagtcttgtgctatcatgcatgtcagtatctgatacagttttatccataatttactaaaggagtaacagtggcacagtgaaagctgactgaccataaatgcttagggctttgtagtattaatattatcgcctcaggaaccaaggaaagtatgaaatcagctgtgaagattttgacctctgacctgcaagtctatgatatatatcccttaaataggtgccttgtccatagggagacgattagagacttaacaaaaaaaaagtcccaaactttctctattacctcagttgtggtaccgagtctaatgtttagacgtaacttgaaagatactcctgagataaaatgaaatatttcccatctctttttctcagttcatcataagtgtcattcagaggtaatgatacagaagaaaaaagtacttaagttgcctttcatttcccttttctgtcttccatctcaaaaggagattccagggaagatataagacagagagaggctgggcgtagtggctcacccctgtagtcccggcactttgggaggctgaggcgggtgaatcacgaggtcaagagattgagaccatcctagccaacatgatgaaaccccatctctactaaaaatacataaattagctgggcatggtggtgcgtgcctgtagtcccagctactcgggaggctgaggcaggagaatcgcttgaacctgggaggtggaggttgcagtgagccgagatctcgccactgcactccccactagcaacagagcgagattccatctcggaaaaaaaaaaaaaagacggggagaatgcaaaagttaggacactttgacacatcaaaaatcaagtacaattggcttaggcaaaagggaaatttattgaaagattacttggtcacttccattattaagtgaaaaccaacacccaggaaaggaaggaggcagcctgctgaacctcaggaaataaaggctgcctctttcccattccctttgttccctttgttcgcctgtctacttcagcctccacaccagctgctgccaccttaagtaggaaacagcggtcatcaggagcaaacaatatcttatgccatttacaattcaaaaactccgtaatgatgacttggttctagacagcaagatcatggaggaaggatcgcgattgtcccaatggtcagaggacaaggctgcataagaagcaggcagggctgattgttttcccatgtttggtggtcatgagaagagcggttcctgaaagaaggggagtggggaaagtaattccctataagaaagggaaggtggagagcactgctgaaagaactaaacagtagatcgccatcataaagaacaaattaggaatatctaggggataatgttactcggtgagaaataaacaagccttccttagaaacttagaaaattataccctttatttctgactacttcaaattatgttctggtagtaccattggtgaatttcccgagcaggcagcctccaattgtagaaaagaattgtgttcccaaaattgacttgtaaggagtttggatctgagaatacacagaaacaatgctaccaatggtgtttttgcttttaggtcagtttataggagcagaatccttaatatgcctaaattattatactaacagtccatttcaatgtcaccaaatatccataagagaatctttctcaagagtccagcttctgagtaccatgaaatacattttacctcctagtggtgatttctttttactgcatcaggtcatggttgggtagataaagcatgaaagggaactctgctgggactcccaggaagtagcagtttatttgctttctgtgttgctttctgatgcagagaatatggaataaaaggctgacaacctgtgttgtagattgagtaactgtttcttgctctgtgacttcagaaaacaggccttggttttcacatctgtaatacggtgttggtatgtgtacgtgtgcatatatgtgtgctgggagccaggtggactgccttttaaattcagcactaccttttgaagttctttccaccctaaaaagtcatgcttctgtgctgagaaaagcactttctcaaagccctgttactgctgaagggaaggctgccctctgggccagtaactaggtggggaggagactagaagagagcagctcaggaaaacaagctgcactccttcaatgtctgctgatctatatgaaggcctccctagtaaagccaaggggggtttctcaccactctccttttttgaggttccctgtattaataaatgaaggaatgacaaaataggattgtaaaaattatggaattgtgaatattttcatttgacaaattagcacaacagaaattatgatataattgagctactaagaattaactataatatttataaaaaatcatttatggtacaatctaaagtagttcagtaattgagtgtatgtgtgaagttttatgagagacatggaaaacatattgtcaataaatatgtctgttattctatatatgaactcacctggagatagcatcaaagacctaatttatggccacttttgtatgaagccctagtcaaagggcctttctagtaacttttgtgagatgccctgttccctcatgttagtaaagttatagactatttctagttagagtatcaaatcagaaataacagtgccgcacattctcaatgatctcattttccctaatcatgtgattggttatcttatcaattctatttttttctcagagtagtttctatcatttgaggaagaaataaaagaataaatatccaaataaagataactagactagctgcacaattactttgggaaaaaaattgaaatgattataaatcatatgcagtgtgataagtcatggacacaagttcaggatacttattcctctcaaattgtggattcaaatgaaattcaatatgggattttgaaaatacatcaattttatcaatgtttaaaaaattttgtaacacaaagatgattttttttgtaaatgtaatatatgtatgctgaaagtaaggttgttttccctacctagaggagcatttgaaaatttagaaataatgatattttattaattttcttatttttgaggcagggtcttgctatgttgcccaggctggagtgcagtggtgcaccatcacagctcactgcactcctggactcaagtgaacctctcacctcagcttcccaagcagctgagactacaggtacacaccaccatgcatggctgatttatttttttatagagatggggtttcgccatgttgcccaggctggtctcaaactcctgggctcaagcaatccacctgccttggcctcccagattactgggattacaggtgtgagccccgcttccggccaagccgtgatcttaaagcaattcatttataatgtctaaaagttggggggaggttctgattttgttatttaaaaaaaaatctcaagttagtgatacttgtgttgagaaactaagtaaattaaacactttttcccctagttattaaatttgaatagagtggaaataacaaaaagttatcattttaagcaagaattttgtttaatattttttctctttcatgtaatctgtatgaaattgctagtccttataaaagttgagcaatacattgctcctttgctttaagtattcttcagaaaattttgtaaataggaagaattaaagaagaggtattagcttatctatggagtttgttaaaatctatgtaaaaagaagagaggctgtgatgttacatgtggaagacaactaaaacagaccaactgtagggcagcaaatgaaagaagaaagtaggtcagcgagccccctggcgaacaacaaattgctattatttaaaaggatggtcagagagtaaaactgcctgtgaacaagaatgcttaagtgaacaatggtaaatctgatagaaaagcagggtcagagcaaaacagttgcaaagctcagagtgtaaactgcatgtcctcaggtcaagcagaggatgaaaagcagaacaatctcctcattcaagaaacttcctggcggccagcaagctgagtaatgagaaacaaactgagtggaggccttccacagagtaagtagaagcaaacagcctcaggatatggagggaatcgagcagattttgagactataaactcatcaggattcacactttcgataaaagaaaagtttcagtaacaggagaatcactgaggggaccaaaatacttaatcaaatctgttgtcatcacttacttgtaaaagccatggacccgatgggattaattaagtgtgtttggtgatcagaaagcattgtcagggaaagcaccattccttattttcatttttaagatttactgtgctttttcttgccactaggtaaaatttgaggatcaattatataagatcatgttgtctgcaaacaagggcaatttaacttcttcctttctaatctgtgtgacttgtattgctttttcttgcctacttgctctagctaggacttccaatactatgtagaatagaagaggtgacagtgggaactcttgtcttgtttctggtcttccattgagtatgatgttagctatggggttgtcatacatatatggtctttattaggttgaggtatactccttttatacctaatttgttaagtggttttatcatccatttattatgaaatgatgttgaattttgtcaaatactttttctgcacctattgaggtgatcatatggtttttattctttattcagttaatgtggtgtatcacacttattgatttgtatatgttgaaccatctttgcatcccaggcataaatcccagttgatcataatgtgtgatccttttaatgtgctattgaatttgatttactagtatttaggtgatttactagtatttaggatcctttcaatgtgctattgaatttgatttactagtgtttatttaggtgaggattttgcatctatgttcatcaaggatattggtttgtaattttcttttcttgtggcatccttttgtggctttggtataaggttaatgctggtctcttaaaatgagtttagaagtgttccctcatcttcagtattttggaagattttgttaaagtttggtattagttgtttaaatgtttggcggaattcagccgtgaagccatcatgtcctgggcttttctttgaagggagactttttattactgactcaattgccttacttgttattaatctgttcatgttttcgtggcattagaaatattttagcagaatggaagaaactgacaatgcaaaagagagtggctaaaattttaggagtgttctttgaaaggggaagagatattgtaaaaaaaaatgaggggtggaaaaaaaatgaaggttgaatcttaggagataaggcagatatatgggtgcagattcaaatatattagtagatttggccaggctgatgtcatttctttaatgattgctttgctttactatgtaaaatcagctgagtttgaggaaggtgtgggaatgttgaagatttgaggagtgaatagcattctgagacaatttaagacagatttaaagagggaaatagagtagatttttcaggaaatgttgaagcccacttaaaaattgtggtcaaaaattttatgtgacatccgtcagcatagttttaggcttttgtcagttgtgcttctccattggggttcaggcattctgtaattacagagaggtggatttttatcacaattgtaggtttgtcagatgagtaccacagaagagagaagggcaaaggtgtgggggtctaggtaaggaagctttatagtgacgggagagggaatgggtcatcttggtggagactgaagtcttcaagaatgattttaggagaactggtataaagaaatttagggaagtgctataatctccagagaatttgatatgatcatgaagttggtagatgacagcataaaagaaaggaagatttgatatagtctgatagcaggtgcttccaagaagctgaatgtttcattggcagcaggagaaacgcagtagctgtgttttaaatccaactgagggtatatcacaatggtattggggaggatggggatttcccatacacaattcaacgctatggatgtattagtttgctagggttgccatcacaatgtgccataacaaccacaactgggtggttgaagcagcagaaatgtattgtctcacagttttggagaccagaaccctgagacaacggtgtcctcagagtttgtttcctctgagggctgaaggaaaatctgtgtcatgcctctctcctagtgtctagtagcctcagattttccttggcttatagatggtgttctctgtgtgttttcatatcattttccttctgtacaaaactgtctctgtgttcaaatttctcccttttttaaggatacaattgatacaggagtggggcagggaagtactgggtagagaagggctgtgtccctagcaagggctccaccctcgggcctgtgcccaggggacctaagtgaggacaggcactcctgctttcaagccccaatgttgcattttccaagaccactctggcctgccatgcccctatcttgtgcctataagaaccctgagatcctagcaggcatacaaacgagcagctagatatttagaggagcagaggggcaaaaaagtgcacagacaagcaccagcagacgctgtcaggacatcgatgatgtggacaccaaggggaatttggttgagggtggtggtcggacgagagcccagccactgagtggcctgactccaggggaagatcaccttcccactccatcccacttctggctccccatccatctgctgagagctacctccaccactcagtaaaaccttgaactcattctccaagcccatatgtgatccaatttttttcttttttggtacacttgggcaagaatccccggatacagaaagccctctgtctttgccataaggcatggggcctaattgagctgattaacacaagccacctgcagacagcacaactaaaaaactaaaaaactgaaaaactaaaaaagcacactgtaatatgcaccactagggcttcaggagctgtaaacactcaatcctagaccctgatgtggggttggagccccacgacttgccagtgtgcatgctccccatagaggtttgagcagggggacaccagaagaagcaagccacacccccactgcatgcccttcgaggggtataaggaaaaactcctcccatttcacagtcattttggactagagcccaatcttatgacctcactttaacttgaggaactgttaagacactattttcaaataaagtcacatttacagatactgagggctatgaattcaacatctttttggggcacacaattcaatctataacagtgggctttccttaaattcttccaatggtaatacattgccaggggaaaatgaacttgccagaaactttggtaatctttattaatttttaaaatttgtaatctttcaatatgtcatggtctgagcaaaaattgacttttaagtagagacgtcagaatttgcatgattccaatgaagtatttttgcccagaattcttctaatctaggtattagaatgcttaaaattcatcagttctttcagattaaacgttgtccccatccttgccattgtttaaaattcaagcattcttgtctgagagtcattcctgccttattttcctggagatgtcatggatatgagaaaaatgtttataaaaacacttttaaaaatacaaaaacattgtagagacggaacgaaaaacaaattaacaaggttttacaagtggtgagacctagtgttggcctactcctcaccttctcttatgcaactggacacagctttactgatggtcttattttgaactcatgactacagaacctctgatgggcacttagtactttctgacaggcacactacctttccttagttcattctctcttccactctctgagatgtctattacagtgtatcctttctctgcaaacctccagcacatcctcctctttctcagtcttatctaatgagcttgctttctactttgagaaaaccaaagccatgagaagagaacttttggactcccaccatgaggtcttctcgcctaccacatctgttccttttcatagcctgcctttctgcttgctattgtaggtgaacgttttgtgcttttctctaacagcaactccttcagttgtgcaatatagctatccccacctgcattctgaaacattgctctagaaattcttccgtctgttttctatgtcatagttttcctcctccctatgggatcatacccatcaacaaacaagtatcctctattgtttcctaggttaaaaaattcctgtttggatggaaatgtttgttatcttgaatgtagtaatggtgtcacagatgctaacatctgtcaaaactgataaaattgtacaccttgaatatgtgcagtttactgtatttcaaatatacctcaataaaataggaaaaaattctatttgacctcactgttcctatagctaatacagtatttcttagctctctcttgcagaagaacttcttggagtagttgggtacattcactgctttcatctcttctcttttcagactcctggacagtcttctttttctgtgccatcctgttctctttgcactcttaatgttggagtactccagggctcagcttttgaacatgttttcttctttactcattccctttctcggggatcttcaactgtttaacggttttaaatgttgtctacataatgatgacttccacattaatacctgagcccagaattctcttctgaatttcagacacataataaccatatattcatttgggtatacattgtaactatcaaatttactatgtttggcatcagatattccatataaaactttcttcatctaaatcttccccatcttagttaatgattattccattttttctgttaccttggccaaaaactttggtgacatacttgactgtcttctttttcttataatccatatccagttttccagcaaatactattgattctgtcttccaaggttttgcagttattaataaagctgctataaatatctatgtgcaggttttttgtgtggacatcagttttcgattcatttgggtaaatacaaagcagtgatttctggattgtatagtatgtttacttttgtaggaaattgccaaactctctctcaaagttgctgtactatttctcatttctgttgctccctgtcttcgctagcatttctcagtgttttgtcaggtgttgtcagtgttttggatttcagccactctcataggtgtgcagtagtatctcattgttttaatttgcagttcttaatgaaagatgatgttgaacatcttttcatatgcttacttgccatctatgtatctccttggctgttcagaccttttttttccattcttaattggattgtttgtttccttactgttgagttttaagagtcctttgtatgttttggatagtagcccttttatcaggtgtgtcttttgcaaacattttctctcagtctatggcttgtattcgcatcctttacattgtttttcacagagcagatgttttaattttaatgaagaacagcttacctgtttcttttctttcatggattatgtctttggtgttgaacctaaaaagccatccccatatttaaggctacccaggtattctcctatgttattttctaggagtatcataaatgtgtgttttacattgaagtctggatcaatttgggtttttttggtgaagagtgtagtgtctgaatctagattattatatttttttgcatgtggatgtccagttgttcaagttcccgtttgttggaaagactgtctttgctccattgtattcccttttctcctttgtcaaagattagttgactacatttacatgagtcagtttctggactctctatgctgttccattgttctctttgtctgttttttcaccacacactctcttgattactgtagttttatagtaagtcttaaactaaagtagcatcagttccccacctccagaggtcccttcaagttcccaccttagctgctggccagattcagccaccactgggcatgttcacaaattatctcgttgatgatgactgagagtcagttgaagttgtaatatttgtgctccataaaaagcatatcaggactgacatatataactagaatgcaaatttattaattcaaaataagaaatgtcatcgtcaggtgaacataagactagcctaatccgtgccttctctcctagtaagcaagctggtgttctattgcccagcaagtttactacaattcacaataatacagagtatacctcaagacagctaaaagacaggattttaaatgtttttaccacaaataaattattaataaacatttgaggtaatggatatactatctactctgatttgatcatttcaaaataaatgtatcaaaatatcactctgtactccgtatttatattaaaattaatgaaaaataaaatttaataaggttcattattaaaataaataatacattgttatatgttaattaaaataaaatataactttaaaaactgatatataaaaccagaatgtttatttatcaattcaaaataaatgactactatcaggtgaagacaatattattctagtcagagccttctctccttgtatgctagctctgttgctatcagaggttttccttggtgagctcagagtcagagctgggtgattgaattatgtgactggggcatacactggcaacagtctgtggtagcctgtggtaaccattgctttaatagggaagtaccctgcccagaggacagagcctttaaaatgccagcacaggatgttattctctggacatggtaaaagaaacacacacaacatttgcttctgtggctgtaaatgcaactctccttttgttattttatttttaatgctttcaaggctaaccactgactcctgctgatcgatgcattctttattttagatatgctattgtgttcaatcaattgcagtcaagtcttgcaggctagggagccattctgtctctttctaaagtgaaattgcctaaacattgtttagctccattatgtgtaggcttaaaaatttaactctacttctaaattcatggggaatgcattagcttcagaagaaaaatgggcactagaggggcacatgactgtggagggcaaaagcagcaatcagtctattaaagtaattctcatcctgggccaagcagcagaatccttgcaacatttttaaaaagagagagagagatgataaagatgtgggctctttacgttttgataaatgataccatattactttccaaagatattgtttgaattcatatttctaatattaatatgtaatagtaccttcttccctaccttcttagtatttactgctaaaccttttatctcagctttgctattgggtaacagttttggtaaaatataggtaaaaatatacaaaacatacttatgaatagcacataaacatgttgtccctatttccatggatgatgaagagaaaatcatattgcacgtttattcttctgcaaagaaatgatggcttaagtaatggggagttaaaggatcatgtgttgatttgcagcttatattaattggctagtcattatattagaacagagattaactgtgctgtctacatataatttacgtcaaataaaatagaaagggatacatttatggtgagttcaggaaataatatgcttttaattttgaaataaaatcaatatgtcccttgttgtctgtgaccttcaggatgttaatgtatagttctttattataaatgaatgacaagaggattgaacaattacaataaatataaaagcattttgagaaatgtgaaatctgagagatggtggacctttactgaggggcctttctgttttatattatagactaaatattatagattaaattatattgagtcataaaattataaatatatataactatacatacaattatatagaaattatattcctagcattatttttgtgataaaccttagggtgccaatactcaaggaacccttagaaagccatctttctaagcccactgaaatcactcctttgtatataggatgatttcagaaaatcaatgcctgttaaatctatttgcaaaaagtttttgcgataggcaccaggtttgctgtttcccataatctaatgagtatgttgctcaataaatgacagtccaaattactatccattgactcggagctcttcttttcattatcagaattttcctaatgcaccatttgttttactgatccatagcgcttcttcactgaattagcttcattacatgcacaccatcgccttttggctgaccttcccatctgatttgtacctgtttctttttcatgctcagcacacagtaggggctttattatatttaacacatactgcttgatgactatgtctcatctctacagactagaccacaatatttttttctgtgtttcccagagttcagtccaggtttgggaactgatctaaatgctatttctaacttggttttatcctaggagtgttcctgggcaaggttaaattctattatctttctgactccaaattctattgaaaatcatgacaaccacaataacaaaaggattgaaaagttataccgaaatctatccatgatgtaatatcttctgataatgaaaagggcctcatgatcttgagtcaccatagttttctcaaattctaactttctaagaaatcaataacagtggaagattaggtcctcggaacccaggtaaagagcccccaataggagttaagggccaaagtttgtgtcccagctcagccaataaccactatgggaatttaagcaagtcactttaccatctgaaactgtttcttcatctttaaagagagtagaattcaaattcataattacttgcagatcagagaccccactgagattctgctgaaaactattgacctccttccctgaaaaagcacaaatacactataaatagaattccaagaaggtcagaagctctttaaaatccacacatagattccctaaaggactttagaatgatttacaatggtctaaaatatgtagttgaaaaaaataaaataaatctatttacatttgctactccctatgtgaattagttttaaaatgtgtatttgggccattatatcatttgacattataattacttttttgtaacttatagtactcaaaacagagctaatttttcaatagtacagaatatttcctttgtggattaatagcatcctaggatctgcaaggttacgtgttcaccctgctacttaatgcaggaattatctataacctgcctcagagatgaaactatagctttgacttgaacatgtacagtgatgaggaactcactcatttgtttatttctgggcaaacataaagaatttgggaatttccttttttatattgagttataatctgcctatacacataaatgtcagccattgactctatttctgctcttggaagctacatagattaattttatttccttttccagtattttaggaattcaaagtcaggctctattgtcctctattaatttcctctatgctaaatattccagtttcatctataattcctccagaaaagtgatgtcataaaactaccttttatctcaattcccttcttaaactagtcctcttaaaatgcagatgagaactaggcagcatgttgcaggaaaagtctgaccaacacgtggttagagagcaattccctttctcgtactgccaacttcgccactaggaataccaccaacactgccaggagctctgtgcctagaaacaccaggtcaagtgaaattgtggtcacctaaaatccctaactataattaattaaggttgcccttatactctttttttttttttagaactaaattaacctttctaaaaacaaaaattctgttgaactctaccttaattgcttagaccatcattccagctcttggaaacctttactctttgccattcatgtcatcttttcttacaaattttgtgttatctacaaatgtaatgagcctcctgtctttggcttcagattaattgattaaaaatattggcctgtggtttgccaaatataaacctccctctatggattcagtattcaaaattcttcactcagttacttcacaacttttttgaatccacatttaaccatttgatctacagaatagagaagagaataagtattatattctgcttagggtcaaaatttatttcttttccttttcttcttttattgtctgctttcttttcttcattccttcacattttcatatggcatatccttgtcttctaaatggtcccttttcctgtgtgctcattttgcttcgaagaaaagaaccttcaatgtgttttttgggattccttggttttccgcccatatgcagccctagctgagtctgcacttgctcctgaggctgattgccctgtgccaagcctcaaaccctgtgcaggggagggatttccctgatgcttattagcatctggcagaggacgaagctctgagaatttcaacaacatccccagaccaattcattttcatccatctctagaattacatcaaatgtaagtctcctcaaacatcaaatgggggtttaaagaaaattaaacacaaattatacgtgtgttttgggatgcaggagaggtgtagggagaaagaaattattacatagtcctcagcaggcttctcactttaatctcagcattattgcatctataatcagatgaatattgatgacaggaaaagagagagattgccttgaaggctgcttcaaggcacacatcaaccaattgttcattatccaattgaaagatggtattagagtaaactgctttgggaatcaaagaattcgtggtagatattctgctgaacagctctgtggtaacatgtcacctgctcctgcctcatcaaaatgtttcacctggaaatagtaatgccacaattgtatagggctaaggaagaccttctaacatttgtccaagcgagtgattttactttgaaaaaggtttggctttttcgtataactttgtgactattattattataaaataaattaaatgttgttcagggtaaacaagcagacctattctcaagtgtggaaagtgggtgattaatggattaatgagttaaacatcttaattactgattttttcctttatattgaatcccctcatttagacaaatcaataaggacattagattattacctcttatttaaagaacattatctcaaacacagatttattactcttgagttaccttgtgaatgaaaaagatgagctctggagtcattagaacctttgcaaacctggcaagatatagtcaacctcagctaaggaagaagagtggtaggtggctgaatgattactgtgtcttaatatttcagagggaaccccaagaccttggtgccaggttaattggtacttcaaacctatgataaatcctagagaatgatggaaagtttgggtcagcagccaaaaagctaaaggtgaaaatgaatcagtgtctcttaataatggaactttatgacttactcattcataccctcattaattcattcagtatatattgagagactatgatgtgtcagaacttctcttagcatcacaatactcttacaaccttgtacaaatcctttatcttctctaagtctaaattttactagacaggtgtttaccacaaggagttgtgaggtttagtgagtcatgtatgtaagactcaagcagagtgactggttggacacttaataaaccctcttccctttccctgagcactgagacctccttttcaggtaatttatgataatgtgaagtgaattccatgtcttagcaacaaatttctccctacagtcttagatcaagaagaattgtgagtaatgtaagttttcagatgaaattaaagtatttaaatattattacaagtgataaaatatttttgcaatccatgaagtccaaggacgtcactgtttgccaaatagcattctgaggcttgctgacagccgtacatgcaaacttacacatttcttgagactctttgttttatagcaaacatgaggaatgacttcctttcatttatcaattcttactagagtgttttttagtaatacttaaaaaatctaataaactaattttataaggtacaaaaaagtgtaaaattgcccacgttaactatcactatatgcagaaagtttcagctactctgatatcttaacagaatagactcgagggaaatgaaagataattttgtagattgagtgtggttgttgtaattgtcttctgatttatactctaaatttgaaataattttgaaaaaaatctaaagatagattattgtggaactgccaaatgcatataccaaactgttacttcattaattcaatcaatgatttagacaataaatattaatgagtacctactgtttgctaggcactgtgcctgggactccaaattaaattacatatttctcagcatcgaggagttttctctgatgagaaagagatgtaaacaaatacagttctgtaaggtaattgacaatagatgttctaagagcaggggggaatatgagaaagtctatctacatggggaattggggtagccatcagagaggaggcaagctgacacgagaagggtgagtgggagattatcatgtgtgtgtgtaggatgaagatgtctggcaatgagaacagaacaagaaaagtatgaaagcctgagggagcctggagtagcccgggggaaaagtaggttagtgttgttaagtgtaaattaccctgaaagcaggaaaggctggtgagaaatggtagagagcccagattataagagccttgtatagcaggcaaatgtatgccaatgtttttcccactgtataggttgtgggggaagttattgaagaattttgaagagagaagttccataatcactttggtatgtttaggttctgaaagaagattcacaatattctgattgttttgttgtttataagttacagaaatggcacgcacacccttttgttcctaggggtttcaatagttcttgttgtaatagaattgagggatgccaaaagcaatatttgaactaagtgatacattagaattataataagaatctgtgagcagatttttagttaacaggtttttaataggctgtgatgcaatccctaatggagaagctttaattatgaaagatagcctgcctctaatggaaattcagctgggtatgtttttattgctcagtgaattaaaaggtttatataggattacattgttaagattcttggagaaaaacatataaacaccaaatgaaaactttgcactcttttctttatcttttgcagcaaagcggttaatattccagaaatgaaaatcatttaaattttgcataatttttataatttcaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttagcttgagatttgcattgatcatatttctgtattcagaacagaacacaatgttcatttttaaatgatgaagaaatgccagttttcttgattcaatacaccacaatattagatactaaacatctttttcccaccaacaacacattaatggttgattatacaactacagaattctcttcattttctaagctgcaagatatatatttcccagcattttctctagttattaagaaagaagaatgataaatccaaaaatctatgccaaatcttcctacctcctcttttagctattacttgaaatttgggccatctatttcctattgcattttgataaataatatagcagtttataaatcttccatatcataaaataagaaattccattaattcattcatatagtcatttattcattaattaaacaaatatcttttatgagcttatccctaggaaggtactatgctgcgaattatagaaataaaagaaagatacttttacccctatagaactggcagaaaagataaagcattagcataaagcaagattttatatgacagtgtatatttattgaatatggctttttcataatttaaaattctgggcattttgaacaattttaattatacattatttgtgaaggcaaagtatctaaactacaaaatttagggggaatggaagaatactcagtttggtcctttattaataatattaatgaaattcaaatgtatcatggataaaaaataaaaagatttctcaaaagtcagtaaaggacaaatgaaggcaggaagaaaaaatcaaatgtgtaatccactgtgggatcttaatatcaagattcaaatatgtaaaatgattgcttttaattttgaatatgagttttgtaatgtagaagttaagagagttttatggagctataaagaatgcagtgagttgacaaccattttccttagtatttttccccaagaaaataagtgtgaaacccgttgataagcataccacatgtataaatgactattctagattcctctctctctccttctgttcctttcttctgtctttctccctccctccttctcttcctttctttcttccttttctctctccctctctccccttctccctctccttctctgtctttctccacccctcccatgactttttcttttttttttaaattatactttaagctttagggtacatgtgcacaacatgcaggtttgttacatatgtatacatgtgccgtgttggtgtgctgcatgcattaactcgtcatttaacattaggtatatctcctaatgctatccctccccccaccacccaccccacagcaggccccggtgtgtgatgttccccttcctgtgtccgtgtgttctcactgttcaattcccacctatgagtgggaacatgtggtgtttggtttttttgtccttgcaatagtttgctgagaatgatggtttccagctttatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttataatcctttgggtatatacccagtaatgggatggctgggtcaaatggtatttctacttctagatccctgaggaatcaccacactgacttccacaatggttgaactagtttacagtcccaacaacagtgtaaaagtgttcctatttctccacatcctctccagcacctgttgtttcctgactttttaatgatcaccattccaactggtgtgagatggtatctcattgtggttttgatttgcatttctctgatggccagtgatgatgagcattttttcatgtgtctgttggctgcataaatgtcttcttttgagaagtgtctgttcatatccttcagccactttttgatggggttgtttgtttttttcttgtaagttttttggagttcactatagattctggatattagccctttgtcagatgagtagattgcaaaaatgttctcccattttgtaggttgcctgttcactctgatggtagtttctttcgctgtgcagaaggtctttagtttaattagatcccatttgtcagttttggcttttgttgccattgcttttggtgttttaggcatgaagtccttgcccatgcctatgtcctgaatggtattgcctaggttttcttctagggtttttatggttttaggtctaacatttaagtctttaatccatctcgaattaatttttgtataaggtgtaaggaagggatccagtttcagctttctacatatggctagccagttttcccagcaccatttattaaataaggaatcctttccccatttcttgtttttgccaggtttgtcaaagatcagatggttgtagatatgcggcattatttctgagggctctgttttgttccattggtctatatctgttttggcaccagtaccatgctgttttggttactgtagccttgtagctgaaggaagtagagacacaaaaaacccttcaaaaaatcattgaatccaggagctggttttttgaaaagatcaacaaaattgatagatcgctagcaagactaataaagaagaaaagagagaagaatcaaatagatgcaataaaaaatgataaaggggatatcaccaccgatcccctgactttttctttgttaagccaaaactttctggaatttctataccacctgctatgactctttgtttatttctcaagtttctctctacttaaaacctgattaaggcccttatttattttaagtgattttgaattacttgtgtttggaaaacatctcaatgccccttgagagtatttgagacaccctgaggtgctaaacataacattgcccttccctttccttgaacagatgcttttaaaatgctttttcaaagggactcaggcaaacaaaaagaaaccaaagcttttgctgattttgtaacatcatttagggtaatatacagtatagcttctggatttttctgttctgttctccattcctaaaaaaaaacacaaagaaatcaaaattaagaacataagttttctttgggaaatggtttcttccattctgttctccactctcaaaacacagagagaattcaattaaaagcttaagttttctttgagaaatatgttgactttctcagaaatttgaaggaaaccagttgagataatggcttttcactttacttttcacacaattatagttttcaaaaaaatttttttctagaagccaacttggcttcagtttggaagaatgggcaaagaaactgaccaaagcaaagcaaaacagaaactatatttcccagaccacatttataatataattgtttgtagctggactttgagtcattctgacttggattcaactccaggctctaccagatttcagactcagtttcttcatttgtaaaataggtacaatcatacctaacctgctgggttgttgtgaggcttaaatgagataagacctataaaatacttagccaagcttagtgagcatttaataattggtatttattattattagagttagaaaggacctcagaggccttctatcttaactttatctacttcatgatcctcttcaacatcatgaacaagtgattaatcaccccacttattttactttttatttttatttatttatttattttttgagatggagtctcgctctgtcaccaggctggagtacagtggcaccatctcggcttactgaaacctccacctcccgggttcaagcgattcccctgcctcagcctcccaagtagctgggactgcaggtgcccaccaccacgcccagctgatttttgtttgtttgtttgttttgtattttagtagagacggggtttcgccatattgtccaggatggtctcgatatcctgacctcataatccgcccgcctcagcctcccaaagtgctgggattacaggcgtgagcccccgttcccggcctaccctacttattcttgaataactccagttccaagccaaccaaaagttttgattgttcttctatgtgttaaactctccccttctacacctttcctgcttctttgattcatctctgaaaactccagatattaaagaacattctgatgtcatttctttgataaaatgtcatcagttcctcccaaacttctcttctcctcctggccactcacttttggatcctgtttagttgtttacactgactctaagaaaggctctgtcaggtgaataagttaggggttatttttctatcctcttatacgtgaggaacaggcagactgtggcagagtcaggcaggattcttgactagagttatttctattggacgataattttgtaaccctttattcttcccagagttatccaaggtaagggtatttataaaaaaaaattactcactaatttttttaccattcacttttagtgttaatttaatatatgccaatgttttatacattatggagaacaacataattttaggttggccaggaaaaatccttttttttatagttacaaatatgattataatgtgtattagaagaaatacatatccagcaaccccaaatccatgattccatacctattatgcttaggatgaggcaagtttaaagtgtgagtatattttaggtttatttaaagaaaaatttagtaaaagtggtaccccaatcaaaaaagtaatatataattgaacgaaagtttggaagcactagttttttgtttttttgaggaaatgataattttattgggattgctagctaaccactttggctctgtagggacaatgcacccatttcaacagatgcatatttaaatatggaaagataaaatggcatgatgtgtgagatttacttttaaatacgtaagccaaaacagacataaagtaagcaagaaaaaaaagaaaaaatattgttagataaatcaagtaggtgaagtgttcaagaaactaggtcagtggtactgtgagatgtcctacattctggagttgtctctgttttttcctggcactatttatttatttattttagtttattattatactctaagttctgggatacctgtgcagaacgtacaggtttgttacataggtatacaggtgccatggtggtttgctgcacccatcaacctgtcatctacattaggtatttctcctaatgctatccctcctctagccccccgccttgacaggcccctgtgtgtgatgctcccctccctgtgcccatatgttctcattgtctaacttccacttatgagtgaaaacatgtggtgtttgcttttctgttcctgtgttagtttgctcagaatgatggtttccagcttcatccatgtgcctgcaaaggacaagaactcattctttttatggctgcatagtattccatggtgtatatgtgccacattttatttatccagtcaatcattgatggacatttgggttggttccaagtctttgcttttgtgaatagtgccacaataaacatacgtgtgcgtgtgtctttatagtagaatgatttataatcctttaggtatgtacccagaaatggaattgctgggtcaaatggtatttctggttctagatccttgagaaatctccacactgtcttccacaatggttgaactagtttacactcccaccaacaatgtaaaagtgttcctatttcttcacatcctctccagcatctattgtttcctgactttttaatgatcgccattttaactagcctgagatgttatctcatggtggttttgatttgcatttctctagtgaccagtgatgatgagctttttatcatacgtttgttgaccgcataaatgtcttcttttgaaaagtgtctgttcgtatcctttgcccactttttgatggggttgtttgtttttttcttgtaaatttgtttaagttccttatagattctggatattagccctttatcaaatagatagattgcaaaacttttctcccattctgtaggttgcctgttcactctgatggtagtttcttttgccgtacagaagctctttagtttaattggatcccatttgtcaattttggcttttgttgccattgcttttggtgttttactcatgaaaactttgcccatccctatgtcgtgaatggtattgcctaggttttcttatagggtttttatggttttagttctaacatttaaatctttaatccatcttcagttaatttttgtataaggtttaaggaaggggtccagtttcagctttctgcatatggctagccagttttccccaacaccatttattaaatagggaatcctttccacattgcttgtttttgtcaggactgtcaaagatcagatagttgtagatgtgtggcattatttctgaggcctctgttctgttcccttggtctatatatctgttttggtaccagtaccatgctgttttggttactgtacctttgtagtatagtttgaagtcaggtagtgttatgcctccagctttgtttttttttgttttttttttttgtttttttttttgtttttttttttttgcttaggattgtcttggctatacaggctctttttttggttccatatcaagtttaaagtagtttttttctaattctatgaagaaagtcaatgggatcttgatgggaatagcattgaatctataaattactttgggcagtatggccattttcatgatattgactcttcctattcatgaggatggaatgtttttccatttgtttgtgtcctctcttatttccttgagcagtggtttgtagttctccttagagaggtccttcacatccctcgtaagttgcattcctaggtgttttactatctttgtagcaattgtgaatgggtgttcacatgattttgctctctgtttgtctattattggtgtataggaatgcttgtgatttttgcaaattgattttgtatcctgagacttcactgaagttgcttatcagctgaaagagtttttggactgagatgatgggattttctaaatatataattgtgtcatctgcaaacagagataatttgacttcccctcttcctattttaataccctttatctttctcttgcctgattgccctggccagatcttccaatactatgttgaataggagtggtgagagggggcatccttgtcttgcataagacaaagttttcaaagggaatggtagaattttgcccattcagtatgatattggctgtggatttctcataaatagctcttattattttgagataagttccatcaatacatagtttgttgagtgtttttagcatgaaggagtgttgaattttatcaaaggcctttttctgcatctattgagataattgtgtgctttttgtcattggttctgtttatgtgatggatgatgtttattgatttgtgtatgttgaaccagccttgcatcctagggatgaagccaactcaatcacagtagataagctttttgctgtgctgctggattcggtttggcagtattttattgagggttttcacatcgatgttcatcaggtatattggcctgaaattttctttttttgttgtgtctctgccaggtttcagtatcatgatgatgctagcctcataaaatgagttagggaggagtccctctttttctatgtttggaatagttttagaaggaaaggtaccagctcctctttgtacctctggtagaatttggctgtgaatccatctggtcctgggctttttggttggtagggtattaattactgcctcaatttcagaacttgttattgctctattcggggatttgatttcttcctagtttagtcttgggagagtgtatatgtcctggaatttatccatttcttctagattttctagtttatttgtgtagagatgtttatagtattttctgatggtagttaatatttttgtgggatcagtggtgatatcccctttataactttttaatgtgtctatttgattcttctctcttttcttccttattagtctggctagcagtctatctattttgttaatcttttcaaagaaaatcttttcaaagaaacagctcctggattcattgattttttgaagggatttttgtgtctctatctccttcacttctgctctgctattagttgtttcttgtcttctgcaagcttttgaatttgtttgttcttgcttctctacttcttttaattgtgatgttagggtgtcaattttagatctttcccactttctaatgtgggcatttagggaagcactggttttaaatattgtcatagcaaacaacttaagtgtaagtattacagagttcatttaattgtaatatagatttatgcattcataaataaaccatatatattgtatttttttaaaagtctttatatgtttttttggccactatcaaaaagcaaacagtttaattgcaaaatgaataatagaaaaagcatgtctacttatgttaaagtgtctatatacatatacaatttttaatatttgctttctctgagtaagcagaatgtagaagaaatgcctttacttattttctaactcagtgattccaaaaaccagtcctcaaagctccattagttgcattaattaataagaaatgtctatgttgctgaaatgtctattttgtctatgttaacaaaattaaattgttagattttataacatcataacattttgaagaactatatcagagaagagctttataaaaatgctagggggaatgtttggttttaaatgacattttaagtgagtaaacatctcacgtaatatgtgagatgcaaacatctcacataattcacacagcaatgcagcattgtcctgtaaattctgaaataatcaacatgaatgataggtgcctgatgacattttgtaaagagactaccactcaaccgtaggtctttccttgacatttattttgtggacacagacattgtgtgtaggggtgcagccacttcccctactgaatataataatatatttcatgcaggcaatggagacttggtgtatagagggaagatgaacaagagactggattagagagaaaagtaggtaaaggagggaatttgtaacttggagacaagggaaaaattcttgatgaagtaaattaaaatgatattggattcatctttgtttttaatttcttacgctataaacatgacttaacagggttttcccttttctctgaatttcagtaacaatgaagctaattcgaaggaacgaacatagtgagaatcccagcagtatataaaattaccatattagaatcctgaaagtaacagaatattagagtatattcagcaaataattcttcagacaaagtgttaacttacaaggcagacagttaccagaagtccagctgaactttggtgacataaacttgtaaggtttgtggagcacattaccatgactttgttttcaagaggtgagagcagtctagaggggctagcattttctgagctggaaaatgagtcacagttctggtctatggccctcattttacaggtagaaaaagtgaggcctagagaatttttcttcaaatttacatttagaaagttcaaaattgtgtcatgtagaaaattatttggcagcaaataaaagaaaaaccagcaaacaacggtgtagagatatgtttatgtcaagtaataaaatgtctaggactggaatagtgaatcaagacaccaacaagcaacaggcaattttcatttttctcaacattctcagagttgtaaactcacatctcaaccaagctgctgctccaagcatctggtcggtccaagtagaaagaacagtgggaagaaaaggggaagaaccaataacaaagaagcaaaacttttttagaaatcttgaactaatgtctcgtaggccagaactgtgtcaccggactatcccttgatgcaacagtgttggagaaagtaaatatttttaaccaggtgccttgccacatccca

SEQ ID NO: 1307 - DNA, 23293 bp, Homo sapiens
actttggaaattgtaagaatacatggaaattaaacaacatgctcctgagcaaccactggttcaatgaagaaatttagaagaaaattaaaatgtttttgaaatatgacaatgtaaacacaacatacagcacaaatagtgctaagaggggagatgctctgaataaattctttcatccaaaagtagagagatttcaattaaacaacccagtgatccacctgagggaactagaaaactaaaaacaaactgaaccccaaattagtgaaaggaaaaatatagtaaaaataagagcagaaccaaacaactagaaactaaaaaaaaacaaacccaaactcaatgtaatgaaaagttggtttattgaaacaataaataaaattcctaagtgtctagctaggctatactatatatgtgtgtgtatatatatatatacacacacacacacgtatatatatatatgctatactatatatatagtatagatattgtgtatctatacatatataaaaatatatatatagacagaaaaaactgaatgaaacaaaatcagaaactaaaaagaagatattacaacttatatcatagaaatacaactgtatattttggacaataatacactaatgaaaccgtatgttttgaacaagtatacactataattgaacaccatggaaaaagattaattccctgacatatacaactcacacaaaatgagccaggaaagaagggtaaacctgaacagactaataatgagtaaagaaatagaatcagtaataaaaacgaaatctcccaacaaagcaaagtccaggcctagatggtttcactgatgaattctaccaaacttataaggaaaaaggaaaagcattcctcatcaaacaattccaacaaattcagagaagagaatacttcctaactaattttacaatgccaggaataccccaatgctaaaaacatacacgaacacaacaacaataactataacaaaaattagaggtcagtatttctgatgaacacagacacaaaaatcctcaagaaaatgttagcaaaccaaatctaagaacacatcagaaagataattagcaataatcaagtggtatttatcccagggatgcaagaatggttcagcatacatgaatcgataaatgtggtacatcacattaacagaataaagacaaaaccaaataagcatatgaatagatgtaggaaaaagcatttgataaaagttagcatccatttatgataaaagttcccaacgaactacacaaagaaggaatatacctctatataatgtaaccacatgtgacgaactcacacctaacatacagaatggggaaaactgaaagccatttctctaaaaactgaaataagacaccactcagtcaacattttactttatgtcatgtcctagcgagaagaatcaggcaagcaaaaaaaataaaagccatccaaattggaaaagaggaagttaaattgttcctgtttgcagacgacatagtcttatattaggaaaaacacactggggcctttcagagggtagagggtggaaggagaaagaggatcaagaaaaataactaatggtactaggcttgatacctgggtgatgaaataatctgtacgacaaacccccatgacacaagtttacctatgtgacaaacatacagttgtacgtctgaacttagaataaaagttaaaaaaattgttaacataaaaaaagaaaaatctaaactccaccaaaaaaatttaggactattcaataacattgcaggataaaatatcaatatgcaaaaattagtagcatttctatatactagcaataacccagcaggaatgaaaaatcagctatgaaattccctttacaaagctataaaaaattaattactcagtaatacatttaagcaagcagactgatgtttaccagctatatgactgaaaatgtcaggcaatcatattgagcttttgttttttcatctgaagagtaaacataatgcaaggaattattaaagggctaccataggaataaaagagctaatggtataaaacattattagtattattagtattgcatagtatctatgcaatagtgtaagtcagaaactgaaatggcagaaatctacttttaataaccatttacatttaatgtaattattggtatttttgagccatttttgtttttcatatttatactacttttgattgtttttctttttcctgatctatggattccttgaaaatgttttttgattccattttagttgatctgtaaattttttgcgtgactctctgtacagcattgttagtggttgctccgtgttacattatgcatacatagcttttcacagcctagtgctgtgcacattttaccctattcagtaaaatatggaaaccttgctttcctgtctttttaactgctccccctttcccactgtttgtaacagaatcatattaaatatatgtctatgtgcatttagtgccacagtaaattttgtcatttttgctttgacataaatttattgtcttccaggtttgcagctcagaaatctgaactgggtctcactgcgttaaatccatgtctcaaggctgagttccttcctggagtctctagaagaaaagctcattatcttgccacattccttggccctcttccatctttaaagctagcaatggccagttgagccatttgaaactcatgcagaaaacgtgagaagaaagatattttgtgtttacctactttgtatttccaatttttgtttttggcttgttgtcattgttgttgttgttgctcattcttgttgttgttgctcattcttgatgttccagaaaaatcctattctattttttcctttatgattagtgaccttcatagaaccattttataagataggtctgttggaaagaaattctcttagatttttttttctgtcttctaagaatgcctgtattttctctttattgatgagtagttatattggacataaacatctggttgacattttttttctttcagcactttgaatattttagctacatcctattggttattctgctctctggtaataacaccactgttactcacattgtgttttccctatagctatggtgtcatttgtttcttgctgctttcaaaacattttttttagtttttagaaatttgactacagtgttgcttgcatggattttcttgggtatattctggttggcagttgctcatcttcttgcatctgtaggtttatgcccattgcaagtttggagaattttcagccattatgtctttgagttctctctcaatagcatcctcattgttcttcccttctgaagctcagattttatcattatcacattatttgttataacctttcttgttcataacagtatttaaaattttaccctgtgttcgagtatacagtttctattaatccagcctcaagaatactgactctttcctccatcatttcctttctgttagtgatcacaccaaataatattttatttaattttttacactacatatctcagtatcaaaatttctatgtcattatattatatagtttcttttttctgctgggaattttttttccatttaaattgagagtgtacacattgacctcataatggatgtttgtaacacctgcttcagtgagattgaaaatctcaccgttttaatatccagattgtttcaaggttatcatctcttgattatttaactccttgagaattggtcgattgtttctgattttataaagtatgttgagtaattttctattttatcccacacacaggactttctctgtttacagtacacaataagttcaatgaaggaagttttggacattggagggtagaggccttcttgcttaattgagatccactcactggttcagatagcaggggattttgtcccactaacatttttctacttggagcttctgcctggatgatcctttatggctcttacgagataaaactataagtatatttaacatcatagcatacatagtgtgcactgaaggggtcccaaaaaattcctattcacaaagtcttttttagttttcttttgtgcatcatttgctcaaatctcaattgaatttgaggacttcattttcctttcttccctacagtaacaacacagtttaacacctgcttaattagagtctattacagtacccgggtaggcctgctgtcttctgactggggatttatagaaagtggataatacggctgaggtaaaatcaacgactacaggcctggcgaaatggctcatgcctgtaatccaactactttcaagggcagaagtgggagaattccttgacacaaggaatttgagatatgcttgggcaacatagtaagacccagtctttataaaaaaattacaaaaggatcctggctcggtggtttgcacctgtagactcagctatttgggagggtgagctgggagtatagattgagcctgggagagcaaggctactgtgagccatgattacgccactgcactccagcctaagagagagagcaagtcaaagtctgaaaaaacaacaatgaaaaccacccaaaaaacaaaaaagactagggccaccaaaaaggctttctttttcacttgacttcttgctccagggtttacctttttaaagtgcacctcccagtgtctagggagtctacagacttggagtctcttcctttcttgcctcggtatcacaagtggctccatcctatatccttcagcactccttccccatttcccacagagccaagtagaatagtgatttgaacacatataagcaattttaatccctaccctccttgatgctttacaaaattttgggatggatctgttaagcttttgtctcatttgagtcagggatatctcaggcccagctcaaatccttaaaggaactgagatcagagtagaggaatagaagtgataagggagatatgtataaagtgtcttcatgcaagtaaacaagacacatttaatttcaaattcaagcagtgcagacattgctcaaaaccaattgaataaacatttgaattttaggtctccccaaaggtctacaacagtgatggagtatctttaattcttctacctcttgttctctatggaaaaaagcaaatgtaaaggtgtcatttggtaagtttgtttcaattctaccatcagatactcagttttcaaccatttccctatcctactcattaatgaacagcataagggaaattttcatacattttggtcaacataccagctattggtgtgtcctttttacattaactgaagaataataaatagtctttacagatgttacgagattacaaaacaaaaagcatccaaaggatctaaattagggtgtaatgtggatgcctaatggttttctatcagaactctcaccaattgccctgtctgatgagagaaatgagcaggagctctgtcgtggtgaaggactctgctgaagctcccccaggcatttctctactagagttctggctttctcaaaatattctcagaataagcatatattgtccttctctggcccttcagaaagtcaataagcaaaatgccttgagcttcccaataaactcttacaattacctttgcactttcctcatccactcttctttgactggaccacttccacctcttggtagccattgctttgattgtgctttgtttcatgattgtactgataaagccatgttatatctgctgtcacaattctttgatgaaatgcttcaggatctttatccccttatttaaattttcagggaagcttcttctcttgtctgtagctgctctggttgccatagttttggcatccacagagtgaaaaatttgctcaacattaatttttcagttagaatcatgtaagatgaaccaattaaaaaacatgaagggttggctattgtttgtactcttaatcttcattcctcttctatcatggtatcaacaagatacatttgatatgaatactctgtcaccgtagacttgaggttcagcaccatttcatcccttcttgaaataacatatctacttgtgaactgctgatttcttcagccattatccatatgaacttttcagaaagcatcagtggttttaccttctttcatgcaagcttaaccataaattttctctttgttttcactttaattttagaaaaatgtattttgctcttataggggatgttttgaaactcctgtcttatttttcattattccttgaaatagctcctattcagacatcttacagcatatcagtttaggttcattttgatgccaaaaaatgtggaatccttttatggtatttcttaatataacatacattttcatgaactttttaaagacctactacattacaggaaggcctttcaataatataagaattgctacaggtaacattgaattttctagttgattaggcagattaactttctgtttttctgctgacataaatagtgatgtgggttgagaaggaatataataccagtggtcaaatattctgcagctatgtggaaagtcaaacagttgcaactaagtgtcacatgctttaagggagtcatagagtagctgcttgggcctagcaggtaccctgatgttaacaggatgattgtctctggtttcaccaaacattacttcaaaagagttactggacatgagcagttttgcctaggtagcttacagtagaccttcaagtaggtaaggaaggtcagagagaatgagcagaggtgaatgccagtcagatgtgcctctttgagtgggtagctgaggaagttccagtcctggtgggaggcaggcttctccttgtctcctgagtccaggaagagaacaggtgatgcttccatatatcactcaactcacaccctattcctgaccctctctaatgtcagaaatgagtgagagagatttgtgtttcaggcaagaataaatattgggtatcaacctaccagacaaccaaaacagagattaccaaagagctgaaggagacactgtgactgacttagaatggagtcaaagccaggagcaggactgcagcaggcgcttaggcatctgtacaggagtcaaggacctcagcaatccacctgtcatttaaaatgaatgtaaacataccgtgtaccaagtagaatcttgatttccaccttctataacctgttctctttaatatcaacaatcattaatttcagaccaagaaaccagaatatattgagaaacacatcaatgaaacaatacatttcccagaactaaaggttaattctccatatcgaaagggcccaatgattatccaaaagcccaaatttaacattttcagggctcagtgcaagaagacaattagtggctaacatactccaactcttaataatcacacattataaagcaagctagactctaggtttagatcacatttccatgtaagtccttcagcctgttgcttggagattgctcatataagctggcatagagactaaaggtgtctgtgtttccctgtaacaatcctgaccccgcaatctgagaggtgggaggaggggggcacagggctgtctgctagagaagcacactagacgttgggctggagcccaggactgatctgcccaagcttcgagagcccctgccaggcatgttatgctcccctatgcctcacttctgagtttggactagtggcaatgtctacacagctcccaatgataaccctactgagcataggactggcagagaataataaccagaatatacaaacaaacaactcaaaaacaacaaaatagtccattaaaaagtgaacaagagatagaaatggacatcttttcaaataagacatacaaataatcaacagtatgtgaaaaatactctatatcactaatcatcagagaaataaaaatcaaaaccacactatcaccttaccctattcagaatggctatgattaaaacaaacaaacaaacaaaacagatgttgggatggatgtggagaaaggagagctcttatacaccctgattggaaagtaaatagtataaactctatggaaaacagtatgatttctcaaagaactaaaactcgattactattcaatctagcaatcttactactgtatctatgcagaggaaatgaaatcagtatatgaaaaataaatctgcacttctatgtttattgaaacaccatacacaacagcaaagatatggcatcaacctaagtaaccatcaatggatactaatgggtttgtaggtaaagaaatcgtgatatatacacaatgcaatactactctgcaaaaaaaaaaaaaaaaaaaaaaaagaaggaacgaaatcactccttttgtagcaatacgaatggaactggatgtgacagataatatgctatgtgacaaaggccagatacagaaagtcaagtataacatgttgtcactaataagtaggtgctaaaatgtgtttacatagatatagaggggagaactatagacactgaagccttggaagagtgagtgggtgggagggaattaagagttagacattaattagtaaatgcaatatttgttattcttgttatggaaaccctaaggccatgatttaaccattatgcaatgtatacatgtaacaaaattatctttgaaccacatatatttataaaaataaagtttaaaaataaattgagggtgaccgggtgcggtggctcacgcctgtaatcacagcactttgggatgccgaggcggatggaacacgaggtcaggagttcgataccagcctgaccaacatggtgaaaccccgtcttaactaaaaatacaaaaattagccaggcatggtggtgcatgcttgtaatcccagctactcaggaggctgaggcaggagaatcgcttgaacctgggaggcggaggttgcagtgagccgatatcttgccactgcaggccagcctgggtgacagaatgagactccatctcaaaataaataaataaataaataaataaataaataaataaatataattgaaggcaaatttaagcatattttttcaaaaaagaaaaagagggagatggagtaggagaaataaaaaagaaggaagaggaggaggaggaggaagaaagagcctgcatttctaattgtcataattaaatttccataagcagatactattttttttaaaaaaaacctaattagaattttacgggtctgataagaaagaaaatgctaaaaaaaatatgaatactcagtgtgttcctattttgtttgaaagcctagaaaaaaacaatatcagagactattctacttagattttttggacaaagaaatcttaagatttttaactcgggaacatttaattcctcacaatttcatgtctgctgttctttcctaaaatcattattgtgaagcagacatgactatatccactagtgtttcatgtatgtgatctgcttagtcttcatcctttaggggagccattttgattattcaaaaatttagaagaggaaacttaggctctgagacttaagtagcttcctatgagtccagagttagcaagacatagttcttaaactgcaatctgagagattccaaattctttgcccattcaagtcaggctgcctctgatgaaatccatttaggttttcttaagaatagtaagactcataggcagggacagaactgatcagtgataaaatatgggaaaataggtctagtggcttctggggaatagaggcatagaaccatactcatttccctagaaaacaaaatcggttacttttgaacttgttaaaatttctctcagcttctgggattttctttcattggtattgttttgcttacattcataagctgactagaatatcaagaaatgacctgaaaataattgtacaacttaaattcgagctatagaagacagagaaggaaagaaacagtggaactccttccccaggtggatgacttaataaggataaggaggagagaagcttgctggaaacatcaaggagaaggggtcctggatattcttacaatgtgaacatgggtctcagattctagagtcccaaacactcagaaagagacaccaccagcagaaattgcaagctgattgttttattggtatactgaagttagagcatgatgccatgtttcacggcatttgaaacactgttatcttcttattcacttcctgaaaaagacaagcaaacaaggaagattacagacaacacttgacatggcaggaaatgtctaatccctcactgggggttactgcagtgatggagatgcaagcccctactcttgccctctatcccttctacagcccccttctccttagtaatattttctttgttcactctttaagccattgcacataatgtgatttaaagtgttgcttagatgagaaagagaaacaattattgttatgtgttcatgctttgctgctgttggttatgtaagggctatttttacaaagatgggcactgcaacatatcatataatagtgagaatgtgaatccagccttaatatccagtgacagggattggttaaatagattacggaacaaccaaacaatagaatagtatacaattgtaaaaacaaactaaccaataaacactgaagagatctaaatgaactcatgagaaagttttctaaacaataaatttttccagtgagtaagacacaaatctgaatatacagtatggtataagtgcttgtaataaaagcattatatatatttatgtagcaatatatatttcaaaaagtagattccaaagagtaaaaggtgggggttttgagaaggatagaagggaggaaagatgagttaggctcttactatttagctctgtacatttcggttcagtgagattagtttttgttagcttaagcatgtatgactttaaatgtaagtatactaaaaatgagataccattttacaactgaaagttcaaggaccacttagcaggaatactggacctgaaagcctgatgtgaggcaggactgagcaaagcatgttcaggtgaaaactttaaatgggagtctgagtttgaggaaagaaaatagagagagccaaagggggaacatggttctatgtcctcattgtcaaccctacttaagacatgtaatttgaagatagtgattctcaaaatcagaattgccttcaagagcttctgtaaaacacagggtcacagggtcttgatactctatacaagaatatctgaataacaatttttagaaatgtgttccaggacagggcaatattaacaggttttcagaggattcattggcacaatgaagttggagaactgtagcagttggagcctttgatggataataaactggaatcgtacctgtcattgaatcctagattactgaggagactgcccctgtggaggtccttgtgggcggcccccttggggaggtggtccctggggctttccaggaggaggtgggggaggaccttgctgatggcctccctgttggggtggtccttgtggccttcctcgaggaggacggggatggcctccctgttggggtggtccttgtggccttccttgaggaggagggggatggcctccctgttggggtggtccttgtggctttccctgaggaggtggtggaccttgttgctgctggcctccttgttggggtggtccttgtggctttccctgaggaggtggtggaccttgttgctgctggcctccttgttggggtggtccctgctgagggccatcatcctggttcccatcaccagcagagggttgagattgctgtcctcccaaaggtggtccctgacgctcctcatctaggaactgctcagagtctcctccatctgtgtgagttgaaacaagaagagctgagctcatgctggaaaaccctcctgtcttcatacctctctgtcttcaccacacggccggcccctctctgcctgacctgcctctcaactcccaacctccccccttcccaaggcttcctaattagaactcctcttaatccacataagggtgatgaaaaattgaatttctttactcatggtccccagaatcaaggttgggagaaaactgtttgtatctttggggcattggtattagccaattcctgacaagaaaatggtgataagaagacactggagaactcatcaatttttcagggaaaaatggagacagagtttactgagaatttattgggatttacctgatattacgaggggaacatcttcctggctgacatctagaaaagaagtacaggatgatgggaaaagttacttcctgaatcattcaaggctcatagtgttctacgaggataaaggacctctgatcacaccctgtgcatcccctttgtgatctcatcagccactctctgatgctactggaagtggaagaagatgtaagggaaagcagtattgttactacactgagcgtcaaccaggaactcaacatagaagggcccctgtttgtcctcttttgattccccaagccttgatgaggaatgaagatacaataggtcttctgatcctcggcatgaaaattctgcagtcccatctgttttctcatcctcctctcttccctccactttcctcctctatagcatttgcctgtaaacccttagcgcttatttagttaaactgctctgagtatttcaatgacatatttggggattcttctgccctctttcatctgtaaatatgttgtttatgtttgcaagccttctcaacaggagccaccagacatagccacttggatataatcttacgcatgccattcccagcacattgaaatactacattcaggagacagaaaaatgacaatgtttcactctggttattctctaactctatgtagacagagacaagtgtttacccaattctctgcctcggcagtagctctgacatgtgtttatctccttcattaatgctcatccactgtacagcaaggccaccatcatccctgtctactgggatcagtacaggatcttcacagctgtacttccctgaatctgtcttgcattctccacatccttcacagcagtcccatgtctctatataatgcaaatctcactctctcacacccctagtacgaattctttattggattctatttgtgcaacaaataaactatgaggccttgatgaggaatggaggtacaatagatcttctgatcctcagcatgagaactctgcagtcccatctgttttctcatcctcctctcttccctccactttcctcctctatagcatttgcctgtaaaccccaatcagagtcacaatatcttcccccaattcatcttaccttcatttaaatcctgagctgagctgaaggccagcagggccactgacagcagaatcagaagcatcttgcaggaggctctggtgtcactcccaactttgtgctgggagaaacgtgtcagctccctttataaagacaagcaggacaatggtgcatttgagctccctaccaggtgggcctcctcgcctcagagactggcttctgctttgcttacttcaggtcaagtgtatccctcatttcttttgggactctagctcagcaggaagggttgggtaggatattgtttgtgtctaattcctaaaaggcacaactatgacttggacaaatgttttgacggaactgtgtccaagcagtcggcacagtgtcaggattgaactttagacatcttttggttttcaatctgtttggaaagactgctattctgcttttcactgtgcttttcatttctgtgtatgtgagtttgtgtgggtgtgtcggggggtggacactgatcctacagctaacagtgaagatggtcaatatctctgactgttttgatagcctctttccatctctcatgatgtgtgtgcgtggatattttcacatttagctaaatttttcatgtaacagagatggtcttgcttatctgtgagatgtgtgaggacagcacactcccaggcacacatatatgagagaaaggtgctggcagcctgctcaggctacaagaattgtccaaacttctgtgaatctcactacactcaggcaagccttggtgctatacaacacaggcaagctaaaatatttgtattttaaaaatatctttagggtttattaaagcaaaactgaactcagaaaccaccaaggaatttctagacctgaacaaactgaatatatggttccctaagtgagccacacgatgtcatatagctaagacctccactttctccagaatattccatagaattcatcctctactttatttcttctaataaatattgtaattgtcatcactgataattaaatggccacaattatacattcatctaagataatttgtaatacctgtccaagcctcaattgccttgattggtcttctgcttttactcagtaattatgtcacctgtttcatcagagtgttctttctcaccaaggatttttatctgtaatattccaatactcattctttctcattctttttctcgcacttatttgttgaaattttgtattctgagtctaccttgccatgtttacttttcgtcctatatctttttttttctccctacaaaggtgtcctttatttatccttctaagtaaaggtgtgtggtactcctcactacctttactttcatttttgtctgtataatttgacaataaaaaattaagtttccaaaaagccctgtcagggtcctggtttggtagctctctcctcagctgctgattgctccaaaaattaagtttccaaaaagccctgtcagagtcctggttttgtcgctctctcctcagctgctgattgctctgtgatacctagaaattccctgctcatcaattcataaaatatactactcagaatcaccagctgcactttccatttcagaccttgagtaggtcttgtgtaatttttcactttttgtgcatggttagtctttatttgaggatagcttggttggaggcatggctgagaagccaggtgacagaaaatcataaagacaaggccctagacaggtgtgcatgagtggatcctgtgctgggcatatgagggtctggtatggctcttctgaaaagttgcagataataatacaagaaggcttcctagtagattagattttgctacagacgacattgttcttgtaagggacccaggcagattggtattttccctggaataaatatagacctatttcaggggggaatgcattcttaattggcaattcttctctggccctgtgggaagtagatcagctctagctgggccgtatgagttgtatctcaggcacagagtagttgcttgagcccagcagctcccaatgcgttatggagattattgtctctggtttcaccaggtactgtttcccataggacctggagatgagcagtcctgcctcggtgacttcaggtcaaccatcatgtcaaaaaggaaggtcagagaaaaggaacaaagaggagtgccaggcagatattgcctgatgatgtgggggactgaggaagctgcaggcctggtgcaagacaggtttctccttggcagcagagtacaggaaaagaacaggaaatcctcctaaaggtcactcagctcaggcctgctccctaacctgctccaatgtcagcaatcagcgagagactagtgtatcaggaaagcataaatatcagctatgctctcactagacacatcaaaaacagaggtaatggaagagctgaaagggacactgtctgtgagtgaaggtgggtgaaagggagacgcaggactgctgcaggagcttgggtacctagaggtgggtggcagccctcagcaccacacttgccttctactatagatgttcatattctgaggccctgaagggccagtcttcaacatatgaaattttaggattcatctctcataacacatcccaacattttctcggtcactgacaggtgtttacctagtggttcaaaaatcctcgctccctccaggaacttatgcattagccgatctaattgcctccactttcaaaatacgtcccaaatatgaccacttgcctgatctttactagaaggtgattgttcagccatgatgctctctcctggaggactttaccagcctccagctggtcttggtaatgttcttcccccagctcatcccatatcagttccctcacaacaatcagagtgatcatttaaaagtagaaattaggttatatcacatttgtgcttcaaatctcctgttttttcttctgcacttgtgataagatccaaatttcatgcctcagctctttcacacccacatgcctcactcttttttgaaaaccaggaagctctctgaatggaacagaaagtagaatcttcttcgacttcaccatgctctagtttgcctggaacactaaagatggtttgccaggaaagatgaacattgacagagggaataaacttctctgagagtcagtgagtttcattgggtcgctgtggtctggcagtgttatgaattggcagaattattctattaattgcaccaactaagcattctgataatacagttagcaaataaacacaatagtctctgagacttcaacttgctttgacttgtctaaaaagtttggtgacactattatggccaattaactattaaaaatatcttctatatttttaaatttgatgttagtggtccataaatatatatatttcacaattaatttagcatatttcttttttttttttttgagatggtgtcttgctctgtcacccaggttggggtgcagtggcatgatctcagctcactgcaacttccacctcccgggttcaagcaattctcctgcctcagcctcccaagtagctgggattacaggtccctcgccaccatgactgactaattttttcccatctctactaaaaatacaaaaaaaaaattatatctaaagaaattaagtcacatggctagggtcactgtagtaaatgaggaaaaattaagttgattttctcttctctttgtaattccagtttaaccggatgttgtcgatgttgttttcaatttagaaaatatagcaaattgttcattagccatgagtatcactctgctatccaccactttctaagaaggcgcttattttagaacaaggctaacactaaattacaggaaattaagtaattgtggcaaactagagaagcatagtatgtataataggtcttactcagttagatccacctgtcaaggctgagtccctttctggagtctctagagaagcacccattttttgtccacattccttggccttcttccatcttcaatgccagcaatagccacttgagcctcccatcacatagcatcacgtcgcccttgcactgactcttctgcctccctcttctgcagttaatgaccttatggttacattgagtccacctagataatccaggataacctttctaaattcaggtcaattgattcgcaaatgtaatttccctttgtcatgtaagttaatatattcacttgtctgagaattaggaagtgtgtgactttgggagactgttaatcttcatagaacacacaggatggacaccttacccatctagacctggtttggctcagtgagagttggagagactcacccaggcttcttccagatatttgcatgagaatatgaatgagtttatgtataattagttgttatacaaatatttgtgacttaaagtatatatctatgcaaaagcgtaaatcacaaactgagatggcaaaaatttactttcaataaccattgacacttaatgcattttttgatattttagagctgtcatattttttgttttttatttatactacttttgattgttttctttttcctgatctcctatggggccactgaaagtgttttataattctattttagttgatccgtataatttttgagtgtatctctctgaacagtgtttttagtgattcttctatgttttactttacatgtacatagcttataatctagtggtgtacactttttaccagttttagtgaagtatggaaaccttacatccctttataatttttaggtcaaaatgaatttattatttttcagttttgtaggtcagaaatctgaactgaggttcactgagttaaatccatgtgtcaaggctgagtttcctcctagaggctctagagaagaatgtcatttttccacatttcctgtctctcttccatcttcaatgctagcaatggctggttaaaacatatgaagaaaactcaagtgaaaaaggaagatatattgtgtttgcccactttccccctttctcttatttttacttcattcttgatgttccacaaatttctcttctattctttcctttatgtttagagaacttcatttggctattatttaaagataggtttgttggaaagaaattctcctaggtttctagcttttctttttttcttagaatgcctggatttcctttacattaatgaaggatatttttattgaacataaacatctggtagaccatttctacttttgagcactttaaatatttgtgctcctttctactgttatttctggtttctggtgataataaccactattatttatattgcattttccctataactatgatgtcatttccttctttctgctttcaatattttgtctttaattttcagaaattggacaatgaattttcctggaatggatttcattggttgtattctggttgggatttgctcagcttcttgaatctgtaggtttatgctctttgctgtgtttggaaaatttttgatcattatttctctgagtcctttttcaacatcaacctcttctgcttttctgaaactcagaatgcatgaatagtacatcatttgttatagcctttcatattcatgatatgatgtataattttttcaattattttaccctgtattgtttagagtatataatttctattgatccaacctcaagaacactgtctttcctccatcattttctttatgctatttatcatgcccaataaaggttttttaagacattatatttttcatttctaaaatatctgttttcttaatttataatttataattcctatttttctgctgacaagtttttcctttccattcattttgagtgtctaccttgacctcatgaaggatgggtacaacagctcctgtaaagtctttggtcattttaatatctaagtaatttcaaggttgtaatttcttgattgtttcattccttgagaaatggtcgattttttgtgagttgttttgagtacattgagtaattttctgttttatcttgcacagagggattttctctttttgcaatacacaaaaagcccaataagggtaggttcggacattggagggtgaaggcactcatggtaaattatgctccaccaactggctcaaatggccagggagtttgtcccactaacatttttggtggttttccctgggtcaatctctctggcacttatgagataatattttaagtatttaatatcacaccatacatacagatataaagacaataaaaagcagtgcatcgaatgggtccaaagggccctatccacaaagtcttcctaactttggtgtgtgtgtgtgtgtgtttgtgtgtgtgtgtgtgcactgtttgttcaatcctcatcagttgaactcaggcacttctttttcctttttctttctaaacctgcttgttagaggctgtcacagtagccagaaggccctgctatcttctatttgagtatttatagaatgcaggaaaaaagagggtaaactataaagaacgactgtaggcctccccggtgcagtggctcatgcctgtaatatcagtacttggagaggcagaggtgggaggactgcttaaggccaggagttctagaccagcctgggtgacatagtgagactcctctgtctttacaaaacactaaaaaattatccaggcatgatggtgtgtgcctgttgtcctagtcatttgggtggctgaggtgggaggaaaagaagggaaggaaagaggaggggatgggaggggaggggagggttggctttttttttttcctcttggcttcttgcccttctttctagtgcacctcccagtagggtctcttttgtatttcctcacatgctattgtcctccatccctcagcaccccttcccccaacccccagaaccaagtagaatggtgatttgtgcacatatatccaacagggctatactaatttgagtccctactctccttgaagctttgcaatatgttgggatggttctgtagggtctttggtgtcccttgggtcaggaagatctcaggcccagcccgaatccctaaagcaattgacatcagaatagaggtaaagaagttatcagggaaatatagagaaagtgtcttcaggccagtatgcaagacacatttactttcaaataagcattattgccactactcggtggttaactgaataagcatctgaatgtaacaactttgggagatccttaatcttttcacctttccaccaaaggcctgtaacaactttgggagatctttaatctgtctacctaatgttatctggagaagacagctaaatctaaaagtgtcatttggaagtctgtttcagttctaccagtggtactcaattttcaaccacttcccaatcctcctcattaatgagcaacataatagaagaatatttatttaccaattacaaacattttagtcaacatgttagctaccagttcccatggactttcagcaaatcctattaatcagcttgtaggatccttcactttctcctcagaaggccaggtctttgggctgtgttccatcctcgttgccaaaattattataagctaacaacttagcttgtcacttgttgtacttgcagaaggcaaaagatggtttattattcactgaagtactagcagtagtcagaggaatatcatcgtactatttcttcaagcttcagtcccctcacagggataagatgagaaactgatgttacatgtgcaagtagtggtgtctatcaaaagagaaatctcaaaattaggaaactccagtcttaaaaactttgatcactgtgagtaacctgtccatcttgccttctgaagaagaagctttacactggaatgtaagcaaatatctctggagagaagaagaagaagagaagagtctttatctttaaacaaatctgccttctgaccaagagggataccctatttctaaatcccaaggctctttgccatgacctggtcttgggcaaagtgaacgagactcctagggcacaaaacgtaaaaaggcattcaataggttgcagggccctaaaaccaagtggctcctcaaactttgcaccctgcatgccttgctcacctgatcctagttgaggcccttctgtttgctcatcaaacatactgtttgctcacaagataagagctagaccatgcagaagtgcaatacattcatggagaatttttttcccaacatccattcccaagatcaaggttacacagttgccaaagattgtagagtattctgaatatatcatctattttcttcctggacagaactaaatccatcagaagtaacttttttaaaaaatgtttctttcttttgcatacaatttgtttttattttagattaagagatgagtccagaggtaagggggacaggagaactgtgacatcagggatgacactaccctttgagagcactggagcagttagaaaggattgaaagtgaataatcttatttcataaggggtatgtcattttatgattcaaattaagtctgtgattatcacttagcaaaattgctaaaatcattatcagaatatcccatatcatgataggaggaagaaaaagaagtaaaatctaaaattgttatggaggtaaatagaagactgccataaacaagctatctacagaattatggggcttaggaattcacagtaccctataaacaagaacacagctttgagaatttctatactctaatttttaaaaatgaagtatattttgtgaatttttcacccacaaattattttaactggaagccatcacagctcattaatcagcaattggtgaaggactaaagcagcccaaatcattcctgtctcaaagtaaggcctgcttgtaagcaagtgtgaactggggatgtatgtgcagaaatcagagcctaagtatggtaagctggacatttcagagataaggaaggcagctggtgtgtgtgaaatcttatatcaataactgattttattttttcagtcctaattgctattatggaatttgtgcttttcattattacatcttcacaaagcatgatttttaactttagaacaatttacattttatgctggataattctgttgtgagggactgtcatgtgcattgtgagatattgagcagcatccttgtcctcgtacagttatcaggtaaaatacagagtgtgtcagttcaatttgaatttcaaataagcaacaaataattgtcattgtctgtgtatccaattatcaatgctgcaggtctgtaattggtcctccatagcacacttacattatgatgtaaactcatattatggttatcacaagtaatacttatttataaatttattcttgttgttttttcttttgtctgaaatgtaaatttaactaggcctcctatatttttatttgcttaatctgttaacattacaatagatgccagcagcatccgtccaattttaactgaaatgtctccaggcattattaaatgtcccctaggggggcaaaattgccctgtgtggagaaccactgtcctaaagggatttcatcctttgcacatggaaatctcgtggtctattctctggatattttaattttattcacacatttaaaatttcgttttaggcctgcaatgtccaggttatttttctagggtttactttttgttctatcgattaccatataattaactttttaaaatactttctgcaatgttgaaaatttgtcttttgtctttactgctgaaaattatattatttgcttgcaatatgttcttttttttcttagagagaacgtaattgttcttcaaaatctgcttccaattatttcattttaaatatttattactgttaccttaaacttgcgattgtgttcttttatttaacctgctatttttacatgctttctcattacatttttaagaggagacgttcttattaaattcaattctgtaaactgattggttatccctgatttgtttttcttttcaaaactttatttatttttctttctttacacagtgactttcatcaaatgagatcctgtatttgttactatcgtcttggtcttctatatttttatttactaaacctggtaactctacactagatgccagcagcagtcctccaattttgcttacttaaaatcttactgattttttaatacgtgtccttgccttccttacacagttaaccaattgagtaaaattttattgt

SEQ ID NO: 1308 - DNA, 21558 bp, Homo sapiens
ctgcactacatccccaaatgattgtgccttgtgaagtaattcccaatagaggatagatatgaatataataaaatatagagctttatttaaaaaaaagagagagagagagactctggacttcccagaacccaaaggtgataccttgtgtttaaaacttagggatctcaaccaggcatggtggctcatgcctgtaatcccagcactttaggaggccgagaggggcccatcacttaagtccaggagttcaagaccagcctgggcaacatggtgaaaccccatctctactaaaaatgcaaaaattagctgggcatggaggcgcatacctgtaatcccagctacttaggaggctaaggcacgagaatcacttgaacgcaggaggcggaggttgcagtgagccaagatcatgctgttgctctccagcctgggtgacaaagggaagctctgtctcaaaaaataataataaaataaaattcagggatctctgggaaagaaatcgggtgaacccagagatgaaggggaccccggagccaaggagatgatgttggggtgagatatcctgagccttaatatggatttgtggtgatgtgtgagttttgactaacgtgggcagagggaggcgggatgagttgatgtgatctcatggcaacgagaggaacatcagacaaaagaatcaggacaatagaaatagaaaggaaacagagcagacctggaaaaaaagagaattcagaattgatgacagaaacaggagctgtgtgtaggaaaatgaaacacgggactaagcctacgatggccgagagaaaagctgatgctttcgtcaaagatatttgggacaaagaatttcaacttgaaaccaaagtgaggatttcctggacaccagagaaagctcttgctttaataaggcctcaggactgaaacctgaggtaattatagttaaaaaaaaaaaagggggggggatatcaccccaagggttgactgctcagggatcatggagacctcacaggacttgtcagtgctgttcatcttggccaacctaactgtggtgaagttccgcctctctcagcactgccctaaaactccctcacaccacatcccagatgttcagaaattctcgatatgtttgtaagccagtcggttgatgggggcaagggtgtcaagggaaggcttgagaaaggcaagcaggagtggaaggaatgagtctaggaaaaaagtttcttggaaaagaaactcctcaccttctcatgcccttcctgtggctctgaaaagtaaaccgaggccatctgagttgggaagccctcctgggagtgtttcctgcctgggctcccctccaggggatccgacttcacagtacagtcagccccctagaaagggcttctgggttaattagtggacagattgcttttgatttgctgttttcccttattgctctgtattagtgtttaattatttaattttaaataactttttaaaataaatgttgaaaattatttaattgtaatattgaaaagctttgtaatctctgaccccttgtgtacatactattgtgtagtttcaatcatagaatcaagcattttattttaggtagaaataaaaatacacctttctctttcttataccccaacatatgtgtgggatgaataacactgggatttaggctgaaatactctacttttactttttatggcaactattaacgacactttttactgtcaggtatcagaattttaaatagttcatgaattctcagagtatctcagtgcataggcaaaaatgctgcacctttgtgggcgtgtgtgtgtgtgtttttgtgtgtgtgtgtgtgtgtgtgtgtgtgtgtgtacagaggttcacctggggacagagctgaaatgtcactccagggtctgtagtctctgagctcctctgccaaagcaccagcactgagagggaggaacttcaccacagttaggttggccaagatgaacaacactgacaagtcccgtgaggtctctgatccctgagcggtcaaaccttatttcagtctctacacccattcggtcaggatgggtctgaatcttggttgaccttgaggagaagctgctaatcttttgggcaataatgccctgaagagtccatctgcgtgctggggagcagaagggacttctgcgtgtaccacactttgaagaatgagctcaagctatgagttagtttccttccagggtagagaactgatgtttgtgtctctgcagtgatggctaatataggactcctgagttatgaatttgaaggaaggaaaattatggcaccttttatgctaaggaaggaataataaaatggtttctgcatacttctcactgtggccatgtttacaagcaagaagacgctgtgctttcagatcccacagatacctctccatctcattttaacagggttataaattaatgcaaaacagacacgttcatgtatccagatcatgtcatccaagaattacattacaacatgggtggagagttggcagtgctcacccaattttgacattcttgagccctgagggtgagagtgagtgtttataggagcttatagaaacttctatgacatccttagtttaaaaaaaaaaaactaaactaaacttcctgtgtgcatgcaaaggacattttatgaccaaagctggaaatcattctttatttttaatactgaggagagtatcttttattattataagaccctgtgtgtttttttattaaactataaatttaaccaattttatgagagacatcaaggtattaaattcttttcagatcgttcccgttgcataagtcaccaactgtttacagtattctgagttattcagtggtataaatttacagcaatttattttattttattttatttttgatatggagttttgctcttgttgcccaggctggagttcaatggtgcgatctcagctcaccacaacctccgcctcccaggttcaagcaatactcctccaagtagctgggattacaggcatgcgccaccacacgcggctaattttgtatttttagtagagacggggtttctccatgttggtcaggctggtctcgaactcctcccgacctcaggtgatccgcctgcctcggcctcccaaagtgctgggattacaggcatgagccaccacacccggactttacagacaatttttaatgggatcttgtggttgaaacagaacttcatagtcatctggcccaagctacccacaagtgcccaagtcctctctactgtgccttctgggtgctgggtcaggataaacagtttctgcctcagctctcctggggctgatccctaagtgacagcaactgctccttctttagtgaccactcatttctttctttttttttttctttagagacagggtctctctccgtcacccaggctggaatgcagcagtgtgatcatagctcactatagcctcaaactcctgggcttaagcaatcctcccaccttagcctcctgagtagctgggaccacaggcacatgccaccacacccagctaattattttattttattttttatttttgtagagacagggtctcactatgtggccaaggctgttcttgaactcctgggctcagccccacaaagtgctgggattatagacgtgacccatcatacccagcccactcattttttttactccggttaaaaagcacttctagcttgagaaaaaactggcttccatgcagttgtcctgggttctggcttctgggatcattctcaaccactgagtctcagcagatggcatgctgggcccttgtatctagggagggcttgcgtcatgtacacatgacatgtgctgggggaggacataaatttcaggatccttaatgaagaaagagtggagggggtgcagctttacaactctacgcccttcacacattctgagattccactcacctcccgaccccaggatcacagcatctgtgccactattgctggtgacagtgtcacatctttcagcaataccgggactaaactaatacctaagcctttcttccctgaggctagtcttcagagactcaaagacaactattatgccctgtctctacctctcctattttctagaccaaaaagcccaggcctttagccattcccctggggtcctggctccagggcccttcactggtggatctcctcaggcatcactcaggttactcactgtccctctcagagtctggcactggaaatgagacacagaactccagtgtgatctatagaacgaggaaagcaaaactatcacctctttttgtttttattctgctttgttttttaagaacgcaggacttctaaatctaatcagtaggacctcatcattttatgtgggttgttttgtatgtcactggttttgtgagagacctgcaccatacatcaaagttatcagactgaggctgaatgaaatccaccagtccaccttaaagacagctatcctgggaatgtgggcaacgtcccacttgcccactgctatagcttatagcaccttacactcacctcttcctacagattatttttgagtaacagcgtgaccatgttgtgcatttagccaagcaaacctttctagcttaggtgaatgagagggagcggccaacgtataaaacaaaatagtaagttcataaaaattacagtgcacaatagtctcagataaaatattaattgttaaacagaattccctgtatgtgacatgttctctttcctaataattttcagttatttcaaactttttactcaagttttttcaagcctccaattaaaggtgctgagctgcaccagtctctgtgacccccagctccaaccttcttcactacaattttgggggtactagcacatgccaggtacagtactcaattataaatatatgatttgtgtatatcgtgtgtgtgtaaaacacttcattttccccatggaaaaatttatccctcaccaccaccctataaagtagagtttgttacctccactttatagatgaaacaacaaggttccaagaagatgttgcataatattctacagatgaaataattaggaaatcaggccgggtgaggtggctcacgcctgtaatcccagcactttgggaggccaaggtgggcggatcactaggtcaggagttcaagaccatcctggctaacacagtgaaaccccatctctactaaaaatacaaaaaattagccaggcgtgatggcaggcagctgtagtcccagctactcgggaggctgaggcaggagaatctcatgtacgtgggaggcagaggttgcggtgagctgagatcttgccactgcactccagcctgggcaacagagtgagactccatctaaaaaaaaaaaaaataggaaatcagatgatttgacccaatgtgtctgtctctaaaggctgaatataatattgctttccccacatatatcatagtgctgctgtcacaggttgagttagctggctctgattttaaatagctaccatttaaatagctaccatttgctgaacatattgttaccacccagccacagtgatattgtttggaaaaaaacatttacaagttcaaggccatgttcaagttgttctttttggcttcagatctaatataccacagcacatcccctcatccctgtgcacttggagggcaggagggtgtcttagtcagtgttgcttccttccaagtcccgagcacagtgctgtgatgtagtcaggactcaatcttgataaacattggtgtaattaacaggtttcaggtccaccaaagaagtatatgctatgctgatcattgcagaagaatcccaaacataatgcaccccattttccagacacaagtgattgggagaaataacgaacttatgttgcgactcatggggagaggttacaaattgatgccaaaatctagtctcacacctgcttttttgctccccccagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctcaattgtggtggtacatcgattccagtgatttatggtctttccatttcttcttttattaaaaataacccaaatactcctcatttgagatattcagaaatcctaaataaactgaatttcatgatggataaaaatgggaaaaacttcaatagcagcttctgctgaactcatccaaagactttcccaaatgtcctggtatattagtcagctttcactatgttatgctatggtaacaaacaatcccaacatcataggagctttcaccaacatagttttacgtctccctcacatgtggggaccagctgcagctctgctccaagagtcttcttcattctggggtccagagcagcccctatgtgggacaggcaactttcatggcagagaaaaagagcaatggtggaaccaatgagagctcacaaagcttctgtctcagtgcagctgacagcatttctacttgcattccatccaccaacatgagtgacattgacaggtctggagtcaaaggtgtgggatgtacacttctcacatgggaatggactcagcaatgaatattttaattaattaatacagtttacaccacctggtaagtgtccctagcaacagagacataagaggttgagagaaaaatcattagaaagcaaaatgatcaaggctgcagaaagatattcctgatgagtaagatgctcagtgttaaatacttcgagttaaaacaagctgattcttgtaagcaagcatgctgtaaacttttgtaaatgtagcccagagccatagttactcagcataagtagcagtttcacctgcagagtcagtgctggaaagctaggatgtcttacatcctaggttaggatgtcaacagggaattctgcagaagtggatgattgaggatcctctgcctctctctagtattcatatgtgctaccactctcccttactacatgggttttcataggtgaatcccactcttcccccctcccatttgtaaatctacccatttaagcagggttcttagcctaggacccactgatttctagaagagtcatagataaatgttaatagggccatgaaatcatatacacaagttgggtatgcttttgtgtatatggggtgttttttttttcatgaagagaaagactatactttttatcaaattcacagtgacctggacccaagaaatgttaagaacctttattttaagacctaactcaaaagccgtttcaataccatgaggctgtgatcctcaaaactctatccccacttgaatcacccgtggcctgcctgtgttgtctcacctgtctcaaaaaacctcaacattttcaaccgttttttaatgactgaggtataacttacatatgctagagtgcacagctatgaattgtatagtccagtgaatttttacatatgtgtagacccatgtgcccagcacctaaagcgcatagaaaacatttgcagctaacctactggctttttttttttttttttttttgagacagagtctcgctctgtcgcccaggctggagtgcggtggtgcagtctcagctcactgcaacctctgcatcccgggtttaagcaattcccctgcctcagcctcccgagtagctgggattacaggcagctgccaccatgcctggctaattttttgtgtttttaatagagacagggtttcaccatgttggccaggctggtcttgaactcctgacctcgtaatccgcccgccttggcctcccaaagtgctgggattacaggcgtgagccaccgtgcctggccacctgctggctctttcatgtcccctctccaccaatgccatcctcaaaggtcactattatgacttccagcatcatagattagttttgccagttcttttttaacaaaactttattggtaatagttggttttttgttttgttgtattgagacagagtctcactctgtcacccaggctggagtgcagtgatgcgatctcggctcactgcaacctctgcctcccaggttcaagcgattctcctgcctcagtctcccaagtagctgggattacaggtgcatgccactacgcccagctatttttgtattttttagtagagacgaggttttgcaatgttagccaggctgttctcaaactcctgacatcaagtgatccacttgccttggcctcccaaagtgctgggattacagcacccggccttattggtaatagttttgacatatgtttacaacagcacactgttcaagaggaaatctcatcttttcacagcaagcaggttgaatcaccctgagcccacctggggacccaccccaggcctgagagctcctcctgggatggggagaagtgatgagagggggaaatatgaagatgaatgaggtggcttgccagcagctcctcacttttctattaagaaagaaaacagaccagggacggtggctcactcctataatcccagcactttgggaggccaaggcagctggatcacctgaggtcaggagttcaaggccagcctggccaatgtggcaaaacctcgtctctactaaaaatacaataattagccggggatggtagtgggcccctgtaatcccagctactcgggaggctgaggcaggagagtcgcttgaacccgggaggcggaggttgcagtgagctgagattgtaccactgcactccagcctgggtgacagagtgagacttcatgtcaaaaaaaaaaaaaaattgaaaacagcacggggtggcaggggagaagaggtgaaggatggctgacagctaagctggagaggggcacccaggatgggagaaggcagaagctgctgggtgaataaaacaggcagcccctccccagcaaccctagccttgaaccctgggcgatgaggtgggggtggaggggctgggcctcttccatgtccttttgcaggactgccttcccataaggagaggctgggcatcacaatctggctgagaataaaattaaggagtttcggggaaatgctgctgtgaagaaagacttgggcttggaactcccactctgtctttttgggggacaactcctctttggcagggagtagggcagctgcttttctggctcccaaagcccaagggtgaagaaaagtctgctggggaagaagagagtggagcttcctaaaagaactgagacctttgcaagagtgatagaggatgcccctggggaggggggagggggaaatcagcagttcatgggggaagttcaaaccccagagcctccttccaaagtcagtcggcttcctggatttgttaaaatggaatggggagacacggtaaggtgggaagggtgggaggggtggaagtagaggaaggaggaaaggggacactggtggaacttaaataagattttaattgttttttgttttaattttttattctagcaaacagcccactgaacatggcactaaacctctctccttcccaggcaggattacgccaaagggtaggtgtgcttttcattcatcctctcttagtaagtggtgcctgttcagggctggagttaagtttgagcccctctttccacaccgtgtcccttgatacaacagcaagacctggcctgaatagagctgagaaactcgtttaaaacaggcagaagggggctggggcaagggggaccctgtgggaggagaaagagagaagcacagagggaccaggaaggcatgggggggggtgagggagcagctggtgtttctgttcctccaaatatctgggcttcctgctcccccaaccctggagggtggggtgaggatgaaattagatacaaggaactctggggccctctggctgttcaatccaaccctcccatcccccaaaccaccaaaaacaaaaaggaaagaaaacccacaggggcacaagcacacccctaaaactcagaaaactccttggcacacttctcattgatggagatccggagctcttcctcctcgtagtcgtcaaagttactggcatccccagggcctgtgtacttcgggatgaagggagcttccaccttcttctcatagatggcgatccagctggttgtggcgaaccacttgtggttcttgatgtcgccaaccccgttcctgaggtttccgaagcgcttggtgaggtccacctgcagcaggctccgcagcagatgcttgaggtcagagctgagtttggagggaaaccgcaccctcccagagacgatcttctcgtagatctggatgggctggtcggcgtagaagggtgggaagcccacggccatctcatagatgagcacccctagggcccaccagtccacggccttgttgtagcctttgctcaggatgatctcgggggccaggtactctggggtcccgcacaaggtccaagtgcggcccttcacgcgcttggcgaaaccgaagtccgtcacctgcaggtagccctgctggtcgatgaggagattctcgggcttcaggtcgcggtggatgaggtcgagcgagtgtaggtactggacggccaggacgacctgggcggcatagaaacaggcatggggctcgctaaaccttccgacgcgctgtaggcgggagaacatctccccacccggcacgtactccatcaccaggtacaggtaggagttgtccttaaaggagaactggagcttgacgaggaacggaaagtcgatcgcctgcaggatgcgcttctcgttcagtatgtgctcgacctgcttcatcttcaccaccttctgcttgttgaggatcttcatggcgtagtggccgccggtctcctggtgcctcaccagcatcacccgcccgaaggagcccatgcccagcgtcctgagccgttcgaactgatccgagctggcggtgttttgagcggggtttccccatctgtagaggaaatctcctctggctttggctaggaactcgttcacgctctcctcctgctcggtgtccttcttggcgggggcgttgcccatggcggtggcggcggcaggggcgggggtctcgcggcggcggcggcggcggcggcagcggcggagatggcgccccctggggctggctgcgctggctgcggcgctgcgacccccgcccggcctccgcttatattcccagctacatgggaggctgagatgggaggatttcttgagcctgggaggtcaaggcttcagtgagccaagatcacgccgctgcactcaacaatatggataaatccaaaaggcattatgcaagtgagagaagccaactctaaaggagacttactgtatgaatccatttctatgacattccagaaaaggcaaaactatagtgtgagagaacagatcagtgattgccagggcttggggttaggggacggttggactatgaagggacagcctgagggaatgtgggaagtggtgggacatgtttgtatcctgattgtgctggtggttacaatgtattgggtggtggtctacatttgttttaaaactcatagaactggccgggcgcagtggctaaagcctgtaatcccaacactttgggaggccgaggcgggcggatcacaaggtcaggagttcgaaaccagcctgaccaccatagtgaaaccccgtctctactaaaaatacaaaaaaattagccaggcgtggtggcgcatgcctgtaatcccagctactcgggaggctgaggcaggagaattgcttgaacctgggaggcagaggttgcagtgagcagagatcgtgccactgcacaccagcctgggcaataagagtgaaactccatctcaaaaacaaacaaacaaacaaacaaacacctcaaagaactgtatacttccccccaaaattcagttttactgcatgtaatgttttattttaacacatacatatgatttcctttcttctgtttgctttgggtttaattgctcttatttcctaaggtgggaactaaggtcactgatttgaaatctttcttctattacaatcacttagtgctataaatttcctcctaagtattattttttgcagcatcccacaaattttggtatgttgtattttccttttcatccagctcaaaatattttctaagctcccttttcatcttctttgacagataagctatttaaaagtatattatttcgtttccaaatacttggggatttttcaagaattttcctattgatttctgatttaattccattgttagaaaacatactctgtgtgacctaaaatgttttacacttcttggggctcattttatggcccagaatatgatctatcttggtagatggcccatatgcacttgagaagaatgtatattctggtgtattctgctgtttgaggatacagtgttctacaaatgtcacttaggtcaagttggctagtagtagtgttcaggtcttctatattcttattgactttctgtttacttattctatcaattattaaaaacatgccacaggagtttatgagaagtcaaagtacatagatgatgggccttccatcactcccccaggccaccatgtcagccgccccacacaccctccagaagactgccagcactcagccatcacagggtgggttctgagctgctctccccagtcaattctgtacaaagattctgtcctacatcataaacactgagctacaggaatacccatttatcctcctattttctctccatcttgccctttaagtttgacagctaattctgcctacccaccctggctacaccgcctgtagctagtgcaagtaaacaacacactttcacctagccctgcaggctgaaaccaagcaaattggagaggaatccctgattacttgactccaagtagaaggtttctattgtgactgtgaattcttgccgctcagttcagcagatgttggtcaagcaggtgtctattgtgtgcaaggcctggttccgagtttacggtttaatctggggccagtacttgggtactgactgtatattcagagacggtcaggttagagaggaagaagaggaaaggagaaaaatctactgttgatcatctgaacttccacaaaagggaaacccacattccctcaagaacatagcaggggggtcaattgccccttgtgctttgggtcaaggcaaatccctggcagatggaaattccacgtctcccccataatctcagtgatttcctcttcattttcatcacagtagatctgctaaaattctgcccatttctgacttacctccagattattcagtagaaatttatacacaaagagcaattagtgggaagccattctcttggaccgacgccttggaagtgggacagtttgtttagaagcaggctgtgccattccatgacaaattcttgtggcattaatctctgaagttcaattaggaagacacaggggtctagagggaacatatgctgcacactagaaatgtccccatgcttcgtttacaggtcagaacatcaagtatttatcccagaacaagctgcagaataattacatttgttatttctctccactttccgttctgcttttctccatggccttggggagcaagggagtccttagcatgccaaggaaacaggaatccttttgcattcagataaaccctttcagaaggaaaagatttgtgtagcaagatacaatacctctgcatgatctgcttggagcttgcctagggggccaaatgaagaggtgaaagccaactctgctttcctgtatgcccaatgaaaggcaatcaagaccattcttctcccaaaaaactgctcactggcagtcatgccagctgattctcctctttactgtttatatagcagtttccaaatggctaattgcataaggcttggatcattcaattctaacttcctctctatctccaaaatattgatgggagcaaagaaaagaacaaactccaccaggattcaaataagaaataaactacaaatctctatcactcagggaattatttacataacactgcatgttctggtccagaaatacttatcatacctggattttgacaagccagcttctattaatagtttgttttctccttattagcagaatattgtaaaagaacatttttgaacacaaagtttctatgtcagatttatgatctataaaatgctgatttaaaaattggcgtggcctttgttatatgaaagatgaaaaattatgggagtcaggaagttcagaaataacttaatgacaataatttataaagtactacatttatttaaagtttgggcaatcattcatcccttggtaccactaattttgccacaattttttttttctttttttttgagaccgagttttgctcttgttgcccgggctagaatgcaatggcacgatctcggctcaccgcaacctccacctcccgggttcaagcaattctcctgcctcagcctcccgagtagctgggattacaggcatgtgccaccatgcccagctaattttgtatttttagtagagacggggtttctccatgttggccaggctggtctcgaactcgcggcctcaggtgatctgcctgcctcggcctcccaaagtgctaggattacaggcgtgagccaccgtgcccggccaccataatatttatagaagtggcttgacacacatgataatgagcattgtaatgtttttgggacctgaaaagaaagtagtcctagaaataggcccaacttgcttacctaaaaatatatcttctgacatataagaactgccaaaagtgattacccctagggaatagcactaggaacttagagaagcataaattaaaggaaggaaaatttttacttctcactttataagcttctgaattgctaaaattaattttgagcatgaattactttacttattaaaataaaaatgaggtaaaacattggtttctcacaaatgcatttacttatattttatatgtcacttttatatactgtttaaatccacaaaagggagacaatttttataaaattattttccccatattttgtagttctccttcgtttcctggcaatagcactctgttttatctttgagggattacttctacctcatttcatctgattctgttgggttcccaatctaacccactcacctgagtcaaagtcagggatggccacaggacccaagatagatcgatcagtttatgtctctcaggaattgaatcttgagcagagacacagggggatttgaggcatttgtaaaggagccatccaaatacagcatcttagaaggctgtccatgtttctacagctgttggccaataagttccttgccttctgtcctgagccctggtttttcagttcttcctttatgtgtctttccacataaaggaagcaaagctttttttttaagcaaagcaaatgggacaaggcgggggtggggaagagaaagaaagaaacaaatttattgaagacaataatgaattcaggattgaacacattgagttcataggtccttaagacattcaggtagagatgtctaattagccaatggaaatctgggattgaacttagtagacagataagcactggcagcacagatttaagtggtatgagagtgttagccaaggaacgtgagccgagagagaacagagtcaaggagggggattgtgggaaactccactatctgaggatgggggtaggaatgtcaggcactgctatttgcccaccatggctgtgtcttgtgaggcctgccgtactcagtccttctgagaccttgaagagaatttcttgtgcacacctacacaagaagtgggcattgtcacatggttgcaatgtgactgcacatgtataatgcctagtaattatcatgcaacatacagacagtacagccgagtggctgaatgggaaactgtacccaggacaagatgttagatacagataatatggactgcgacaggagcttcggcactcatgtaaagtataatggcatatgagtttcttggtgacctcttctgctatcactgtaacagcctacatttcatgatgaagagttgaggccctcaagagaaacagaacaggagagcgcttgatgatttcctctgaaatctcatctgcagcacttaacatgtgtgatacagcacacctgccaattaacagaaggccctaggtggagcagaacattcacaacatccttctgccaaaatatgccctataatcagagctcacaaaccgatgcacatcaaaagcagtggttcttaattttaactgcacattgaaatcacctgagacattaaaaaaaaaagaatactgggttgggcatggtggctcacgcctgtattcccaacactttgggaggccgaggcagggagctcacttgaggtcaggagttcgagaccagcctggccaaaatggtgaaaccccgtctctactaaaaatacaaaagttagccgggtgtggcggcaggcacctgtaatcccagctacttaggagactgaggcaggagaatcacttgaacccgggagccggaggttgcagtgagccaaaattgcgccactgcactccagcctgggtgacagagcaagactctgtctaaaaaaaaaaaaaaaaaaaaaaaaaaaaatactgatgactgaatctgcctccagagattgacttaactgcccaggcatgtgacttgaacgttgggacttttaaaagctccccaggtgattctaatgcacagccgagttttagaaccattggatgagcccatgaacacattttgtttaacccaatatagttataggcctaacagagtatttcaaattttaataattgttttctcaatgtaaagagtcgtcagtttcatataccccagatcatccagatttcagtctcctgttgtaatatttgtgcacagtaggcctacgtttccacaggacaccattcagctatgctgagttgctactgcacctatgtaagcattttctctgcacttcacagcccttcctgccccacccaactatcaccactgcacagagctaatgacagttgctgcttatcatcctgttggctctgtgggtttttttttttttttttacattagcgttaaaagtaaaatagtgcttatgccatgtctccagcagagcaagaaagaaaaaggcagcccaggaaggctaagtgttccatagggcactcatttctggcacctgcctggcccctgcagcatttgggtgcatgcccttgatttaaatcgattaatgttttcccagaaggagccccaaaatgctttatagcctatagaacaaagagctgagaagtgagaggtcccaattcaattatcttaataattagagagctcttgaagacaaaagaaagctatacaaatacagcaaggaaaagggggtatccagtgaccagttccataattcaggaaatgcaggagatttgaagagtttgtatgcattataagggacaaagagggctggagctgaacctgaactgtgagggatggaagtgcctaacctggagttaaaaaagaataagaagattgcaaccctaggggtaaactgcagacctttcagaactgcagaaccccaggagctagggcccaatgcatccaagcttgagtctgtttgagaatctccctttttcagcctctccaacactgtactagatgaggacatctggcctctgggtctgtacatactgtcccctctgctatgctctttcctccttgccctctttcacctggccaactcttcatctctctgatctcagaaactcatgctgtcaccacccccaccaagtcaagaccaggccactctcatatgctcctgtagtatcctataattaccccatctagcacttatgtgactttgtaaatacttttacgttatcatctctctccgcaagactgtgagctccatgagaacatgttgattatcaatctttgttaccactatatcatcagcaaccacagtgcctggaactgtggacgctcaacaaacaatgatggatggatgccgggcgcggtggtggctcatgcctgtaattccagcactttgggaggctgaggcgggcagatcatgaggtcaagagatcgagaccatcctggccaacatggtgaaaccccatctctactaaaaatacaaaaattagccgggcgtggtggtgcacgtctgtagtcccagctactgcggaggctaaggcaggagaattgcttgaatccaggaggtggaggttgcagtgagccaagatcgcgccactgcactccagcctggaaacagagcaagactccgtctcacaacaacaacaacaacaacaaaaacaatgatggatgggtttgtaaaccaaaactaaaattcaaagccccccaactgactaaatggacccccctcttagccaaggggagtccaaagaaacctgcaaaactagttcaggccactccaggaaggggtaggggtcagacatgcctcattataccctctcccttttgtagtttgtaaccgcccaatgggatcaccttgcccaatgcctagacagagccgatttatcaagacaggggaatcgcaatagagaaagagtaattcacacagagccagatgtatgggagactagagttttattagtactcaaatcagtctccctaagaatcggggatcagagtatttaaggataatttggtgggcacaggccagtgagtcgggagtgctgattggtcaggtcagagatgaaatcagggaatcaaaggtgtcctcttgtgcggagtcagttcctgctggggggtacacaagatcagatgagccagttgattggtctgggtggtgccagctgatccactgagtgcagggtctgcaaaatatctcaagccctgatcttagattttacaatagtgatgttatccccaggagcaatttggggaggttcagaatctggccgccttcagttgcatgactcctaaaccataatttctaatcttgtggctaatgtgttggttctgtaaaggcagtctagtccccaggcaggaagggggtttgttttgggaaagggctgttatcgtccttgtttcaaagttaaactataaactaagttcctcccaaagttagttccagaatatgtttccttgctatattttgaaatggccctgcaaagctttcttttgtgggggagaatttacatctgtaaaaaaatcttttttttttttttttgagacagagtctcactttgtcgcccaggttggagtgcagtggcgcaatctcggctcactgcaacctctgcctcccaggttcaagcgcttctcctgcctcagcctcccgagtaggtgggactacaggtgcatgccaccacgcccggctaatttttttttcttttttgtatttttagtagaggcgggttttcaccctgttagccaggatggtcttgatctcctgaccttgtgatccaccttcctcggcctcccaaagtgctgggattacaggcatgagccactgtgcccggcccaaaaatctcttttaacataagtggatctttccttttccaggccctccaaatccctgaagagattaactgagagtctaatacctaccttttaaaggtctgcataggaaatatttgcatctataatctctaagctacctatgagacttgatctatacaataagaaccttggtctccacaaccccttatcttaacccagacactcctttctattgcttccaggtcttcagataataacttaactctcaaccaattgccaatcaggaaattgttgaatccacctatgacctgcaagcactctgcccttcaagttgtcacacctttctggaccaaaccaatgtacacctcacatgtatacatgtattgattgatgtcttaatgtctccctaaaacatataaaaccaagctgtggccaggcgtagtggctcacgcctgtaatcccagcactttgggaggctgaggtgggtggatcacaggttcaggagatcgagaccatcctggctaacacggtgaaaccccgtttctacgaaaaatacaaaaacaaaacaaaacaaaaaaaacttagccaggcgtggtggcggtccactcccagctacttaggaggctgaggcaggagaatggcgtgaacccgggaggcagagcttgcagtgagccagtgagccgagatggcgccactgcactccagcctgggcaacagagcgagactctgtctcaaaaaaaaaaaaacaagctgtaacccaaccatcttgggcacatattctcaggaccttttgagactgtgccttcgggccatgttcactcatatttgcctcagaataaaactctttaaatattttatagagtttggcttttttccttgacaggttgatgagtaagtgggtggaagaacagagtgggtgaacagagcaaacatgataaatggaagaaaggacctgaggttaaggaactggagattgtaatcagaaagcaggatcctatagttgaagatatctgagaaagaacaatttaaaatggcaataaagtccaaagtacagatacgaatatcagctggggtccagcctcacaaacaaaacctaggtccggcaattcacagagataatctaatgcagggaatttgttgcaaaggtgatggaaggactgaaagagctaccagggagaattagacaaactcaaaattaagaaatgcagaaaagttgcatttaccataactacgcatagaggaacagaaggaaaaaggtgttaacacagccccggagctgagactgaaaccacagtggtctgtccagcaagaggcggagccatggaggaaacccaatcactgctggaaatggtgcctgaagggaatggcgggaggagaaaaggagggcagaaatacctgcctcctctctgccacccacctgccagtctcccacaggcgcctctcgttggctgaacctctcttgaaacaaattggcaaagcagtttaggaaacgtaatttgcatggatcaggtttccttgaaagaaacagatgaggagaagagaatggatgtaacagcaaataggcaaacaagcaacccaagatgagaatggcttgctgaagctttatgagaagtga
